United States Patent 9,061,059 (MODIFIED POLYNUCLEOTIDES FOR TREATING PROTEIN DEFICIENCY) - sequence listing, part 87

SEQ ID NO: 170037 - DNA, 2817 bp, Artificial Sequence
  Description of Artificial Sequence: Synthetic coding sequence
atgacctgcctgagccaccccctgcagctggaggtgacagctgacctggccgagcggcggcgcatccgcagcgccatccgggagctgcagaggcaggagctggagcgggaggaggaggccctggccagcaagcgcttccgggcagagcggcaggacaacaaggagaactggctgcacagccagcagcgggaggccgagcagagagctgccctggcccggctggccggccagctggagagcatgaatgatgtggaggagctgacagccctgctgcggtctgctggggagtatgaggagaggaagctgatccgggccgccatccggcgggtgcgggcccaggagattgaagctgccaccctggccggccgcctgtacagcggccggcccaacagcggcagccgggaggacagcaagggcctggccgcccaccggctggagcagtgtgaggtgcctgagcgggaggagcaggagcagcaggccgaggtgtccaagcccacccccaccccagagggcaccagccaggatgtgaccaccgtgaccctgctgctgcgggcccctcctggcagcaccagcagcagccctgccagccccagcagcagccccaccccagccagccctgagccccccctggagcctgctgaggcccagtgcctgacagctgaggtgcccggcagccctgagcccccacccagcccccccaagaccaccagccctgagccccaggagagccccaccctgcccagcacagagggccaggtggtgaacaagctgctgagcggccccaaggagaccccagctgcccagagccccacccggggccccagcgacaccaagagagcagatgtggccggcccccggccctgccagaggagcctgtctgtgctgagcccccggcagcctgcccagaaccgggagagcacccccctggccagcggccccagcagcttccagagagctggctctgtgcgggacagagtgcacaagttcaccagtgacagccccatggccgcccggctgcaggacggcaccccccaggccgccctgagccccctgaccccagcccggctgctgggccccagcctgaccagcaccaccccagccagcagcagcagcggcagcagcagccggggccccagcgacaccagcagccgcttcagcaaggagcagaggggcgtggcccagcccctggcccagctgcggagctgcccccaggaggagggcccccggggccggggcctggccgcccggcccctggagaacagagctgggggccctgtggcccggtctgaggagcccggggcccccctgcctgtggccgtgggcacagctgagcccggcggctccatgaagaccaccttcaccatcgagatcaaggatggccggggccaggccagcacaggccgggtgctgctgcccactggaaaccagagagctgagctgaccctgggcctgcgggccccacccaccctgctgagcaccagcagcggcggcaagagcaccatcaccagggtgaacagccctggcaccctggcccggctgggctctgtgacccacgtgaccagcttcagccacgccccacccagcagcagaggaggctgcagcatcaaggccgcagaagatgctggcacccctgtggcccaccccccagccttcagcaccaggagaagaagcagcacaggcaccaccaggagcaccagcctgatggaggccgagcctgctgagcccctggccgctgctgtggaggccgccaacggggctgagcagaccagggtgaacaaggcccctgagggccgcagccccctgtctgctgaggagctgatgaccattgaagatgaaggagtgctggacaagatgctggaccagagcacagactttgaggagaggaagctgatccgggccgccctgcgggagctgcggcagaggaagagggaccagagggacaaggagcgggagcggcggctgcaggaggcccggggccggcctggagagggccggggcaacacagccacagagaccaccaccaggcacagccagagagctgctgatggcagcgctgtgtccacagtgaccaagacagagcggctggtgcacagcaatgatggcaccaggacagcccggaccaccaccgtggagagcagctttgtgcggcggagtgaaaatggcagcggcagcaccatgatgcagaccaagaccttcagcagcagcagcagcagcaagaagatgggcagcatctttgaccgggaggaccaggccagccccagggctggcagcctggccgccctggagaagaggcaggccgagaagaagaaggagctgatgaaggcccagagcctgcccaagaccagcgccagccaggccaggaaggccatgattgagaagctggagaaggagggcgccgccggcagccctgggggccccagggctgctgtgcagaggagcaccagctttggagtgcccaatgccaacagcatcaagcagatgctgctggactggtgccgggccaagacccggggctatgaacatgtggacatccagaacttcagcagctcctggagcgatggcatggccttctgtgccctggtgcacaacttcttccctgaggcctttgattatggccagctgagcccccagaacagacggcagaactttgaggtggccttcagcagcgctgagacccacgccgactgcccccagctgctggacacagaggacatggtgcggctgcgggagccagactggaagtgtgtgtacacctacatccaggagttctaccgctgcctggtgcagaagggcctggtgaagaccaagaagagctag

SEQ ID NO: 170038 - DNA, 114 bp, Artificial Sequence
  Description of Artificial Sequence: Synthetic coding sequence
atggctgatgaggccctggccggcctggatgagggcgccctgaggaagctgctggaggtgacagctgacctggccgagcggcggcgcatccgcagcgccatccgggagctgtag

SEQ ID NO: 170039 - DNA, 2823 bp, Artificial Sequence
  Description of Artificial Sequence: Synthetic coding sequence
atggctgatgaggccctggccggcctggatgagggcgccctgaggaagctgctggaggtgacagctgacctggccgagcggcggcgcatccgcagcgccatccgggagctgcagaggcaggagctggagcgggaggaggaggccctggccagcaagcgcttccgggcagagcggcaggacaacaaggagaactggctgcacagccagcagcgggaggccgagcagagagctgccctggcccggctggccggccagctggagagcatgaatgatgtggaggagctgacagccctgctgcggtctgctggggagtatgaggagaggaagctgatccgggccgccatccggcgggtgcgggcccaggagattgaagctgccaccctggccggccgcctgtacagcggccggcccaacagcggcagccgggaggacagcaagggcctggccgcccaccggctggagcagtgtgaggtgcctgagcgggaggagcaggagcagcaggccgaggtgtccaagcccacccccaccccagagggcaccagccaggatgtgaccaccgtgaccctgctgctgcgggcccctcctggcagcaccagcagcagccctgccagccccagcagcagccccaccccagccagccctgagccccccctggagcctgctgaggcccagtgcctgacagctgaggtgcccggcagccctgagcccccacccagcccccccaagaccaccagccctgagccccaggagagccccaccctgcccagcacagagggccaggtggtgaacaagctgctgagcggccccaaggagaccccagctgcccagagccccacccggggccccagcgacaccaagagagcagatgtggccggcccccggccctgccagaggagcctgtctgtgctgagcccccggcagcctgcccagaaccgggagagcacccccctggccagcggccccagcagcttccagagagctggctctgtgcgggacagagtgcacaagttcaccagtgacagccccatggccgcccggctgcaggacggcaccccccaggccgccctgagccccctgaccccagcccggctgctgggccccagcctgaccagcaccaccccagccagcagcagcagcggcagcagcagccggggccccagcgacaccagcagccgcttcagcaaggagcagaggggcgtggcccagcccctggcccagctgcggagctgcccccaggaggagggcccccggggccggggcctggccgcccggcccctggagaacagagctgggggccctgtggcccggtctgaggagcccggggcccccctgcctgtggccgtgggcacagctgagcccggcggctccatgaagaccaccttcaccatcgagatcaaggatggccggggccaggccagcacaggccgggtgctgctgcccactggaaaccagagagctgagctgaccctgggcctgcgggccccacccaccctgctgagcaccagcagcggcggcaagagcaccatcaccagggtgaacagccctggcaccctggcccggctgggctctgtgacccacgtgaccagcttcagccacgccccacccagcagcagaggaggctgcagcatcaagatggaggccgagcctgctgagcccctggccgctgctgtggaggccgccaatggagctgagcagaccagggtgaacaaggcccctgagggccgcagccccctgtctgctgaggagctgatgaccattgaagatgagggcgtgctggacaagatgctggaccagagcacagactttgaggagaggaagctgatccgggccgccctgcgggagctgcggcagaggaagagggaccagagggacaaggagcgggagcggcggctgcaggaggcccggggccggcctggagagggccggggcaacacagccacagagaccaccaccaggcacagccagagagctgctgatggcagcgctgtgtccacagtgaccaagacagagcggctggtgcacagcaatgatggcaccaggacagcccggaccaccaccgtggagagcagctttgtgagaagaagtgaaaatggaagtggcagcaccatgatgcagaccaagaccttcagcagcagcagcagcagcaagaagatgggcagcatctttgaccgggaggaccaggccagcccccgggccggcagcctggccgccctggagaagaggcaggccgagaagaagaaggagctgatgaaggcccagagcctgcccaagaccagcgccagccaggccaggaaggccatgattgagaagctggagaaggagggcgctgctggcagccctgggggccccagggctgctgtgcagaggagcaccagctttggagtgcccaatgccaacagcatcaagcagatgctgctggactggtgccgggccaagacccggggctatgagcacgtggacatccagaacttcagcagctcctggagcgatggcatggccttctgtgccctggtgcacaacttcttccctgaggcctttgattatggccagctgagcccccagaacagacggcagaactttgaggtggccttcagcagcgctgagacccatgctgactgcccccagctgctggacacagaggacatggtgcggctgcgggagccagactggaagatgctggtggactgtgtgcccctggtggaggtggatgacatgatgatcatgggcaagaagccagaccccaagtgtgtgttcacctacgtgcagagcctgtacaaccacctgcggagacatgagctgcggctgcggggcaagaatgtgtag

SEQ ID NO: 170040 - DNA, 1374 bp, Artificial Sequence
  Description of Artificial Sequence: Synthetic coding sequence
atggagcagaaggagggcaagctgtctgaagatggcaccaccgtgtccccagctgctgacaaccctgagatgtctgggggcggggccccagctgaggagaccaagggcacagctgggaaggccatcaatgaaggccccccaacagagagcggcaagcaggagaaggccccagcagaagatggcatgtctgctgagctgcagggcgaggccaacggcctggatgaggtgaaggtggagagccagcgggaggccggcggcaaggaggatgctgaggccgagctgaagaaggaggatggagagaaggaggagaccaccgtgggcagccaggagatgacaggcaggaaggaggagaccaagtctgagcccaaggaggccgaggagaaggagagcaccctggccagcgagaagcagaaggccgaggagaaggaggccaagccagagagcggccagaaggcagatgccaatgaccgggacaagccagagcccaaggccaccgtggaggaggaggatgccaagacagccagccaggaggagaccgtggtggaggatgaggccaaggccgagcccaaggagccagatggcaaggaggaggccaagcacggggccaaggaggaggctgatgagcccggcagccccagcgaggagcaggagcaggatgtggagaaggagcctgagggcggggccggggtcatccccagcagccctgaggagtggccagagagccccactggagagggccacaacctgagcacagatggcctgggccctgactgtgtggccagcggccagaccagccccagcgccagcgagagcagccccagtgatgtgccccagagccccccagagagccccagcagcggggagaagaaggagaaggcccctgagcggcgggtgtctgccccagcccggccccggggcccccgggcccagaacaggaaggccatcgtggacaagtttggaggagctgccagcggccccacagccctcttcaggaacaccaaggccgccggggccgccatcggcggcgtgaagaacatgctgctggagtggtgccgggccatgaccaagaagtatgagcacgtggacatccagaacttcagcagctcctggagcagcggcatggccttctgtgccctgatccacaagttcttcccagatgcctttgattatgcagagctggaccctgccaagaggaggcacaacttcaccctggccttcagcacagctgagaagctggccgactgtgcccagctgctggatgtggatgacatggtgcggctggccgtgcctgacagcaaatgtgtgtacacctacatccaggagctgtaccgcagcctggtgcagaagggcctggtgaagaccaagaagaagtag

SEQ ID NO: 170041 - DNA, 1539 bp, Artificial Sequence
  Description of Artificial Sequence: Synthetic coding sequence
atgctgcctggagctgtgggggagagtgactgcagcgctgaggcccgggagaagatggagcagaaggagggcaagctgtctgaagatggcaccaccgtgtccccagctgctgacaaccctgagatgtctgggggcggggccccagctgaggagaccaagggcacagctgggaaggccatcaatgaaggccccccaacagagagcggcaagcaggagaaggccccagcagaagatggcatgtctgctgagctgcagggcgaggccaacggcctggatgaggtgaaggtggagagccagcgggaggccggcggcaaggaggatgctgaggccgagctgaagaaggaggatggagagaaggaggagaccaccgtgggcagccaggagatgacaggcaggaaggaggagaccaagtctgagcccaaggaggccgaggagaaggagagcaccctggccagcgagaagcagaaggccgaggagaaggaggccaagccagagagcggccagaaggcagatgccaatgaccgggacaagccagagcccaaggccaccgtggaggaggaggatgccaagacagccagccaggaggagaccggccagaggaaggagtgcagcacagagcccaaggagaaggccacagatgaggaggccaaggccgagagccagaaggctgtggtggaggatgaggccaaggccgagcccaaggagccagatggcaaggaggaggccaagcacggggccaaggaggaggctgatgccaaggaggaggctgaagatgctgaggaggccgagcccggcagccccagcgaggagcaggagcaggatgtggagaaggagcctgagggcggggccggggtcatccccagcagccctgaggagtggccagagagccccaccggggagggccacaacctgagcacagatggcctgggccctgactgtgtggccagcggccagaccagccccagcgccagcgagagcagccccagtgatgtgccccagagccccccagagagccccagcagtggagagaagaaggagaaggcccctgagaggagagtgtctgccccagcccggccccggggcccccgggcccagaacaggaaggccatcgtggacaagtttggaggagctgccagcggccccacagccctcttcaggaacaccaaggctgctggagctgccatcggcggcgtgaagaacatgctgctggagtggtgccgggccatgaccaagaagtatgaacatgtggacatccagaacttcagcagctcctggagcagcggcatggccttctgtgccctgatccacaagttcttcccagatgcctttgattatgcagagctggaccctgccaagagaagacacaacttcaccctggccttcagcacagctgagaagctggccgactgtgcccagctgctggatgtggatgacatggtgcggctggccgtgcctgacagcaaatgtgtgtacacctacatccaggagctgtaccgcagcctggtgcagaagggcctggtgaagaccaagaagaagtag

SEQ ID NO: 170042 - DNA, 1485 bp, Artificial Sequence
  Description of Artificial Sequence: Synthetic coding sequence
atggagcagaaggagggcaagctgtctgaagatggcaccaccgtgtccccagctgctgacaaccctgagatgtctgggggcggggccccagctgaggagaccaagggcacagctgggaaggccatcaatgaaggccccccaacagagagcggcaagcaggagaaggccccagcagaagatggcatgtctgctgagctgcagggcgaggccaacggcctggatgaggtgaaggtggagagccagcgggaggccggcggcaaggaggatgctgaggccgagctgaagaaggaggatggagagaaggaggagaccaccgtgggcagccaggagatgacaggcaggaaggaggagaccaagtctgagcccaaggaggccgaggagaaggagagcaccctggccagcgagaagcagaaggccgaggagaaggaggccaagccagagagcggccagaaggcagatgccaatgaccgggacaagccagagcccaaggccaccgtggaggaggaggatgccaagacagccagccaggaggagaccggccagaggaaggagtgcagcacagagcccaaggagaaggccacagatgaggaggccaaggccgagagccagaaggctgtggtggaggatgaggccaaggccgagcccaaggagccagatggcaaggaggaggccaagcacggggccaaggaggaggctgatgccaaggaggaggctgaagatgctgaggaggccgagcccggcagccccagcgaggagcaggagcaggatgtggagaaggagcctgagggcggggccggggtcatccccagcagccctgaggagtggccagagagccccaccggggagggccacaacctgagcacagatggcctgggccctgactgtgtggccagcggccagaccagccccagcgccagcgagagcagccccagtgatgtgccccagagccccccagagagccccagcagtggagagaagaaggagaaggcccctgagaggagagtgtctgccccagcccggccccggggcccccgggcccagaacaggaaggccatcgtggacaagtttggaggagctgccagcggccccacagccctcttcaggaacaccaaggctgctggagctgccatcggcggcgtgaagaacatgctgctggagtggtgccgggccatgaccaagaagtatgaacatgtggacatccagaacttcagcagctcctggagcagcggcatggccttctgtgccctgatccacaagttcttcccagatgcctttgattatgcagagctggaccctgccaagagaagacacaacttcaccctggccttcagcacagctgagaagctggccgactgtgcccagctgctggatgtggatgacatggtgcggctggccgtgcctgacagcaaatgtgtgtacacctacatccaggagctgtaccgcagcctggtgcagaagggcctggtgaagaccaagaagaagtag

SEQ ID NO: 170043 - DNA, 312 bp, Artificial Sequence
  Description of Artificial Sequence: Synthetic coding sequence
atgtctgaggagaagcccaaggagggcgtgaagacagaaaatgaccacatcaacctgaaggtggccggccaggacggctctgtggtgcagttcaagatcaagaggcacacccccctgagcaagctgatgaaggcctactgtgagcggcagggcctgtccatgaggcagatccgcttccgctttgatggccagcccatcaatgaaacagacaccccagcccagctggagatggaggatgaggacaccattgatgtgttccagcagcagacaggaggagtgcctgagagcagcctggccggccacagcttctag

SEQ ID NO: 170044 - DNA, 426 bp, Artificial Sequence
  Description of Artificial Sequence: Synthetic coding sequence
atgtctgaggagaagcccaaggagggcgtgaagacagaaaatgaccacatcaacctgaaggtggccggccaggacggctctgtggtgcagttcaagatcaagaggcacacccccctgagcaagctgatgaaggcctactgtgagcggcaggtgcgccacctggccccaccccagagcctgcctgtgtgtgccctggtgctgtgtgtgcccggcatcccccgggcccgggccagccggggctggacccagatgcagctgcctgagggcctgtccatgaggcagatccgcttccgctttgatggccagcccatcaatgaaacagacaccccagcccagctggagatggaggatgaggacaccattgatgtgttccagcagcagacaggaggagtgcctgagagcagcctggccggccacagcttctag

SEQ ID NO: 170045 - DNA, 288 bp, Artificial Sequence
  Description of Artificial Sequence: Synthetic coding sequence
atggccaatgagaagcccacagaggaggtgaagacagagaacaacaaccacatcaacctgaaggtggccggccaggacggctctgtggtgcagttcaagatcaagaggcagacccccctgagcaagctgatgaaggcctactgtgagccccggggcctgtctgtgaagcagatccgcttccgctttggaggccagcccatcagcggcacagacaagccagcccagctggagatggaggatgaggacaccattgatgtgttccagcagcccactggaggagtgtactag

SEQ ID NO: 170046 - DNA, 411 bp, Artificial Sequence
  Description of Artificial Sequence: Synthetic coding sequence
atggccggggccggcagcgctgctgtgtctggggccggcacccctgtggccggccccaccggccgggacctgtttgctgagggcctgctggagttcctgcggcctgctgtgcagcagctggacagccacgtgcatgctgtgcgggagagccaggtggagctgcgggagcagattgacaacctggccacagagctgtgccgcatcaatgaagaccagaaggtggccctggacctggacccctacgtgaagaagctgctgaatgcccggcggcgggtggtgctggtgaacaacatcctgcagaatgcccaggagcggctgcggcggctgaaccacagcgtggccaaggagacagcccggcggcgggccatgctggacagcggcatctacccacctggcagccctgggaagtag

SEQ ID NO: 170047 - DNA, 2298 bp, Artificial Sequence
  Description of Artificial Sequence: Synthetic coding sequence
atggccggcttcaagaggggctatgatggcaagattgctggcctgtatgacctggacaagaccctgggccggggccactttgctgtggtgaagctggcccggcacgtgttcaccggggagaaggtggccgtgaaggtgattgacaagaccaagctggacaccctggccaccggccacctgttccaggaggtgcgctgcatgaagctggtgcagcaccccaacatcgtgcggctgtatgaagtcatcgacacccagaccaagctgtacctgatcctggagctgggagatggaggagacatgtttgactacatcatgaagcatgaggagggcctgaatgaagacctggccaagaagtactttgcccagatcgtgcacgccatctcctactgccacaagctgcacgtggtgcaccgggacctgaagccagaaaatgtggtgttctttgagaagcagggcctggtgaagctgacagactttggcttcagcaacaagttccagcccgggaagaagctgaccaccagctgtggcagcctggcctacagcgcccctgagatcctgctgggagatgaatatgatgccccagctgtggacatctggagcctgggcgtcatcctcttcatgctggtgtgtggccagccccccttccaggaggccaatgattctgagaccctgaccatgatcatggactgcaagtacacagtgcccagccacgtgtccaaagaatgcaaggacctgatcaccaggatgctgcagagggaccccaagaggcgggccagcctggaggagattgagaaccacccctggctgcagggcgtggaccccagccctgccaccaagtacaacatccccctggtgtcctacaagaacctgtctgaggaggagcacaacagcatcatccagaggatggtgctgggggacattgctgacagagatgccatcgtggaggccctggagaccaaccgctacaaccacatcacagccacctacttcctgctggccgagcgcatcctgcgggagaagcaggagaaggagatccagaccaggtctgccagccccagcaacatcaaggcccagttccggcagagctggcccaccaagattgatgtgccccaggacctggaggatgacctgacagccacccccctgagccacgccaccgtgccccagagccctgcccgggctgctgacagcgtgctgaatggccacaggagcaagggcctgtgtgacagcgccaagaaggatgacctgcctgagctggccggccctgccctgagcacagtgcccccagccagcctgaagcccacagccagcggcaggaagtgcctcttccgggtggaggaggatgaggaggaggatgaggaggacaagaagcccatgagcctgagcacccaggtggtgctgcggaggaagcccagcgtgaccaaccggctgaccagcaggaagagcgcccctgtgctgaaccagatctttgaggagggggagagtgatgatgaatttgacatggatgagaacctgccccccaagctgagccggctgaagatgaacatcgccagccctggcaccgtgcacaagcgctaccacaggaggaagagccagggccggggcagcagctgcagcagcagcgagaccagtgatgatgacagcgagagcagaagaaggctggacaaggacagcggcttcacctacagctggcaccggcgggacagcagcgagggccccccaggctctgaaggagatggcggcggccagagcaagcccagcaatgccagcggcggcgtggacaaggccagccccagcgagaacaatgccggcggcggcagccccagcagcggcagcggcggcaaccccaccaacaccagcggcaccacccggcgctgtgccggccccagcaacagcatgcagctggccagccgctctgctggggagctggtggagagcctgaagctgatgagcctgtgcctgggcagccagctgcacggcagcaccaagtacatcatcgacccccagaatggcctgtccttcagctctgtgaaggtgcaggagaagagcacctggaagatgtgcatcagcagcactggaaatgccggccaggtgcctgctgtgggcggcatcaagttcttcagtgaccacatggctgacaccaccacagagctggagcgcatcaagagcaagaacctgaagaacaacgtgctgcagctgcccctgtgtgagaagaccatctctgtgaacatccagaggaaccccaaggagggcctgctgtgtgccagcagccctgccagctgctgccacgtgatctag

SEQ ID NO: 170048 - DNA, 2298 bp, Artificial Sequence; identical to SEQ ID NO: 170047
  Description of Artificial Sequence: Synthetic coding sequence

SEQ ID NO: 170049 - DNA, 2298 bp, Artificial Sequence; identical to SEQ ID NO: 170047
  Description of Artificial Sequence: Synthetic coding sequence

SEQ ID NO: 170050 - DNA, 9693 bp, Artificial Sequence
  Description of Artificial Sequence: Synthetic coding sequence
atgcagagcagccccagccctgcccacccccagctgcctgtgctgcagacccagatggtgtctgatggcatgacaggcagcaaccctgtgtccccagccagcagcagcagccctgccagcagtggagctgggggcatcagcccccagcacatcgcccaggacagcagcctggatggccccccaggccccccagatggagccaccgtgcccctggagggcttcagcctgagccaggccgctgacctggccaacaagggccccaagtgggagaagagccacgccgagattgctgagcaggccaagcatgaggccgagattgagaccagaattgctgagctgaggaaggagggcttctggagcctgaagaggctgcccaaggtgcctgagcccccccggcccaagggccactgggactacctgtgtgaggagatgcagtggctgtctgctgactttgcccaggagcggcgctggaagaggggcgtggccaggaaggtggtgaggatggtgatccgccaccacgaggagcagaggcagaaggaggagcgggcccggcgggaggagcaggccaagctgcggcgcatcgccagcaccatggccaaggatgtgcggcagttctggagcaatgtggagaaggtggtgcagttcaagcagcagagccggctggaggagaagaggaagaaggccctggacctgcacctggacttcatcgtgggccagacagagaagtacagcgacctgctgagccagagcctgaaccagcccctgaccagcagcaaggccggcagcagcccctgcctgggcagcagcagcgctgccagcagccccccacctccagccagccggctggatgatgaagatggagacttccagccccaggaggatgaggaggaggatgatgaggagaccatcgaggtggaggagcagcaggagggcaatgatgctgaggcccagaggcgggagattgagctgctgcggcgggagggggagctgcccctggaggagctgctgcggagcctgcccccccagctgctggagggccccagcagccccagccagacccccagcagccatgacagcgacaccagagatggccctgaggagggcgctgaggaggagcccccccaggtgctggagatcaagcccccacccagcgctgtgacccagaggaacaagcagccctggcacccagatgaagatgatgaggagttcaccgccaatgaggaggaggctgaagatgaggaggacaccatcgctgctgaggagcagctggagggggaggtggaccacgccatggagctgtctgagctggcccgggagggggagctgtccatggaggagctgctgcagcagtatgctggggcctatgcccctggcagcggcagcagtgaagatgaagatgaagatgaggtggatgccaacagcagtgactgtgagcctgagggccctgtggaggccgaggagcccccccaggaggacagcagcagccagagcgacagcgtggaggacagaagtgaagatgaggaggatgagcacagcgaggaggaggagaccagcggcagcagcgccagcgaggagagcgagagcgaggagagtgaagatgcccagagccagagccaggctgatgaggaggaggaggatgatgactttggagtggagtacctgctggccagagatgaggagcagagcgaggctgatgctggcagcggcccccccaccccaggccccaccaccctgggccccaagaaggagatcacagacattgctgctgctgctgagagcctgcagcccaagggctacaccctggccaccacccaggtgaagacccccatccccctgctgctgcggggccagctgcgggagtaccagcacatcggcctggactggctggtgaccatgtatgagaagaagctgaatggcatcctggctgatgagatgggcctgggcaagaccatccagaccatcagcctgctggcccacctggcctgtgagaagggcaactggggcccccacctgatcatcgtgcccacctctgtgatgctgaactgggagatggagctgaagcgctggtgccccagcttcaagatcctgacctactatggagcccagaaggagaggaagctgaagaggcagggctggaccaagcccaatgccttccacgtgtgcatcaccagctacaagctggtgctgcaggaccaccaggccttccggaggaagaactggagatacctgatcctggatgaggcccagaacatcaagaacttcaagagccagcgctggcagagcctgctgaacttcaacagccagaggcggctgctgctgaccggcacccccctgcagaacagcctgatggagctgtggagcctgatgcacttcctgatgcctcatgtgttccagagccaccgggagttcaaggagtggttcagcaaccccctgaccggcatgattgagggcagccaggagtacaatgaaggcctggtgaagaggctgcacaaggtgctgcggcccttcctgctgcggcgggtgaaggtggatgtggagaagcagatgcccaagaagtatgaacatgtgatccgctgccgcctgagcaagaggcagcgctgcctgtatgatgacttcatggcccagaccaccaccaaggagaccctggccaccggccacttcatgtctgtcatcaacatcctgatgcagctgaggaaggtgtgcaaccaccccaacctgtttgaccccaggcctgtgaccagccccttcatcaccccaggcatctgcttcagcacagccagcctggtgctgcgggccacagatgtgcaccccctgcagagaattgacatgggccgctttgacctgattggcctggagggccgggtgagccgctatgaggccgacaccttcctgcccaggcaccggctgagcagaagagtgctgctggaggtggccacagccccagaccccccaccccggcccaagcctgtgaagatgaaggtgaacaggatgctgcagcctgtgcccaagcaggagggccgcacagtggtggtggtgaacaacccccgggcccccctgggccctgtgcctgtgcggcccccacctggccctgagctgagcgcccagcccaccccaggccctgtgccccaggtgctgcctgccagcctgatggtgtctgccagccctgctggccccccactcatcccagccagccggcccccaggccctgtgctgctgccccccctgcagcccaacagcggcagcctgccccaggtgctgcccagccccctgggcgtgctgagcggcaccagcaggcctcccacccccaccctgagcctgaagcccaccccaccagcccctgtgcggctgagccctgcccctcctcctggcagcagcagcctgctgaagcccctgactgtgcccccaggctacaccttccccccagctgctgccaccaccaccagcaccaccacagccacagccaccaccacagctgtgcctgcccccaccccagccccccagaggctcatcctgagcccagacatgcaggcccggctgcccagcggggaggtggtgtccatcggccagctggccagcctggcccagaggcctgtggccaatgccggcggcagcaagcccctgaccttccagatccagggcaacaagctgaccctgactggagcccaggtgcggcagctggccgtgggccagccccggcccctgcagagaaatgtggtgcacctggtgtctgctgggggccagcaccacctgatcagccagcctgcccacgtggccctgatccaggccgtggcccccaccccaggccccacccctgtgtctgtgctgcccagcagcacccccagcaccaccccagcccccaccggcctgagcctgcccctggccgccaaccaggtgccccccaccatggtgaacaacacaggagtggtgaagatcgtggtgcggcaggcccccagagatggcctgacccctgtgccccccctggccccagcccccaggcctcccagcagcggcctgcctgctgtgctgaacccccggcccaccctgaccccaggccgcctgcccacccccaccctgggcacagcccgggcccccatgcccacccccaccctggtgcggcccctgctgaagctggtgcacagccccagccctgaggtgtctgccagcgcccctggggccgcccccctgaccatcagcagccccctgcacgtgcccagcagcctgcccggccctgccagcagccccatgcccatccccaacagcagccccctggccagccctgtgagcagcacagtgtctgtgcccctgagcagcagcctgcccatctctgtgcccaccaccctgcctgccccagccagcgcccccctgaccatccccatcagcgcccccctgactgtgtctgccagcggccctgccctgctgacctctgtgaccccacccctggcccctgtggtgcctgctgcccctggcccccccagcctggcccccagcggggccagccccagcgccagcgccctgaccctgggcctggccacagcccccagcctgagcagcagccagaccccaggccaccccctgctgctggcccccaccagcagccacgtgcccggcctgaacagcacagtggccccagcctgcagccctgtgctggtgcctgccagcgccctggccagccccttccccagcgcccccaacccagccccagcccaggccagcctgctggccccagccagcagcgccagccaggccctggccacccccctggcccccatggccgccccccagacagccatcctggcccccagccctgccccacccctggcccccctgcctgtgctggcccccagccctggggccgcccctgtgctggccagcagccagacccctgtgcctgtgatggcccccagcagcaccccaggcaccagcctggccagcgccagccctgtgcctgcccccacccctgtgctggcccccagcagcacccagaccatgctgcctgcccctgtgcccagccccctgcccagccctgccagcacccagaccctggccctggccccagccctggcccccaccctgggcggcagcagccccagccagaccctgagcctgggcaccggcaacccccagggccccttccccacccagaccctgagcctgaccccagccagcagcctggtgcccaccccagcccagaccctgagcctggcccctggcccccccctgggccccacccagaccctgagcctggccccagccccacccctggccccagccagccctgtgggccctgccccagcccacaccctgaccctggccccagccagcagcagcgccagcctgctggccccagcctctgtgcagaccctgaccctgagccctgcccctgtgcccaccctgggccctgctgctgcccagaccctggccctggccccagccagcacccagagccctgccagccaggccagcagcctggtggtgtctgccagcggggccgcccccctgcctgtgaccatggtgtcccggctgcctgtgtccaaggatgagccagacaccctgaccctgcggagcggcccccccagcccccccagcacagccaccagctttggaggcccccggccccggcggcagcccccacctccacccaggagccccttctacctggacagcctggaggagaagaggaagaggcagaggtctgagcggctggagcgcatcttccagctgtctgaggcccatggagccctggcccctgtgtatggaacagaggtgctggacttctgcaccctgccccagcctgtggccagccccatcggccccaggagccctggccccagccaccccaccttctggacctacacagaggccgcccacagagctgtgctcttcccccagcagaggctggaccagctgtctgagatcatcgagcgcttcatctttgtgatgcctcctgtggaggcccccccacccagcctgcacgcctgccaccccccaccctggctggccccccggcaggccgccttccaggagcagctggccagcgagctgtggccccgggcccggcccctgcaccgcatcgtgtgcaacatgaggacccagttcccagacctgcggctcatccagtatgactgtgggaagctgcagaccctggccgtgctgctgcggcagctgaaggccgagggccaccgggtgctgatcttcacccagatgaccaggatgctggatgtgctggagcagttcctgacctaccacggccacctgtacctgcggctggatggcagcaccagggtggagcagaggcaggccctgatggagcgcttcaatgctgacaagaggatcttctgcttcatcctgagcaccaggtctgggggcgtgggcgtgaacctgaccggggctgacacagtggtgttctatgacagcgactggaaccccaccatggatgcccaggcccaggaccgctgccacagaattggccagaccagagatgtgcacatctaccgcctcatcagcgagaggacagtggaggagaacatcctgaagaaggccaaccagaagaggatgctgggggacatggccattgaaggaggcaacttcaccacagcctacttcaagcagcagaccatccgggagctgtttgacatgcccctggaggagcccagcagcagctctgtgcccagcgcccctgaggaggaggaggagaccgtggccagcaagcagacccacatcctggagcaggccctgtgcagagcagaagatgaggaggacatccgggccgccacccaggccaaggccgagcaggtggccgagctggccgagttcaatgaaaatgatggcttccctgctggggagggggaggaggccggccggcctggagcagaagatgaggagatgagcagagctgagcaggagattgctgccctggtggagcagctgacccccatcgagagatatgccatgaagttcctggaggccagcctggaggaggtgtcccgggaggagctgaagcaggccgaggagcaggtggaggccgccaggaaggacctggaccaggccaaggaggaggtgttccggctgccccaggaggaggaggagggccctggagctggagatgagagcagctgtggcaccggcggcggcacccaccggcgcagcaagaaggccaaggcccctgagaggcctggcaccagggtgtctgagcggctgcggggggcccgggcagagacccagggcgccaaccacacccctgtgatcagcgcccaccagaccaggagcaccaccaccccaccccgctgcagccctgcccgggagcgggtgcccaggcctgccccccggccccggcccaccccagccagcgccccagctgccatcccagccctggtgcctgtgcctgtgtctgcccctgtgcccatcagcgcccccaaccccatcaccatcctgcctgtgcacatcctgcccagccccccaccacccagccagatccccccctgcagcagccctgcctgcaccccacctccagcctgcaccccacctccagcccacaccccacctccagcccagacctgcctggtgacccccagcagccccctgctgctgggccccccatctgtgcccatcagcgcctctgtgaccaacctgcccctgggcctgcggcctgaggccgagctgtgtgcccaggccctggccagccctgagagcctggagctggcctctgtggccagcagcgagaccagcagcctgagcctggtgccccccaaggacctgctgcctgtggccgtggagatcctgcctgtgtctgagaagaacctgagcctgaccccatctgcccccagcctgaccctggaggccggcagcatccccaacggccaggagcaggaggccccagattctgctgagggcaccaccctgactgtgctgcctgagggggaggagctgcccctgtgtgtgtctgagagcaatggcctggagctgcccccatctgctgccagtgatgagcccctgcaggagcccctggaggccgacaggaccagcgaggagctgacagaggccaagacccccaccagcagccctgagaagccccaggagctggtgacagctgaggtggccgcccccagcaccagcagcagcgccaccagcagccctgagggccccagccctgcccggcccccaagaagaaggaccagcgcagatgtggagatccggggccagggcaccggccggcccggccagcccccaggccccaaggtgctgaggaagctgcccggccgcctggtgacagtggtggaggagaaggagctggtgagaagaagacggcagcagagaggagctgccagcaccctggtgcctggggtgtctgagaccagcgccagccctggcagccccagcgtgcgctccatgagcggccctgagagcagcccccccatcggcggcccctgtgaggccgcccccagcagcagcctgcccaccccaccccagcagcccttcatcgcccggcggcacatcgagctgggcgtgactggaggcggcagcccagaaaatggagatggagccctgctggccatcaccccacctgctgtgaagagaagaagaggccggccccccaagaagaacagaagccctgcagatgctggccggggcgtggatgaggcccccagcagcaccctgaagggcaagaccaacggggctgaccctgtgcccggccctgagaccctcatcgtggccgaccctgtgctggagccccagctgatccctggcccccagcccctgggcccccagcctgtgcaccggcccaaccccctgctgagccctgtggagaagagaagaagaggccggccccccaaggcccgggacctgcccatccctggcaccatcagcagcgctggagatggcaacagcgagagcaggacccagcccccaccccaccccagccccctgacccccctgccccccctgctggtgtgccccacagccaccgtggccaacacagtgaccaccgtgaccatcagcaccagcccccccaagaggaagaggggccggccccccaagaacccccccagcccccggcccagccagctgcctgtgctggaccgggacagcacctctgtgctggagagctgtggcctgggcagaagacggcagccccagggccagggcgagagcgagggcagcagcagtgatgaagatggcagccggcccctgacccggctggcccggctgcggctggaggccgagggcatgaggggcaggaagagcggcggctccatggtggtggccgtcatccaggatgacctggacctggccgacagcggccctgggggcctggagctgaccccacctgtggtgtccctgacccccaagctgcggagcacccggctgcggcccggcagcctggtgccccccctggagacagagaagctgcccaggaagagagctggggcccctgtgggcggcagccctggcctggccaagaggggccgcctgcagccccccagccccctgggccctgagggctctgtggaggagagcgaggccgaggccagcggggaggaggaggagggagatggcacccccaggagaagacctggcccccggcggctggtgggcaccaccaaccagggcgaccagaggatcctgcggagcagcgccccacccagcctggccggccctgctgtgagccaccggggcaggaaggccaagacctag

SEQ ID NO: 170051 - DNA, 9219 bp, Artificial Sequence
  Description of Artificial Sequence: Synthetic coding sequence
atgcagagcagccccagccctgcccacccccagctgcctgtgctgcagacccagatggtgtctgatggcatgacaggcagcaaccctgtgtccccagccagcagcagcagccctgccagcagtggagctgggggcatcagcccccagcacatcgcccaggacagcagcctggatggccccccaggccccccagatggagccaccgtgcccctggagggcttcagcctgagccaggccgctgacctggccaacaagggccccaagtgggagaagagccacgccgagattgctgagcaggccaagcatgaggccgagattgagaccagaattgctgagctgaggaaggagggcttctggagcctgaagaggctgcccaaggtgcctgagcccccccggcccaagggccactgggactacctgtgtgaggagatgcagtggctgtctgctgactttgcccaggagcggcgctggaagaggggcgtggccaggaaggtggtgaggatggtgatccgccaccacgaggagcagaggcagaaggaggagcgggcccggcgggaggagcaggccaagctgcggcgcatcgccagcaccatggccaaggatgtgcggcagttctggagcaatgtggagaaggtggtgcagttcaagcagcagagccggctggaggagaagaggaagaaggccctggacctgcacctggacttcatcgtgggccagacagagaagtacagcgacctgctgagccagagcctgaaccagcccctgaccagcagcaaggccggcagcagcccctgcctgggcagcagcagcgctgccagcagccccccacctccagccagccggctggatgatgaagatggagacttccagccccaggaggatgaggaggaggatgatgaggagaccatcgaggtggaggagcagcaggagggcaatgatgctgaggcccagaggcgggagattgagctgctgcggcgggagggggagctgcccctggaggagctgctgcggagcctgcccccccagctgctggagggccccagcagccccagccagacccccagcagccatgacagcgacaccagagatggccctgaggagggcgctgaggaggagcccccccaggtgctggagatcaagcccccacccagcgctgtgacccagaggaacaagcagccctggcacccagatgaagatgatgaggagttcaccgccaatgaggaggaggctgaagatgaggaggacaccatcgctgctgaggagcagctggagggggaggtggaccacgccatggagctgtctgagctggcccgggagggggagctgtccatggaggagctgctgcagcagtatgctggggcctatgcccctggcagcggcagcagtgaagatgaagatgaagatgaggtggatgccaacagcagtgactgtgagcctgagggccctgtggaggccgaggagcccccccaggaggacagcagcagccagagcgacagcgtggaggacagaagtgaagatgaggaggatgagcacagcgaggaggaggagaccagcggcagcagcgccagcgaggagagcgagagcgaggagagtgaagatgcccagagccagagccaggctgatgaggaggaggaggatgatgactttggagtggagtacctgctggccagagatgaggagcagagcgaggctgatgctggcagcggcccccccaccccaggccccaccaccctgggccccaagaaggagatcacagacattgctgctgctgctgagagcctgcagcccaagggctacaccctggccaccacccaggtgaagacccccatccccctgctgctgcggggccagctgcgggagtaccagcacatcggcctggactggctggtgaccatgtatgagaagaagctgaatggcatcctggctgatgagatgggcctgggcaagaccatccagaccatcagcctgctggcccacctggcctgtgagaagggcaactggggcccccacctgatcatcgtgcccacctctgtgatgctgaactgggagatggagctgaagcgctggtgccccagcttcaagatcctgacctactatggagcccagaaggagaggaagctgaagaggcagggctggaccaagcccaatgccttccacgtgtgcatcaccagctacaagctggtgctgcaggaccaccaggccttccggaggaagaactggagatacctgatcctggatgaggcccagaacatcaagaacttcaagagccagcgctggcagagcctgctgaacttcaacagccagaggcggctgctgctgaccggcacccccctgcagaacagcctgatggagctgtggagcctgatgcacttcctgatgcctcatgtgttccagagccaccgggagttcaaggagtggttcagcaaccccctgaccggcatgattgagggcagccaggagtacaatgaaggcctggtgaagaggctgcacaaggtgctgcggcccttcctgctgcggcgggtgaaggtggatgtggagaagcagatgcccaagaagtatgaacatgtgatccgctgccgcctgagcaagaggcagcgctgcctgtatgatgacttcatggcccagaccaccaccaaggagaccctggccaccggccacttcatgtctgtcatcaacatcctgatgcagctgaggaaggtgtgcaaccaccccaacctgtttgaccccaggcctgtgaccagccccttcatcaccccaggcatctgcttcagcacagccagcctggtgctgcgggccacagatgtgcaccccctgcagagaattgacatgggccgctttgacctgattggcctggagggccgggtgagccgctatgaggccgacaccttcctgcccaggcaccggctgagcagaagagtgctgctggaggtggccacagccccagaccccccaccccggcccaagcctgtgaagatgaaggtgaacaggatgctgcagcctgtgcccaagcaggagggccgcacagtggtggtggtgaacaacccccgggcccccctgggccctgtgcctgtgcggcccccacctggccctgagctgagcgcccagcccaccccaggccctgtgccccaggtgctgcctgccagcctgatggtgtctgccagccctgctggccccccactcatcccagccagccggcccccaggccctgtgctgctgccccccctgcagcccaacagcggcagcctgccccaggccggggaggtggtgtccatcggccagctggccagcctggcccagaggcctgtggccaatgccggcggcagcaagcccctgaccttccagatccagggcaacaagctgaccctgactggagcccaggtgcggcagctggccgtgggccagccccggcccctgcagatgccacccaccatggtgaacaacacaggagtggtgaagatcgtggtgcggcaggcccccagagatggcctgacccctgtgccccccctggccccagcccccaggcctcccagcagcggcctgcctgctgtgctgaacccccggcccaccctgaccccaggccgcctgcccacccccaccctgggcacagcccgggcccccatgcccacccccaccctggtgcggcccctgctgaagctggtgcacagccccagccctgaggtgtctgccagcgcccctggggccgcccccctgaccatcagcagccccctgcacgtgcccagcagcctgcccggccctgccagcagccccatgcccatccccaacagcagccccctggccagccctgtgagcagcacagtgtctgtgcccctgagcagcagcctgcccatctctgtgcccaccaccctgcctgccccagccagcgcccccctgaccatccccatcagcgcccccctgactgtgtctgccagcggccctgccctgctgacctctgtgaccccacccctggcccctgtggtgcctgctgcccctggcccccccagcctggcccccagcggggccagccccagcgccagcgccctgaccctgggcctggccacagcccccagcctgagcagcagccagaccccaggccaccccctgctgctggcccccaccagcagccacgtgcccggcctgaacagcacagtggccccagcctgcagccctgtgctggtgcctgccagcgccctggccagccccttccccagcgcccccaacccagccccagcccaggccagcctgctggccccagccagcagcgccagccaggccctggccacccccctggcccccatggccgccccccagacagccatcctggcccccagccctgccccacccctggcccccctgcctgtgctggcccccagccctggggccgcccctgtgctggccagcagccagacccctgtgcctgtgatggcccccagcagcaccccaggcaccagcctggccagcgccagccctgtgcctgcccccacccctgtgctggcccccagcagcacccagaccatgctgcctgcccctgtgcccagccccctgcccagccctgccagcacccagaccctggccctggccccagccctggcccccaccctgggcggcagcagccccagccagaccctgagcctgggcaccggcaacccccagggccccttccccacccagaccctgagcctgaccccagccagcagcctggtgcccaccccagcccagaccctgagcctggcccctggcccccccctgggccccacccagaccctgagcctggccccagccccacccctggccccagccagccctgtgggccctgccccagcccacaccctgaccctggccccagccagcagcagcgccagcctgctggccccagcctctgtgcagaccctgaccctgagccctgcccctgtgcccaccctgggccctgctgctgcccagaccctggccctggccccagccagcacccagagccctgccagccaggccagcagcctggtggtgtctgccagcggggccgcccccctgcctgtgaccatggtgtcccggctgcctgtgtccaaggatgagccagacaccctgaccctgcggagcggcccccccagcccccccagcacagccaccagctttggaggcccccggccccggcggcagcccccacctccacccaggagccccttctacctggacagcctggaggagaagaggaagaggcagaggtctgagcggctggagcgcatcttccagctgtctgaggcccatggagccctggcccctgtgtatggaacagaggtgctggacttctgcaccctgccccagcctgtggccagccccatcggccccaggagccctggccccagccaccccaccttctggacctacacagaggccgcccacagagctgtgctcttcccccagcagaggctggaccagctgtctgagatcatcgagcgcttcatctttgtgatgcctcctgtggaggcccccccacccagcctgcacgcctgccaccccccaccctggctggccccccggcaggccgccttccaggagcagctggccagcgagctgtggccccgggcccggcccctgcaccgcatcgtgtgcaacatgaggacccagttcccagacctgcggctcatccagtatgactgtgggaagctgcagaccctggccgtgctgctgcggcagctgaaggccgagggccaccgggtgctgatcttcacccagatgaccaggatgctggatgtgctggagcagttcctgacctaccacggccacctgtacctgcggctggatggcagcaccagggtggagcagaggcaggccctgatggagcgcttcaatgctgacaagaggatcttctgcttcatcctgagcaccaggtctgggggcgtgggcgtgaacctgaccggggctgacacagtggtgttctatgacagcgactggaaccccaccatggatgcccaggcccaggaccgctgccacagaattggccagaccagagatgtgcacatctaccgcctcatcagcgagaggacagtggaggagaacatcctgaagaaggccaaccagaagaggatgctgggggacatggccattgaaggaggcaacttcaccacagcctacttcaagcagcagaccatccgggagctgtttgacatgcccctggaggagcccagcagcagctctgtgcccagcgcccctgaggaggaggaggagaccgtggccagcaagcagacccacatcctggagcaggccctgtgcagagcagaagatgaggaggacatccgggccgccacccaggccaaggccgagcaggtggccgagctggccgagttcaatgaaaatgatggcttccctgctggggagggggaggaggccggccggcctggagcagaagatgaggagatgagcagagctgagcaggagattgctgccctggtggagcagctgacccccatcgagagatatgccatgaagttcctggaggccagcctggaggaggtgtcccgggaggagctgaagcaggccgaggagcaggtggaggccgccaggaaggacctggaccaggccaaggaggaggtgttccggctgccccaggaggaggaggagggccctggagctggagatgagagcagctgtggcaccggcggcggcacccaccggcgcagcaagaaggccaaggcccctgagaggcctggcaccagggtgtctgagcggctgcggggggcccgggcagagacccagggcgccaaccacacccctgtgatcagcgcccaccagaccaggagcaccaccaccccaccccgctgcagccctgcccgggagcgggtgcccaggcctgccccccggccccggcccaccccagccagcgccccagctgccatcccagccctggtgcctgtgcctgtgtctgcccctgtgcccatcagcgcccccaaccccatcaccatcctgcctgtgcacatcctgcccagccccccaccacccagccagatccccccctgcagcagccctgcctgcaccccacctccagcctgcaccccacctccagcccacaccccacctccagcccagacctgcctggtgacccccagcagccccctgctgctgggccccccatctgtgcccatcagcgcctctgtgaccaacctgcccctgggcctgcggcctgaggccgagctgtgtgcccaggccctggccagccctgagagcctggagctggcctctgtggccagcagcgagaccagcagcctgagcctggtgccccccaaggacctgctgcctgtggccgtggagatcctgcctgtgtctgagaagaacctgagcctgaccccatctgcccccagcctgaccctggaggccggcagcatccccaacggccaggagcaggaggccccagattctgctgagggcaccaccctgactgtgctgcctgagggggaggagctgcccctgtgtgtgtctgagagcaatggcctggagctgcccccatctgctgccagtgatgagcccctgcaggagcccctggaggccgacaggaccagcgaggagctgacagaggccaagacccccaccagcagccctgagaagccccaggagctggtgacagctgaggtggccgcccccagcaccagcagcagcgccaccagcagccctgagggccccagccctgcccggcccccaagaagaaggaccagcgcagatgtggagatccggggccagggcaccggccggcccggccagcccccaggccccaaggtgctgaggaagctgcccggccgcctggtgacagtggtggaggagaaggagctggtgagaagaagacggcagcagagaggagctgccagcaccctggtgcctggggtgtctgagaccagcgccagccctggcagccccagcgtgcgctccatgagcggccctgagagcagcccccccatcggcggcccctgtgaggccgcccccagcagcagcctgcccaccccaccccagcagcccttcatcgcccggcggcacatcgagctgggcgtgactggaggcggcagcccagaaaatggagatggagccctgctggccatcaccccacctgctgtgaagagaagaagaggccggccccccaagaagaacagaagccctgcagatgctggccggggcgtggatgaggcccccagcagcaccctgaagggcaagaccaacggggctgaccctgtgcccggccctgagaccctcatcgtggccgaccctgtgctggagccccagctgatccctggcccccagcccctgggcccccagcctgtgcaccggcccaaccccctgctgagccctgtggagaagagaagaagaggccggccccccaaggcccgggacctgcccatccctggcaccatcagcagcgctggagatggcaacagcgagagcaggacccagcccccaccccaccccagccccctgacccccctgccccccctgctggtgtgccccacagccaccgtggccaacacagtgaccaccgtgaccatcagcaccagcccccccaagaggaagaggggccggccccccaagaacccccccagcccccggcccagccagctgcctgtgctggaccgggacagcacctctgtgctggagagctgtggcctgggcagaagacggcagccccagggccagggcgagagcgagggcagcagcagtgatgaagatggcagccggcccctgacccggctggcccggctgcggctggaggccgagggcatgaggggcaggaagagcggcggctccatggtggtggccgtcatccaggatgacctggacctggccgacagcggccctgggggcctggagctgaccccacctgtggtgtccctgacccccaagctgcggagcacccggctgcggcccggcagcctggtgccccccctggagacagagaagctgcccaggaagagagctggggcccctgtgggcggcagccctggcctggccaagaggggccgcctgcagccccccagccccctgggccctgagggctctgtggaggagagcgaggccgaggccagcggggaggaggaggagggagatggcacccccaggagaagacctggcccccggcggctggtgggcaccaccaaccagggcgaccagaggatcctgcggagcagcgccccacccagcctggccggccctgctgtgagccaccggggcaggaaggccaagacctag

SEQ ID NO: 170052 - DNA, 9507 bp, Artificial Sequence
  Description of Artificial Sequence: Synthetic coding sequence
atgcagagcagccccagccctgcccacccccagctgcctgtgctgcagacccagatggtgtctgatggcatgacaggcagcaaccctgtgtccccagccagcagcagcagccctgccagcagtggagctgggggcatcagcccccagcacatcgcccaggacagcagcctggatggccccccaggccccccagatggagccaccgtgcccctggagggcttcagcctgagccaggccgctgacctggccaacaagggccccaagtgggagaagagccacgccgagattgctgagcaggccaagcatgaggccgagattgagaccagaattgctgagctgaggaaggagggcttctggagcctgaagaggctgcccaaggtgcctgagcccccccggcccaagggccactgggactacctgtgtgaggagatgcagtggctgtctgctgactttgcccaggagcggcgctggaagaggggcgtggccaggaaggtggtgaggatggtgatccgccaccacgaggagcagaggcagaaggaggagcgggcccggcgggaggagcaggccaagctgcggcgcatcgccagcaccatggccaaggatgtgcggcagttctggagcaatgtggagaaggtggtgcagttcaagcagcagagccggctggaggagaagaggaagaaggccctggacctgcacctggacttcatcgtgggccagacagagaagtacagcgacctgctgagccagagcctgaaccagcccctgaccagcagcaaggccggcagcagcccctgcctgggcagcagcagcgctgccagcagccccccacctccagccagccggctggatgatgaagatggagacttccagccccaggaggatgaggaggaggatgatgaggagaccatcgaggtggaggagcagcaggagggcaatgatgctgaggcccagaggcgggagattgagctgctgcggcgggagggggagctgcccctggaggagctgctgcggagcctgcccccccagctgctggagggccccagcagccccagccagacccccagcagccatgacagcgacaccagagatggccctgaggagggcgctgaggaggagcccccccaggtgctggagatcaagcccccacccagcgctgtgacccagaggaacaagcagccctggcacccagatgaagatgatgaggagttcaccgccaatgaggaggaggctgaagatgaggaggacaccatcgctgctgaggagcagctggagggggaggtggaccacgccatggagctgtctgagctggcccgggagggggagctgtccatggaggagctgctgcagcagtatgctggggcctatgcccctggcagcggcagcagtgaagatgaagatgaagatgaggtggatgccaacagcagtgactgtgagcctgagggccctgtggaggccgaggagcccccccaggaggacagcagcagccagagcgacagcgtggaggacagaagtgaagatgaggaggatgagcacagcgaggaggaggagaccagcggcagcagcgccagcgaggagagcgagagcgaggagagtgaagatgcccagagccagagccaggctgatgaggaggaggaggatgatgactttggagtggagtacctgctggccagagatgaggagcagagcgaggctgatgctggcagcggcccccccaccccaggccccaccaccctgggccccaagaaggagatcacagacattgctgctgctgctgagagcctgcagcccaagggctacaccctggccaccacccaggtgaagacccccatccccctgctgctgcggggccagctgcgggagtaccagcacatcggcctggactggctggtgaccatgtatgagaagaagctgaatggcatcctggctgatgagatgggcctgggcaagaccatccagaccatcagcctgctggcccacctggcctgtgagaagggcaactggggcccccacctgatcatcgtgcccacctctgtgatgctgaactgggagatggagctgaagcgctggtgccccagcttcaagatcctgacctactatggagcccagaaggagaggaagctgaagaggcagggctggaccaagcccaatgccttccacgtgtgcatcaccagctacaagctggtgctgcaggaccaccaggccttccggaggaagaactggagatacctgatcctggatgaggcccagaacatcaagaacttcaagagccagcgctggcagagcctgctgaacttcaacagccagaggcggctgctgctgaccggcacccccctgcagaacagcctgatggagctgtggagcctgatgcacttcctgatgcctcatgtgttccagagccaccgggagttcaaggagtggttcagcaaccccctgaccggcatgattgagggcagccaggagtacaatgaaggcctggtgaagaggctgcacaaggtgctgcggcccttcctgctgcggcgggtgaaggtggatgtggagaagcagatgcccaagaagtatgaacatgtgatccgctgccgcctgagcaagaggcagcgctgcctgtatgatgacttcatggcccagaccaccaccaaggagaccctggccaccggccacttcatgtctgtcatcaacatcctgatgcagctgaggaaggtgtgcaaccaccccaacctgtttgaccccaggcctgtgaccagccccttcatcaccccaggcatctgcttcagcacagccagcctggtgctgcgggccacagatgtgcaccccctgcagagaattgacatgggccgctttgacctgattggcctggagggccgggtgagccgctatgaggccgacaccttcctgcccaggcaccggctgagcagaagagtgctgctggaggtggccacagccccagaccccccaccccggcccaagcctgtgaagatgaaggtgaacaggatgctgcagcctgtgcccaagcaggagggccgcacagtggtggtggtgaacaacccccgggcccccctgggccctgtgcctgtgcggcccccacctggccctgagctgagcgcccagcccaccccaggccctgtgccccaggtgctgcctgccagcctgatggtgtctgccagccctgctggccccccactcatcccagccagccggcccccaggccctgtgctgctgccccccctgcagcccaacagcggcagcctgccccaggtgctgcccagccccctgggcgtgctgagcggcaccagcaggcctcccacccccaccctgagcctgaagcccaccccaccagcccctgtgcggctgagccctgcccctcctcctggcagcagcagcctgctgaagcccctgactgtgcccccaggctacaccttccccccagctgctgccaccaccaccagcaccaccacagccacagccaccaccacagctgtgcctgcccccaccccagccccccagaggctcatcctgagcccagacatgcaggcccggctgcccagcggggaggtggtgtccatcggccagctggccagcctggcccagaggcctgtggccaatgccggcggcagcaagcccctgaccttccagatccagggcaacaagctgaccctgactggagcccaggtgcggcagctggccgtgggccagccccggcccctgcagatgccacccaccatggtgaacaacacaggagtggtgaagatcgtggtgcggcaggcccccagagatggcctgacccctgtgccccccctggccccagcccccaggcctcccagcagcggcctgcctgctgtgctgaacccccggcccaccctgaccccaggccgcctgcccacccccaccctgggcacagcccgggcccccatgcccacccccaccctggtgcggcccctgctgaagctggtgcacagccccagccctgaggtgtctgccagcgcccctggggccgcccccctgaccatcagcagccccctgcacgtgcccagcagcctgcccggccctgccagcagccccatgcccatccccaacagcagccccctggccagccctgtgagcagcacagtgtctgtgcccctgagcagcagcctgcccatctctgtgcccaccaccctgcctgccccagccagcgcccccctgaccatccccatcagcgcccccctgactgtgtctgccagcggccctgccctgctgacctctgtgaccccacccctggcccctgtggtgcctgctgcccctggcccccccagcctggcccccagcggggccagccccagcgccagcgccctgaccctgggcctggccacagcccccagcctgagcagcagccagaccccaggccaccccctgctgctggcccccaccagcagccacgtgcccggcctgaacagcacagtggccccagcctgcagccctgtgctggtgcctgccagcgccctggccagccccttccccagcgcccccaacccagccccagcccaggccagcctgctggccccagccagcagcgccagccaggccctggccacccccctggcccccatggccgccccccagacagccatcctggcccccagccctgccccacccctggcccccctgcctgtgctggcccccagccctggggccgcccctgtgctggccagcagccagacccctgtgcctgtgatggcccccagcagcaccccaggcaccagcctggccagcgccagccctgtgcctgcccccacccctgtgctggcccccagcagcacccagaccatgctgcctgcccctgtgcccagccccctgcccagccctgccagcacccagaccctggccctggccccagccctggcccccaccctgggcggcagcagccccagccagaccctgagcctgggcaccggcaacccccagggccccttccccacccagaccctgagcctgaccccagccagcagcctggtgcccaccccagcccagaccctgagcctggcccctggcccccccctgggccccacccagaccctgagcctggccccagccccacccctggccccagccagccctgtgggccctgccccagcccacaccctgaccctggccccagccagcagcagcgccagcctgctggccccagcctctgtgcagaccctgaccctgagccctgcccctgtgcccaccctgggccctgctgctgcccagaccctggccctggccccagccagcacccagagccctgccagccaggccagcagcctggtggtgtctgccagcggggccgcccccctgcctgtgaccatggtgtcccggctgcctgtgtccaaggatgagccagacaccctgaccctgcggagcggcccccccagcccccccagcacagccaccagctttggaggcccccggccccggcggcagcccccacctccacccaggagccccttctacctggacagcctggaggagaagaggaagaggcagaggtctgagcggctggagcgcatcttccagctgtctgaggcccatggagccctggcccctgtgtatggaacagaggtgctggacttctgcaccctgccccagcctgtggccagccccatcggccccaggagccctggccccagccaccccaccttctggacctacacagaggccgcccacagagctgtgctcttcccccagcagaggctggaccagctgtctgagatcatcgagcgcttcatctttgtgatgcctcctgtggaggcccccccacccagcctgcacgcctgccaccccccaccctggctggccccccggcaggccgccttccaggagcagctggccagcgagctgtggccccgggcccggcccctgcaccgcatcgtgtgcaacatgaggacccagttcccagacctgcggctcatccagtatgactgtgggaagctgcagaccctggccgtgctgctgcggcagctgaaggccgagggccaccgggtgctgatcttcacccagatgaccaggatgctggatgtgctggagcagttcctgacctaccacggccacctgtacctgcggctggatggcagcaccagggtggagcagaggcaggccctgatggagcgcttcaatgctgacaagaggatcttctgcttcatcctgagcaccaggtctgggggcgtgggcgtgaacctgaccggggctgacacagtggtgttctatgacagcgactggaaccccaccatggatgcccaggcccaggaccgctgccacagaattggccagaccagagatgtgcacatctaccgcctcatcagcgagaggacagtggaggagaacatcctgaagaaggccaaccagaagaggatgctgggggacatggccattgaaggaggcaacttcaccacagcctacttcaagcagcagaccatccgggagctgtttgacatgcccctggaggagcccagcagcagctctgtgcccagcgcccctgaggaggaggaggagaccgtggccagcaagcagacccacatcctggagcaggccctgtgcagagcagaagatgaggaggacatccgggccgccacccaggccaaggccgagcaggtggccgagctggccgagttcaatgaaaatgatggcttccctgctggggagggggaggaggccggccggcctggagcagaagatgaggagatgagcagagctgagcaggagattgctgccctggtggagcagctgacccccatcgagagatatgccatgaagttcctggaggccagcctggaggaggtgtcccgggaggagctgaagcaggccgaggagcaggtggaggccgccaggaaggacctggaccaggccaaggaggaggtgttccggctgccccaggaggaggaggagggccctggagctggagatgagagcagctgtggcaccggcggcggcacccaccggcgcagcaagaaggccaaggcccctgagaggcctggcaccagggtgtctgagcggctgcggggggcccgggcagagacccagggcgccaaccacacccctgtgatcagcgcccaccagaccaggagcaccaccaccccaccccgctgcagccctgcccgggagcgggtgcccaggcctgccccccggccccggcccaccccagccagcgccccagctgccatcccagccctggtgcctgtgcctgtgtctgcccctgtgcccatcagcgcccccaaccccatcaccatcctgcctgtgcacatcctgcccagccccccaccacccagccagatccccccctgcagcagccctgcctgcaccccacctccagcctgcaccccacctccagcccacaccccacctccagcccagacctgcctggtgacccccagcagccccctgctgctgggccccccatctgtgcccatcagcgcctctgtgaccaacctgcccctgggcctgcggcctgaggccgagctgtgtgcccaggccctggccagccctgagagcctggagctggcctctgtggccagcagcgagaccagcagcctgagcctggtgccccccaaggacctgctgcctgtggccgtggagatcctgcctgtgtctgagaagaacctgagcctgaccccatctgcccccagcctgaccctggaggccggcagcatccccaacggccaggagcaggaggccccagattctgctgagggcaccaccctgactgtgctgcctgagggggaggagctgcccctgtgtgtgtctgagagcaatggcctggagctgcccccatctgctgccagtgatgagcccctgcaggagcccctggaggccgacaggaccagcgaggagctgacagaggccaagacccccaccagcagccctgagaagccccaggagctggtgacagctgaggtggccgcccccagcaccagcagcagcgccaccagcagccctgagggccccagccctgcccggcccccaagaagaaggaccagcgcagatgtggagatccggggccagggcaccggccggcccggccagcccccaggccccaaggtgctgaggaagctgcccggccgcctggtgacagtggtggaggagaaggagctggtgagaagaagacggcagcagagaggagctgccagcaccctggtgcctggggtgtctgagaccagcgccagccctggcagccccagcgtgcgctccatgagcggccctgagagcagcccccccatcggcggcccctgtgaggccgcccccagcagcagcctgcccaccccaccccagcagcccttcatcgcccggcggcacatcgagctgggcgtgactggaggcggcagcccagaaaatggagatggagccctgctggccatcaccccacctgctgtgaagagaagaagaggccggccccccaagaagaacagaagccctgcagatgctggccggggcgtggatgaggcccccagcagcaccctgaagggcaagaccaacggggctgaccctgtgcccggccctgagaccctcatcgtggccgaccctgtgctggagccccagctgatccctggcccccagcccctgggcccccagcctgtgcaccggcccaaccccctgctgagccctgtggagaagagaagaagaggccggccccccaaggcccgggacctgcccatccctggcaccatcagcagcgctggagatggcaacagcgagagcaggacccagcccccaccccaccccagccccctgacccccctgccccccctgctggtgtgccccacagccaccgtggccaacacagtgaccaccgtgaccatcagcaccagcccccccaagaggaagaggggccggccccccaagaacccccccagcccccggcccagccagctgcctgtgctggaccgggacagcacctctgtgctggagagctgtggcctgggcagaagacggcagccccagggccagggcgagagcgagggcagcagcagtgatgaagatggcagccggcccctgacccggctggcccggctgcggctggaggccgagggcatgaggggcaggaagagcggcggctccatggtggtggccgtcatccaggatgacctggacctggccgacagcggccctgggggcctggagctgaccccacctgtggtgtccctgacccccaagctgcggagcacccggctgcggcccggcagcctggtgccccccctggagacagagaagctgcccaggaagagagctggggcccctgtgggcggcagccctggcctggccaagaggggccgcctgcagccccccagccccctgggccctgagggctctgtggaggagagcgaggccgaggccagcggggaggaggaggagggagatggcacccccaggagaagacctggcccccggcggctggtgggcaccaccaaccagggcgaccagaggatcctgcggagcagcgccccacccagcctggccggccctgctgtgagccaccggggcaggaaggccaagacctag

SEQ ID NO: 170053 - DNA, 180 bp, Artificial Sequence
  Description of Artificial Sequence: Synthetic coding sequence
atgcagagcagccccagccctgcccacccccagctgcctgtgctgcagacccagatggtgtctgatggcatgacaggcagcaaccctgtgtccccagccagcagcagcagccctgccagcagtggagctgggggcatcagcccccagcacatcgcccaggacagcagcctggatggatag

SEQ ID NO: 170054 - DNA, 774 bp, Artificial Sequence
  Description of Artificial Sequence: Synthetic coding sequence
atgcacagaagaggagtgggcgctggggccatcgccaagaagaagctggccgaggccaagtacaaggagcggggcaccgtgctggccgaggaccagctggcccagatgagcaagcagctggacatgttcaagaccaacctggaggagtttgccagcaagcacaagcaggagatcaggaagaaccctgagttccgggtgcagttccaggacatgtgtgccaccatcggcgtggaccccctggccagcggcaagggcttctggagcgagatgctgggcgtgggggacttctactatgagctgggcgtgcagatcatcgaggtgtgcctggccctgaagcacagaaatggaggcctcatcaccctggaggagctgcaccagcaggtgctgaagggccggggcaagtttgcccaggatgtgtcccaggatgacctgatccgggccatcaagaagctgaaggccctgggcaccggcttcggcatcatccctgtgggcggcacctacctgatccagagcgtgcctgctgagctgaacatggaccacacagtggtgctgcagctggccgagaatggctacgtgacagtgtctgagatcaaggccagcctgaagtgggagacagagcgggcccggcaggtgctggagcacctgctgaaggagggcctggcctggctggacctgcaggcccctggagaggcccactactggctgcctgccctcttcacagacctgtacagccaggagatcacagctgaggaggcccgggaggccctgccctag

SEQ ID NO: 170055 - DNA, 777 bp, Artificial Sequence
  Description of Artificial Sequence: Synthetic coding sequence
atgcacagaagaggagtgggcgctggggccatcgccaagaagaagctggccgaggccaagtacaaggagcggggcaccgtgctggccgaggaccagctggcccagatgagcaagcagctggacatgttcaagaccaacctggaggagtttgccagcaagcacaagcaggagatcaggaagaaccctgagttccgggtgcagttccaggacatgtgtgccaccatcggcgtggaccccctggccagcggcaagggcttctggagcgagatgctgggcgtgggggacttctactatgagctgggcgtgcagatcatcgaggtgtgcctggccctgaagcacagaaatggaggcctcatcaccctggaggagctgcaccagcaggtgctgaagggccggggcaagtttgcccaggatgtgtcccaggatgacctgatccgggccatcaagaagctgaaggccctgggcaccggcttcggcatcatccctgtgggcggcacctacctgatccagagcgtgcctgctgagctgaacatggaccacacagtggtgctgcagctggccgagaagaatggctacgtgacagtgtctgagatcaaggccagcctgaagtgggagacagagcgggcccggcaggtgctggagcacctgctgaaggagggcctggcctggctggacctgcaggcccctggagaggcccactactggctgcctgccctcttcacagacctgtacagccaggagatcacagctgaggaggcccgggaggccctgccctag

SEQ ID NO: 170056 - DNA, 1611 bp, Artificial Sequence
  Description of Artificial Sequence: Synthetic coding sequence
atgagcagcagcctgggcaaggagaaggacagcaaggagaaggaccccaaggtgcccagcgccaaggagcgggagaaggaggccaaggccagcggcggctttgggaaggagagcaaggagaaggagcccaagaccaagggcaaggatgccaaggatggcaagaaggacagcagcgctgcccagcccggggtggccttctctgtggacaacaccatcaagaggcccaacccagcccctggcaccaggaagaagagcagcaatgctgaggtgatcaaggagctgaacaagtgccgggaggagaacagcatgaggctggacctgagcaagaggagcatccacatcctgcccagcagcatcaaggagctgacccagctgacagagctgtacctgtacagcaacaagctgcagagcctgcctgctgaggtgggctgcctggtgaacctgatgaccctggccctgtctgagaacagcctgaccagcctgcctgacagcctggacaacctgaagaagctgaggatgctggacctgcggcacaacaagctgcgggagatccccagcgtggtgtaccgcctggacagcctgaccaccctgtacctgcgcttcaaccgcatcaccaccgtggagaaggacatcaagaacctgagcaagctgtccatgctgagcatccgggagaacaagatcaagcagctgcctgctgagatcggcaacctgagcagcctgagccggctgggcctgcgctacaaccggctgagcgccatccccaggagcctggccaagtgcagcgccctggaggagctgaacctggagaacaacaacatcagcaccctgcctgagagcctgctgagcagcctggtgaagctgaacagcctgaccctggccaggaactgcttccagctgtaccctgtgggcggccccagccagttcagcaccatctacagcctgaacatggagcacaaccgcatcaacaagatccccttcggcatcttcagccgggccaaggtgctgagcaagctgaacatgaaggacaaccagctgaccagcctgcccctggactttggcacctggacctccatggtggagctgaacctggccaccaaccagctgaccaagatcccagaagatgtgtctggcctggtgtccctggaggtgctgatcctgagcaacaacctgctgaagaagctgccccacggcctgggcaacctgaggaagctgcgggagctggacctggaggagaacaagctggagagcctgcccaatgaaattgcctacctgaaggacctgcagaagctggtgctgaccaacaaccagctgaccaccctgccccggggcatcggccacctgaccaacctgacccacctgggcctgggggagaacctgctgacccacctgcctgaggagatcggcaccctggagaacctggaggagctgtacctgaatgacaaccccaacctgcacagcctgccctttgagctggccctgtgcagcaagctgagcatcatgagcattgagaactgccccctgagccacctgcccccccagatcgtggccggcggccccagcttcatcatccagttcctgaagatgcagggcccctaccgggccatggtgtag

SEQ ID NO: 170057 - DNA, 1749 bp, Artificial Sequence
  Description of Artificial Sequence: Synthetic coding sequence
atgagcagcagcctgggcaaggagaaggacagcaaggagaaggaccccaaggtgcccagcgccaaggagcgggagaaggaggccaaggccagcggcggctttgggaaggagagcaaggagaaggagcccaagaccaagggcaaggatgccaaggatggcaagaaggacagcagcgctgcccagcccggggtggccttctctgtggacaacaccatcaagaggcccaacccagcccctggcaccaggaagaagagcagcaatgctgaggtgatcaaggagctgaacaagtgccgggaggagaacagcatgaggctggacctgagcaagaggagcatccacatcctgcccagcagcatcaaggagctgacccagctgacagagctgtacctgtacagcaacaagctgcagagcctgcctgctgaggtgggctgcctggtgaacctgatgaccctggccctgtctgagaacagcctgaccagcctgcctgacagcctggacaacctgaagaagctgaggatgctggacctgcggcacaacaagctgcgggagatccccagcgtggtgtaccgcctggacagcctgaccaccctgtacctgcgcttcaaccgcatcaccaccgtggagaaggacatcaagaacctgagcaagctgtccatgctgagcatccgggagaacaagatcaagcagctgcctgctgagatcggggagctgtgcaacctgatcaccctggatgtggcccacaaccagctggagcacctgcccaaggagatcggcaactgcacccagatcaccaacctggacctgcagcacaatgagctgctggacctgcctgacaccatcggcaacctgagcagcctgagccggctgggcctgcgctacaaccggctgagcgccatccccaggagcctggccaagtgcagcgccctggaggagctgaacctggagaacaacaacatcagcaccctgcctgagagcctgctgagcagcctggtgaagctgaacagcctgaccctggccaggaactgcttccagctgtaccctgtgggcggccccagccagttcagcaccatctacagcctgaacatggagcacaaccgcatcaacaagatccccttcggcatcttcagccgggccaaggtgctgagcaagctgaacatgaaggacaaccagctgaccagcctgcccctggactttggcacctggacctccatggtggagctgaacctggccaccaaccagctgaccaagatcccagaagatgtgtctggcctggtgtccctggaggtgctgatcctgagcaacaacctgctgaagaagctgccccacggcctgggcaacctgaggaagctgcgggagctggacctggaggagaacaagctggagagcctgcccaatgaaattgcctacctgaaggacctgcagaagctggtgctgaccaacaaccagctgaccaccctgccccggggcatcggccacctgaccaacctgacccacctgggcctgggggagaacctgctgacccacctgcctgaggagatcggcaccctggagaacctggaggagctgtacctgaatgacaaccccaacctgcacagcctgccctttgagctggccctgtgcagcaagctgagcatcatgagcattgagaactgccccctgagccacctgcccccccagatcgtggccggcggccccagcttcatcatccagttcctgaagatgcagggcccctaccgggccatggtgtag

SEQ ID NO: 170058 - DNA, 1119 bp, Artificial Sequence
  Description of Artificial Sequence: Synthetic coding sequence
ctggacaacctgaagaagctgaggatgctggacctgcggcacaacaagctgcgggagatccccagcgtggtgtaccgcctggacagcctgaccaccctgtacctgcgcttcaaccgcatcaccaccgtggagaaggacatcaagaacctgagcaagctgtccatgctgagcatccgggagaacaagatcaagcagctgcctgctgagatcggcaacctgagcagcctgagccggctgggcctgcgctacaaccggctgagcgccatccccaggagcctggccaagtgcagcgccctggaggagctgaacctggagaacaacaacatcagcaccctgcctgagagcctgctgagcagcctggtgaagctgaacagcctgaccctggccaggaactgcttccagctgtaccctgtgggcggccccagccagttcagcaccatctacagcctgaacatggagcacaaccgcatcaacaagatccccttcggcatcttcagccgggccaaggtgctgagcaagctgaacatgaaggacaaccagctgaccagcctgcccctggactttggcacctggacctccatggtggagctgaacctggccaccaaccagctgaccaagatcccagaagatgtgtctggcctggtgtccctggaggtgctgatcctgagcaacaacctgctgaagaagctgccccacggcctgggcaacctgaggaagctgcgggagctggacctggaggagaacaagctggagagcctgcccaatgaaattgcctacctgaaggacctgcagaagctggtgctgaccaacaaccagctgaccaccctgccccggggcatcggccacctgaccaacctgacccacctgggcctgggggagaacctgctgacccacctgcctgaggagatcggcaccctggagaacctggaggagctgtacctgaatgacaaccccaacctgcacagcctgccctttgagctggccctgtgcagcaagctgagcatcatgagcattgagaactgccccctgagccacctgcccccccagatcgtggccggcggccccagcttcatcatccagttcctgaagatgcagggcccctaccgggccatggtgtag

SEQ ID NO: 170059 - DNA, 588 bp, Artificial Sequence
  Description of Artificial Sequence: Synthetic coding sequence
atgctgagagatggccgctttgcctgtgccatctgcccccacaggcctgtgctggacaccctggccatgctgacagcccacagagctgggaagaagcacctgagcagcctgcagctgttctacggcaagaagcagcccgggaaggagaggaagcagaaccccaagcaccagaatgagctgcggcgggaggagaccaaggccgaggcccccctgctgacccagaccaggctcatcacccagagcgccctgcaccgggccccccactacaacagctgctgcaggaggaagtacagacctgaggcccctggccccagcgtgtccctgagccccatgccacccagcgaggtgaagctgcagagcggcaagatcagccgggagcctgagcctgctgctggcccccaggccgaggagagcgccaccgtgtctgccccagcccccatgagccccacccggcggcgggccctggaccactacctgaccctgcggagcagcggctggatcccagatggccggggccgctgggtgaaggatgaaaatgtggagtttgacagtgatgaggaggagcccccagacctgcccctggactag

SEQ ID NO: 170060 - DNA, 693 bp, Artificial Sequence
  Description of Artificial Sequence: Synthetic coding sequence
atgtccttcaagcgggagggagatgactggagccagctgaatgtgctgaagaagagaagagtgggggacctgctggccagctacatcccagaagatgaggccctgatgctgagagatggccgctttgcctgtgccatctgcccccacaggcctgtgctggacaccctggccatgctgacagcccaccgggccggcaagaagcacctgagcagcctgcagctgttctacggcaagaagcagcccgggaaggagaggaagcagaaccccaagcaccagaatgagctgcggcgggaggagaccaaggccgaggcccccctgctgacccagaccaggctcatcacccagagcgccctgcaccgggccccccactacaacagctgctgcaggaggaagtacagacctgaggcccctggccccagcgtgtccctgagccccatgcctccttctgaggtgaagctgcagagcggcaagatcagccgggagcctgagcctgctgctggcccccaggccgaggagagcgccaccgtgtctgccccagcccccatgagccccaccaggagaagagccctggaccactacctgaccctgcggagcagcggctggatcccagatggccggggccgctgggtgaaggatgaaaatgtggagtttgacagtgatgaggaggagcccccagacctgcccctggactag

SEQ ID NO: 170061 - DNA, 1038 bp, Artificial Sequence
  Description of Artificial Sequence: Synthetic coding sequence
atgtacaaggactgcatcgagagcactggagactacttcctgctgtgtgatgctgagggcccctggggcatcatcctggagagcctggccatcctgggcatcgtggtgaccatcctgctgctgctggccttcctgttcctgatgaggaagatccaggactgcagccagtggaatgtgctgcccacccagctgctcttcctgctgtctgtgctgggcctgtttggcctggcctttgccttcatcatcgagctgaaccagcagacagcccctgtgcgctacttcctgtttggagtgctgtttgccctgtgcttcagctgcctgctggcccacgccagcaacctggtgaagctggtgcggggctgtgtgtccttctcctggaccaccatcctgtgcatcgccatcggctgcagcctgctgcagatcatcatcgccacagaatatgtgaccctcatcatgacccggggcatgatgtttgtgaacatgaccccctgccagctgaatgtggactttgtggtgctgctggtgtatgtgctcttcctgatggccctgaccttctttgtgtccaaggccaccttctgtggcccctgtgagaactggaagcagcacggccgcctcatcttcatcaccgtgctcttcagcatcatcatctgggtggtgtggatctccatgctgctgcggggcaacccccagttccagaggcagccccagtgggatgatcctgtggtgtgcatcgccctggtgaccaatgcctgggtgttcctgctgctgtacatcgtgcctgagctgtgcatcctgtaccgcagctgccggcaggagtgccccctgcagggcaatgcctgccctgtgacagcctaccagcacagcttccaggtggagaaccaggagctgagccgggcccgggacagtgatggagcagaagaagatgtggccctgaccagctatggcacccccatccagccccagacagtggaccccacccaggagtgcttcatcccccaggccaagctgagcccccagcaggatgctgggggcgtgtag

SEQ ID NO: 170062 - DNA, 2076 bp, Artificial Sequence
  Description of Artificial Sequence: Synthetic coding sequence
atggagggcaacaagctggaggagcaggacagcagccccccccagagcaccccaggcctgatgaagggcaacaagcgggaggagcagggcctgggccctgagcctgctgccccccagcagcccacagctgaggaggaggccctgattgagttccacaggagctaccgggagctgtttgagttcttctgcaacaacaccaccatccatggagccatccggctggtgtgcagccagcacaacaggatgaagacagccttctgggccgtgctgtggctgtgcaccttcggcatgatgtactggcagtttggcctgctgtttggagagtacttctcctaccctgtgtccctgaacatcaacctgaacagcgacaagctggtgtttcctgctgtgaccatctgcaccctgaacccctaccgctacccagagatcaaggaggagctggaggagctggaccgcatcacagagcagaccctgtttgacctgtacaagtacagcagcttcaccaccctggtggccggcagccgcagcagaagagacctgcggggcaccctgccccaccccctgcagaggctgcgggtgcccccaccaccccacggggcccggcgggcccggtctgtggccagcagcctgcgggacaacaacccccaggtggactggaaggactggaagattggcttccagctgtgcaaccagaacaagagtgactgcttctaccagacctacagcagtggagtggatgctgtgcgggagtggtaccgcttccactacatcaacatcctgagccggctgcctgagaccctgcccagcctggaggaggacaccctgggcaacttcatctttgcctgccgcttcaaccaggtgtcctgcaaccaggccaactacagccacttccaccaccccatgtatggcaactgctacaccttcaatgacaagaacaacagcaacctgtggatgagctccatgcctggcatcaacaacggcctgagcctgatgctgcgggcagagcagaatgacttcatccccctgctgagcacagtgactggagcccgggtgatggtgcacggccaggatgagcccgccttcatggatgatggcggcttcaacctgcggcctggggtggagaccagcatctccatgaggaaggagaccctggaccggctgggcggggactatggagactgcaccaagaatggaagtgatgtgcctgtggagaacctgtaccccagcaagtacacccagcaggtgtgcatccacagctgcttccaggagagcatgatcaaggaatgtggctgtgcctacatcttctacccccggccccagaatgtggagtactgtgactacaggaagcacagctcctggggccaggtgcgcagcctgacccctgtgatcccagccctgtgggaggccgaggccggccgcagccggggctactgctactacaagctgcaggtggacttcagcagtgaccacctgggctgcttcaccaagtgcaggaagccctgcagcgtgaccagctaccagctgtctgctggctacagccgctggcccagcgtgaccagccaggagtgggtgttccagatgctgagccggcagaacaactacacagtgaacaacaagagaaatggagtggccaaggtgaacatcttcttcaaggagctgaactacaagaccaacagcgagagccccagcgtgaccatggtgaccctgctgagcaacctgggcagccagtggagcctgtggtttggcagctctgtgctgtctgtggtggagatggccgagctggtgtttgacctgctggtgatcatgttcctgatgctgctgcggcgcttccgcagccgctactggagccctggccggggcggccgcggggcccaggaggtggccagcaccctggccagcagcccccccagccacttctgcccccaccccatgagcctgagcctgagccagcccggccctgcccccagccctgccctgacagcccctcctccagcctatgccaccctgggcccccggcccagccctgggggcagcgctggggccagcagcagcacctgccccctgggcggcccctag

SEQ ID NO: 170063 - DNA, 2058 bp, Artificial Sequence
  Description of Artificial Sequence: Synthetic coding sequence
atgctgctgcacatcaacccagcctacctgttcaagctgctgcacggcttccccccctggatcatgcccacagatggcaacctgggggacaagaacttccagatgggcaagccaggccaccgggagggcgccaccatgcacgtgaagaagtacctgctgaagggcctgcaccggctgcagaagggccctggctacacctacaaggagctgctggtgtggtactgtgacaacaccaacacccacggccccaagaggatcatctgtgagggccccaagaagaaggccatgtggttcctgctgaccctgctgtttgctgccctggtgtgctggcagtggggcatcttcatccgcacctacctgtcctgggaggtgtctgtgtccctgtctgtgggcttcaagaccatggacttccctgctgtgaccatctgcaatgccagccccttcaagtacagcaagatcaagcacctgctgaaggacctggatgagctgatggaggccgtgctggagcgcatcctggcccctgagctgagccacgccaatgccaccaggaacctgaacttcagcatctggaaccacacccccctggtgctgattgatgaaagaaacccccaccaccccatggtgctggacctgtttggagacaaccacaacggcctgaccagcagcagcgccagcgagaagatctgcaatgcccacggctgcaagatggccatgaggctgtgcagcctgaacagaacccagtgcaccttcaggaacttcaccagcgccacccaggccctgacagagtggtacatcctgcaggccaccaacatctttgcccaggtgccccagcaggagctggtggagatgagctacccaggagagcagatgatcctggcctgcctgtttggagctgagccctgcaactacagaaacttcaccagcatcttctacccccactacggcaactgctacatcttcaactggggcatgacagagaaggccctgcccagcgccaaccctggaacagaatttggcctgaagctgatcctggacatcggccaggaggactatgtgcccttcctggccagcacagctggggtgcggctgatgctgcacgagcagaggagctaccccttcatcagagatgagggcatctatgccatgtctggaacagagaccagcattggagtgctggtggacaagctgcagaggatgggagagccctacagcccctgcaccgtgaatggaagtgaggtgcctgtgcagaacttctacagcgactacaacaccacctacagcatccaggcctgcctgcggagctgcttccaggaccacatgatccggaactgcaactgtggccactacctgtaccccctgcccagaggagagaagtactgcaacaacagagacttcccagactgggcccactgctacagcgacctgcagatgtctgtggcccagcgggagacctgcatcggcatgtgcaaggagagctgcaatgacacccagtacaagatgaccatctccatggctgactggcccagcgaggccagcgaggactggatcttccacgtgctgagccaggagcgggaccagagcaccaacatcaccctgagcaggaaaggaattgtgaagctgaacatctacttccaggagttcaactaccgcaccatcgaggagagcgctgccaacaacatcgtgtggctgctgagcaacctgggcggccagtttggcttctggatgggcggctctgtgctgtgcctgattgaatttggagagatcatcatcgactttgtgtggatcaccatcatcaagctggtggccctggccaagagcctgcggcagaggcgggcccaggccagctatgccggccccccacccaccgtggccgagctggtggaggcccacaccaactttggcttccagcctgacacagcccccaggagccccaacacaggcccctaccccagcgagcaggccctgcccatccctggcaccccaccacccaactatgacagcctgcggctgcagcccctggatgtgattgaaagtgacagtgaaggagatgccatctag

SEQ ID NO: 170064 - DNA, 1923 bp, Artificial Sequence
  Description of Artificial Sequence: Synthetic coding sequence
atgcacgtgaagaagtacctgctgaagggcctgcaccggctgcagaagggccctggctacacctacaaggagctgctggtgtggtactgtgacaacaccaacacccacggccccaagaggatcatctgtgagggccccaagaagaaggccatgtggttcctgctgaccctgctgtttgctgccctggtgtgctggcagtggggcatcttcatccgcacctacctgtcctgggaggtgtctgtgtccctgtctgtgggcttcaagaccatggacttccctgctgtgaccatctgcaatgccagccccttcaagtacagcaagatcaagcacctgctgaaggacctggatgagctgatggaggccgtgctggagcgcatcctggcccctgagctgagccacgccaatgccaccaggaacctgaacttcagcatctggaaccacacccccctggtgctgattgatgagaggaacccccaccaccccatggtgctggacctgtttggagacaaccacaacggcctgaccagcagcagcgccagcgagaagatctgcaatgcccacggctgcaagatggccatgaggctgtgcagcctgaacagaacccagtgcaccttcaggaacttcaccagcgccacccaggccctgacagagtggtacatcctgcaggccaccaacatctttgcccaggtgccccagcaggagctggtggagatgagctacccaggagagcagatgatcctggcctgcctgtttggagctgagccctgcaactacagaaacttcaccagcatcttctacccccactacggcaactgctacatcttcaactggggcatgacagagaaggccctgcccagcgccaaccctggaacagaatttggcctgaagctgatcctggacatcggccaggaggactatgtgcccttcctggccagcacagctggggtgcggctgatgctgcacgagcagaggagctaccccttcatcagagatgagggcatctatgccatgagcggcacagagaccagcattggagtgctggtggacaagctgcagaggatgggagagccctacagcccctgcaccgtgaatggcagcgaggtgcctgtgcagaacttctacagcgactacaacaccacctacagcatccaggcctgcctgcggagctgcttccaggaccacatgatccggaactgcaactgtggccactacctgtaccccctgcccagaggagagaagtactgcaacaacagagacttcccagactgggcccactgctacagcgacctgcagatgtctgtggcccagcgggagacctgcatcggcatgtgcaaggagagctgcaatgacacccagtacaagatgaccatctccatggctgactggcccagcgaggccagcgaggactggatcttccacgtgctgagccaggagcgggaccagagcaccaacatcaccctgagcaggaagggcatcgtgaagctgaacatctacttccaggagttcaactaccgcaccatcgaggagagcgctgccaacaacatcgtgtggctgctgagcaacctgggcggccagtttggcttctggatgggcggctctgtgctgtgcctgattgaatttggagagatcatcatcgactttgtgtggatcaccatcatcaagctggtggccctggccaagagcctgcggcagaggcgggcccaggccagctatgccggccccccacccaccgtggccgagctggtggaggcccacaccaactttggcttccagcctgacacagcccccaggagccccaacacaggcccctaccccagcgagcaggccctgcccatccctggcaccccaccacccaactatgacagcctgcggctgcagcccctggatgtgattgaaagtgacagtgaaggagatgccatctag

SEQ ID NO: 170065 - DNA, 2115 bp, Artificial Sequence
  Description of Artificial Sequence: Synthetic coding sequence
atggccttcctgagcaggaccagccctgtggccgccgccagcttccagagccggcaggaggcccggggcagcatcctgctgcagagctgccagctgcccccccagtggctgagcacagaggcctggacaggagagtggaagcagccccacggcggggccctgaccagccgcagccctggccctgtggccccccagaggccctgccacctgaagggctggcagcaccggcccacccagcacaatgctgcctgcaagcagggccaggccgccgcccagaccccacccaggcctggccccccatctgcccctcctcctccacccaaggagggccaccaggagggcctggtggagctgcctgccagcttccgggagctgctgaccttcttctgcaccaatgccaccatccacggggccatccggctggtgtgcagccggggcaaccggctgaagaccacctcctggggcctgctgagcctgggcgccctggtggccctgtgctggcagctgggcctgctgtttgagcggcactggcacaggcctgtgctgatggctgtgtctgtgcacagcgagaggaagctgctgcccctggtgaccctgtgtgatggcaacccccggcggcccagccctgtgctgcggcacctggagctgctggatgaatttgccagagaaaatattgacagcctgtacaacgtgaacctgagcaagggccgggccgccctgagcgccaccgtgcccaggcatgagccccccttccacctggaccgggagatccggctgcagaggctgagccacagcggcagccgggtgcgggtgggcttccggctgtgcaacagcactggaggagactgcttctaccggggctacaccagcggcgtggccgctgtgcaggactggtaccacttccactacgtggacatcctggccctgctgcctgctgcctgggaggacagccacggcagccaggacggccactttgtgctgagctgcagctatgatggcctggactgccaggcccggcagttccgcaccttccaccaccccacctacggcagctgctacacagtggatggagtgtggacagcccagaggcctggcatcacccacggcgtgggcctggtgctgcgggtggagcagcagccccacctgcccctgctgagcaccctggccggcatccgggtgatggtgcacggcaggaaccacacccccttcctgggccaccacagcttctctgtgcggcctggaacagaggccaccatcagcatcagagaagatgaggtgcaccggctgggcagcccctacggccactgcacagctggaggagagggcgtggaggtggagctgctgcacaacaccagctacacccggcaggcctgcctggtgtcctgcttccagcagctgatggtggagacctgcagctgtggctactacctgcaccccctgcctgctggagctgagtactgcagcagcgcccggcacccagcctggggccactgcttctaccgcctgtaccaggacctggagacccaccggctgccctgcaccagccgctgcccccggccctgccgggagagcgccttcaagctgagcacaggcaccagccgctggcccagcgccaagtctgctggctggaccctggccaccctgggggagcagggcctgccccaccagagccaccggcagaggagcagcctggccaagatcaacatcgtgtaccaggagctgaactacagatctgtggaggaggcccctgtgtacagcgtgccccagctgctgagcgccatgggcagcctgtgcagcctgtggtttggagcctctgtgctgagcctgctggagctgctggagctgctgctggatgccagcgccctgaccctggtgctgggcggccgccgcctgcggcgggcctggttctcctggccccgggccagccctgccagcggggccagcagcatcaagccagaggccagccagatgcctcctcctgctgggggcaccagtgatgatcctgagcccagcggcccccacctgccccgggtgatgctgcccggggtgctggccggcgtgtctgctgaggagagctgggccggcccccagcccctggagaccctggacacctag

SEQ ID NO: 170066 - DNA, 1917 bp, Artificial Sequence
  Description of Artificial Sequence: Synthetic coding sequence
atggccgagcaccgctccatggatggccgcatggaggccgccacccggggcggcagccacctgcaggccgccgcccagaccccacccaggcctggccccccatctgcccctcctcctccacccaaggagggccaccaggagggcctggtggagctgcctgccagcttccgggagctgctgaccttcttctgcaccaatgccaccatccacggggccatccggctggtgtgcagccggggcaaccggctgaagaccacctcctggggcctgctgagcctgggcgccctggtggccctgtgctggcagctgggcctgctgtttgagcggcactggcacaggcctgtgctgatggctgtgtctgtgcacagcgagaggaagctgctgcccctggtgaccctgtgtgatggcaacccccggcggcccagccctgtgctgcggcacctggagctgctggatgaatttgccagagaaaatattgacagcctgtacaacgtgaacctgagcaagggccgggccgccctgagcgccaccgtgcccaggcatgagccccccttccacctggaccgggagatccggctgcagaggctgagccacagcggcagccgggtgcgggtgggcttccggctgtgcaacagcactggaggagactgcttctaccggggctacaccagcggcgtggccgctgtgcaggactggtaccacttccactacgtggacatcctggccctgctgcctgctgcctgggaggacagccacggcagccaggacggccactttgtgctgagctgcagctatgatggcctggactgccaggcccggcagttccgcaccttccaccaccccacctacggcagctgctacacagtggatggagtgtggacagcccagaggcctggcatcacccacggcgtgggcctggtgctgcgggtggagcagcagccccacctgcccctgctgagcaccctggccggcatccgggtgatggtgcacggcaggaaccacacccccttcctgggccaccacagcttctctgtgcggcctggaacagaggccaccatcagcatcagagaagatgaggtgcaccggctgggcagcccctacggccactgcacagctggaggagagggcgtggaggtggagctgctgcacaacaccagctacacccggcaggcctgcctggtgtcctgcttccagcagctgatggtggagacctgcagctgtggctactacctgcaccccctgcctgctggagctgagtactgcagcagcgcccggcacccagcctggggccactgcttctaccgcctgtaccaggacctggagacccaccggctgccctgcaccagccgctgcccccggccctgccgggagagcgccttcaagctgagcacaggcaccagccgctggcccagcgccaagtctgctggctggaccctggccaccctgggggagcagggcctgccccaccagagccaccggcagaggagcagcctggccaagatcaacatcgtgtaccaggagctgaactacagatctgtggaggaggcccctgtgtacagcgtgccccagctgctgagcgccatgggcagcctgtgcagcctgtggtttggagcctctgtgctgagcctgctggagctgctggagctgctgctggatgccagcgccctgaccctggtgctgggcggccgccgcctgcggcgggcctggttctcctggccccgggccagccctgccagcggggccagcagcatcaagccagaggccagccagatgcctcctcctgctgggggcaccagtgatgatcctgagcccagcggcccccacctgccccgggtgatgctgcccggggtgctggccggcgtgtctgctgaggagagctgggccggcccccagcccctggagaccctggacacctag

SEQ ID NO: 170067 - DNA, 927 bp, Artificial Sequence
  Description of Artificial Sequence: Synthetic coding sequence
tgagccacagcccgggccgccacagccttcacagaggccacccggcaggcctggaggctgagcaggacaggcaccaccagcaccatgtggatctcctggccctgctgccccaggcatggccgcacagccaccggggccaggacagccaccagcagcagccctgctgtgaccatggcctggacagcccggccagacagcagcggccccagcaccaccccacccacagctgctgccaccaggtccatggccagcggccagctgagcgccccagccagccccaccgtgggcgccagcccctggcctgtgcggggccagggctgccgcagcggcggcctgaccccagccctgggcctgcccggggtgggcctggtgctgcgggtggagcagcagccccacctgcccctgctgagcaccctggccggcatccgggtgatggtgcatggaagaaaccacacccccttcctgggccaccacagcttctctgtgcggcccggcacagaggccaccatcagcatccgggaggatgaggtgcaccggctgggcagcccctacggccactgcacagctggaggagaaggagtggaggtggagctgctgcacaacaccagctacacccggcaggcctgcctggtgtcctgcttccagcagctgatggtggagacctgcagctgtggctactacctgcaccccctgcctgctggagctgagtactgcagcagcgcccggcacccagcctggggccactgcttctaccgcctgtaccaggacctggagacccaccggctgccctgcaccagccgctgcccccggccctgccgggagagcgccttcaagctgagcacaggcaccagccgctggcccagcgccaagtctgctggctggaccctggccaccctgggggagcagggcctgccccaccagagctag

SEQ ID NO: 170068 - DNA, 2010 bp, Artificial Sequence
  Description of Artificial Sequence: Synthetic coding sequence
atggccgagcaccgctccatggatggccgcatggaggccgccacccggggcggcagccacctgcagatcgcctgggcctgtggcagccctgaggccctgcccccagagggcatggccgcccagacccacagcgcccagcgctgcctgcagacaggccctggctgcagcccagatgccccccagcccggcccccccagcgcccctcctcctccacccaaggagggccaccaggagggcctggtggagctgcctgccagcttccgggagctgctgaccttcttctgcaccaatgccaccatccatggagccatccggctggtgtgcagccggggcaaccggctgaagaccacctcctggggcctgctgagcctgggcgccctggtggccctgtgctggcagctgggcctgctgtttgagcggcactggcacaggcctgtgctgatggctgtgtctgtgcacagcgagaggaagctgctgcccctggtgaccctgtgtgatggcaacccccggcggcccagccctgtgctgcggcacctggagctgctggatgaatttgcccgggagaacatcgacagcctgtacaacgtgaacctgagcaagggccgggccgccctgagcgccaccgtgcccaggcatgagccccccttccacctggaccgggagatccggctgcagaggctgagccacagcggcagccgggtgcgggtgggcttccggctgtgcaacagcactggaggagactgcttctaccggggctacaccagcggcgtggccgctgtgcaggactggtaccacttccactacgtggacatcctggccctgctgcctgctgcctgggaggacagccacggcagccaggacggccactttgtgctgagctgcagctatgatggcctggactgccaggcccggcagttccgcaccttccaccaccccacctacggcagctgctacacagtggatggagtgtggacagcccagaggcctggcatcacccatggagtgggcctggtgctgcgggtggagcagcagccccacctgcccctgctgagcaccctggccggcatccgggtgatggtgcatggaagaaaccacacccccttcctgggccaccacagcttctctgtgcggcccggcacagaggccaccatcagcatccgggaggatgaggtgcaccggctgggcagcccctacggccactgcacagctggaggagaaggagtggaggtggagctgctgcacaacaccagctacacccggcaggcctgcctggtgtcctgcttccagcagctgatggtggagacctgcagctgtggctactacctgcaccccctgcctgctggagctgagtactgcagcagcgcccggcacccagcctggggccactgcttctaccgcctgtaccaggacctggagacccaccggctgccctgcaccagccgctgcccccggccctgccgggagagcgccttcaagctgagcacaggcaccagccgctggcccagcgccaagtctgctggctggaccctggccaccctgggggagcagggcctgccccaccagagccaccggcagaggagcagcctggccaagatcaacatcgtgtaccaggagctgaactacagatctgtggaggaggcccctgtgtacagcgtgccccagctgctgagcgccatgggcagcctgtgcagcctgtggtttggagcctctgtgctgagcctgctggagctgctggagctgctgctggatgccagcgccctgaccctggtgctgggcggccggcggctgcggcgggcctggttctcctggccccgggccagccctgccagcggggccagcagcatcaagccagaggccagccagatgcctcctcctgctgggggcaccagtgatgatcctgagcccagcggcccccacctgccccgggtgatgctgcccggggtgctggccggcgtgtctgctgaggagagctgggccggcccccagcccctggagaccctggacacctag

SEQ ID NO: 170069 - DNA, 2409 bp, Artificial Sequence
  Description of Artificial Sequence: Synthetic coding sequence
atgagagctgtgctgagccagaagaccacccccctgccccgctacctgtggccaggccacctgagcggcccccggcggctgacctggagctggtgcagcgaccacaggacccccacctgccgggagctgggcagcccccaccccaccccctgcaccggccctgcccggggctggccccggcggggcggcggcccctgtggcttcaccagcgctggccacgtgctgtgtggctaccccctgtgcctgctgagcggccccatccagggctgcggcaccggcctgggggacagctccatggccttcctgagcaggaccagccctgtggccgccgccagcttccagagccggcaggaggcccggggcagcatcctgctgcagagctgccagctgcccccccagtggctgagcacagaggcctggacaggagagtggaagcagccccacggcggggccctgaccagccgcagccctggccctgtggccccccagaggccctgccacctgaagggctggcagcaccggcccacccagcacaatgctgcctgcaagcagggccaggccgccgcccagaccccacccaggcctggccccccatctgcccctcctcctccacccaaggagggccaccaggagggcctggtggagctgcctgccagcttccgggagctgctgaccttcttctgcaccaatgccaccatccacggggccatccggctggtgtgcagccggggcaaccggctgaagaccacctcctggggcctgctgagcctgggcgccctggtggccctgtgctggcagctgggcctgctgtttgagcggcactggcacaggcctgtgctgatggctgtgtctgtgcacagcgagaggaagctgctgcccctggtgaccctgtgtgatggcaacccccggcggcccagccctgtgctgcggcacctggagctgctggatgaatttgccagagaaaatattgacagcctgtacaacgtgaacctgagcaagggccgggccgccctgagcgccaccgtgcccaggcatgagccccccttccacctggaccgggagatccggctgcagaggctgagccacagcggcagccgggtgcgggtgggcttccggctgtgcaacagcactggaggagactgcttctaccggggctacaccagcggcgtggccgctgtgcaggactggtaccacttccactacgtggacatcctggccctgctgcctgctgcctgggaggacagccacggcagccaggacggccactttgtgctgagctgcagctatgatggcctggactgccaggcccggcagttccgcaccttccaccaccccacctacggcagctgctacacagtggatggagtgtggacagcccagaggcctggcatcacccacggcgtgggcctggtgctgcgggtggagcagcagccccacctgcccctgctgagcaccctggccggcatccgggtgatggtgcacggcaggaaccacacccccttcctgggccaccacagcttctctgtgcggcctggaacagaggccaccatcagcatcagagaagatgaggtgcaccggctgggcagcccctacggccactgcacagctggaggagagggcgtggaggtggagctgctgcacaacaccagctacacccggcaggcctgcctggtgtcctgcttccagcagctgatggtggagacctgcagctgtggctactacctgcaccccctgcctgctggagctgagtactgcagcagcgcccggcacccagcctggggccactgcttctaccgcctgtaccaggacctggagacccaccggctgccctgcaccagccgctgcccccggccctgccgggagagcgccttcaagctgagcacaggcaccagccgctggcccagcgccaagtctgctggctggaccctggccaccctgggggagcagggcctgccccaccagagccaccggcagaggagcagcctggccaagatcaacatcgtgtaccaggagctgaactacagatctgtggaggaggcccctgtgtacagcgtgccccagctgctgagcgccatgggcagcctgtgcagcctgtggtttggagcctctgtgctgagcctgctggagctgctggagctgctgctggatgccagcgccctgaccctggtgctgggcggccgccgcctgcggcgggcctggttctcctggccccgggccagccctgccagcggggccagcagcatcaagccagaggccagccagatgcctcctcctgctgggggcaccagtgatgatcctgagcccagcggcccccacctgccccgggtgatgctgcccggggtgctggccggcgtgtctgctgaggagagctgggccggcccccagcccctggagaccctggacacctag

SEQ ID NO: 170070 - DNA, 1917 bp, Artificial Sequence; identical to SEQ ID NO: 170066
  Description of Artificial Sequence: Synthetic coding sequence

SEQ ID NO: 170071 - DNA, 1950 bp, Artificial Sequence
  Description of Artificial Sequence: Synthetic coding sequence
atggcccctggagagaagatcaaggccaagatcaagaagaacctgcctgtgacaggcccccaggcccccaccatcaaggagctgatgcgctggtactgcctgaacaccaacacccacggctgccgccgcatcgtggtgtcccggggccgcctgcggcggctgctgtggattggcttcaccctgacagctgtggccctgatcctgtggcagtgtgccctgctggtgttctccttctacacagtgtctgtgtccatcaaggtgcacttcaggaagctggacttccctgctgtgaccatctgcaacatcaacccctacaagtacagcacagtgcgccacctgctggccgacctggagcaggagacccgggaggccctgaagagcctgtatggcttccctgagagcaggaagagaagagaggccgagagctggaacagcgtgtctgagggcaagcagccccgcttcagccaccgcatccccctgctgatctttgaccaggatgagaagggcaaggcccgggacttcttcaccggcaggaagaggaaggtgggcggcagcatcatccacaaggccagcaatgtgatgcacatcgagagcaagcaggtggtgggcttccagctgtgcagcaatgacaccagtgactgtgccacctacaccttcagcagcggcatcaatgccatccaggagtggtacaagctgcactacatgaacatcatggcccaggtgcccctggagaagaagatcaacatgagctacagcgctgaggagctgctggtgacctgcttctttgatggagtgtcctgtgatgccaggaacttcaccctcttccaccaccccatgcacggcaactgctacaccttcaacaaccgggagaatgagaccatcctgagcacctccatgggcggctctgaatatggcctgcaggtgatcctgtacatcaatgaggaggagtacaaccccttcctggtgagcagcactggagccaaggtgatcatccaccggcaggatgagtacccctttgtggaggatgtgggcacagaaattgaaacagccatggtgaccagcatcggcatgcacctgacagagagcttcaagctgtctgagccctacagccagtgcacagaagatggcagtgatgtgcccatccggaacatctacaatgctgcctacagcctgcagatctgcctgcacagctgcttccagaccaagatggtggagaagtgtggctgtgcccagtacagccagcccctgcccccagctgccaactactgcaactaccagcagcaccccaactggatgtactgctactaccagctgcaccgggcctttgtgcaggaggagctgggctgccagagcgtgtgcaaggaggcctgcagcttcaaggagtggaccctgaccaccagcctggcccagtggcccagcgtggtgtctgagaagtggctgctgcctgtgctgacctgggaccagggccggcaggtgaacaagaagctgaacaagacagacctggccaagctgctgatcttctacaaggacctgaaccagaggagcatcatggagagccctgccaacagcattgagatgctgctgagcaactttggaggccagctgggcctgtggatgagctgcagcgtggtgtgtgtgattgagatcatcgaggtgttcttcatcgacttcttcagcatcatcgcccggcggcagtggcagaaggccaaggagtggtgggcctggaagcaggccccaccctgcccagaggcccccaggagcccccagggccaggacaacccagccctggacattgatgatgacctgcccaccttcaacagcgccctgcacctgcccccagccctgggcacccaggtgcccggcaccccaccacccaagtacaacaccctgcggctggagcgggccttcagcaaccagctgacagacacccagatgctggatgagctgtag

SEQ ID NO: 170072 - DNA, 5943 bp, Artificial Sequence
  Description of Artificial Sequence: Synthetic coding sequence
atggccgcccggctgctggcccctcctggccctgacagcttcaagcccttcaccccagagagcctggccaacattgaaagaagaattgctgagagcaagctgaagaagccacccaaggcagatggcagccaccgggaggatgatgaggacagcaagcccaagcccaacagcgacctggaggccggcaagagcctgcccttcatctatggagacatcccccagggcctggtggccgtgcccctggaggactttgacccctactacctgacccagaagacctttgtggtgctgaacagaggcaagaccctcttccgcttcagcgccaccccagccctgtacatcctgagccccttcaacctgatccgccgcatcgccatcaagatcctgatccacagcgtcttctccatgatcatcatgtgcaccatcctgaccaactgtgtgttcatgaccttcagcaaccccccagactggagcaagaatgtggagtacaccttcaccggcatctacacctttgagagcctggtgaagatcatcgcccggggcttctgcattgatggcttcaccttcctgcgggacccctggaactggctggacttcagcgtcatcatgatggcctacatcacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgtgtggtgtggcccatcaacttcaatgaaagctacctggagaatggcaccaagggctttgactgggaggagtacatcaacaacaagaccaacttctacacagtgcccggcatgctggagcccctgctgtgtggcaacagcagtgatgctggccagtgcccagagggctaccagtgcatgaaggccggcaggaaccccaactacggctacaccagctttgacaccttctcctgggccttcctggccctcttccggctgatgacccaggactactgggagaacctgtaccagctgaccctgcgggctgctgggaagacctacatgatcttctttgtgctggtgatctttgtgggcagcttctacctggtgaacctgatcctggccgtggtggccatggcctatgaggagcagaaccaggccaccctggaggaggccgagcagaaggaggccgagttcaaggccatgctggagcagctgaagaagcagcaggaggaggcccaggccgccgccatggccaccagcgctggcaccgtgtctgaagatgccatcgaggaggagggggaggagggcggcggcagccccaggagcagcagcgagatcagcaagctgagcagcaagagcgccaaggagaggaggaacagaaggaagaagaggaagcagaaggagctgtctgagggggaggagaagggggaccctgagaaggtgttcaagtctgagagtgaagatggcatgaggaggaaggccttccggctgcctgacaaccgcatcggcaggaagttcagcatcatgaaccagagcctgctgagcatccctggcagccccttcctgagccgccacaacagcaagagcagcatcttctccttccggggccctggccgcttccgggaccccggctctgaaaatgaatttgctgatgatgagcacagcacagtggaggagagcgagggcagaagagacagcctcttcatccccatccgggcccgggagcggcgcagcagctacagcggctacagcggctacagccagggcagccgcagcagccgcatcttccccagcctgcggcgctctgtgaagaggaacagcacagtggactgcaatggagtggtgtccctcatcggcggccctggcagccacatcggcggccgcctgctgcctgaggccaccacagaggtggagatcaagaagaagggccctggcagcctgctggtgtccatggaccagctggccagctatggcaggaaggaccgcatcaacagcatcatgtctgtggtgaccaacaccctggtggaggagctggaggagagccagaggaagtgccccccctgctggtacaagtttgccaacaccttcctgatctgggagtgccacccctactggatcaagctgaaggagatcgtgaacctgattgtgatggacccctttgtggacctggccatcaccatctgcatcgtgctgaacaccctcttcatggccatggagcaccaccccatgaccccccagtttgaacatgtgctggccgtgggcaacctggtgttcaccggcatcttcaccgctgagatgttcctgaagctgattgccatggacccctactactacttccaggagggctggaacatctttgatggcttcatcgtgtccctgagcctgatggagctgagcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaaccaggactgtgagctgccccgctggcacatgcatgacttcttccacagcttcctgattgtgttccgggtgctgtgtggggagtggattgagaccatgtgggactgcatggaggtggccggccaggccatgtgcctgattgtgttcatgatggtgatggtgattggcaacctggtggtgctgaacctcttcctggccctgctgctgagcagcttctctgctgacaacctggccgccacagatgatgatggagagatgaacaacctgcagatcagcgtcatccgcatcaagaagggcgtggcctggaccaagctgaaggtgcacgccttcatgcaggcccacttcaagcagcgggaggctgatgaggtgaagcccctggatgagctgtatgagaagaaggccaactgcatcgccaaccacactggagctgacatccacagaaatggagacttccagaagaatggaaatggcaccaccagcggcatcggcagctctgtggagaagtacatcattgatgaggaccacatgtccttcatcaacaaccccaacctgactgtgcgggtgcccatcgctgtgggggagagtgactttgagaacctgaacacagaagatgtgtcctctgagagtgaccctgagggcagcaaggacaagctggatgacaccagcagcagcgagggcagcaccatcgacatcaagccagaggtggaggaggtgcctgtggagcagcctgaggagtacctggaccctgatgcctgcttcacagagggctgtgtgcagcgcttcaagtgctgccaggtgaacatcgaggagggcctgggcaagtcctggtggatcctgaggaagacctgcttcctgattgtggagcacaactggtttgagaccttcatcatcttcatgatcctgctgagcagcggggccctggcctttgaggacatctacatcgagcagaggaagaccatccgcaccatcctggagtatgctgacaaggtgttcacctacatcttcatcctggagatgctgctgaagtggacagcctacggctttgtgaagttcttcaccaatgcctggtgctggctggacttcctgattgtggccgtgtccctggtgtccctcatcgccaatgccctgggctacagcgagctgggcgccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtaccactactgcttcaatgagaccagcgagatccgctttgaaattgaagatgtgaacaacaagacagaatgtgagaagctgatggagggcaacaacacagagatccgctggaagaatgtgaagatcaactttgacaacgtgggcgccggctacctggccctgctgcaggtggccaccttcaagggctggatggacatcatgtatgctgctgtggacagcaggaagccagatgagcagcccaagtatgaggacaacatctacatgtacatctacttcgtcatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatcccccggcccctgaacaagatccagggcatcgtgtttgattttgtgacccagcaggcctttgacatcgtcatcatgatgctgatctgcctgaacatggtgaccatgatggtggagacagacacccagagcaagcagatggagaacatcctgtactggatcaacctggtgtttgtgatcttcttcacctgtgaatgtgtgctgaagatgtttgccctgcggcactactacttcaccatcggctggaacatctttgattttgtggtggtgatcctgagcatcgtgggcatgttcctggccgacatcatcgagaagtactttgtgagccccaccctcttccgggtcatccggctggcccgcatcggccgcatcctgcggctcatcaagggggccaagggcatccgcaccctgctgtttgccctgatgatgagcctgcctgccctcttcaacatcggcctgctgctcttcctggtgatgttcatcttcagcatcttcggcatgagcaactttgcctacgtgaagcatgaggccggcattgatgacatgttcaactttgagacctttggaaacagcatgatctgcctcttccagatcaccaccagcgctggctgggatggcctgctgctgcccatcctgaaccggcccccagactgcagcctggacaaggagcaccctggcagcggcttcaagggggactgtggcaaccccagcgtgggcatcttcttctttgtgtcctacatcatcatctccttcctgattgtggtgaacatgtacatcgccatcatcctggagaacttctctgtggccacagaggagagcgctgaccccctgtctgaagatgactttgagaccttctatgagatctgggagaagtttgatcctgatgccacccagttcatcgagtactgcaagctggccgactttgctgatgccctggagcaccccctgcgggtgcccaagcccaacaccatcgagctgattgccatggacctgcccatggtgtctggggaccgcatccactgcctggacatcctgtttgccttcaccaagagggtgctgggggacagcggggagctggacatcctgcggcagcagatggaggagagatttgtggccagcaaccccagcaaggtgtcctatgagcccatcaccaccaccctgcggaggaagcaggaggaggtgtctgctgtggtgctgcagagggcctaccggggccacctggcccggcggggcttcatctgcaagaagaccaccagcaacaagctggagaatggaggcacccaccgggagaagaaggagagcacccccagcacagccagcctgcccagctatgattctgtgaccaagccagagaaggagaagcagcagagagctgaggagggcagaagagagcgggccaagaggcagaaggaggtgcgggagagcaaatgttag

SEQ ID NO: 170073 - DNA, 4674 bp, Artificial Sequence
  Description of Artificial Sequence: Synthetic coding sequence
atggccgcccggctgctggcccctcctggccctgacagcttcaagcccttcaccccagagagcctggccaacattgaaagaagaattgctgagagcaagctgaagaagccacccaaggcagatggcagccaccgggaggatgatgaggacagcaagcccaagcccaacagcgacctggaggccggcaagagcctgcccttcatctatggagacatcccccagggcctggtggccgtgcccctggaggactttgacccctactacctgacccagaagacctttgtggtgctgaacagaggcaagaccctcttccgcttcagcgccaccccagccctgtacatcctgagccccttcaacctgatccgccgcatcgccatcaagatcctgatccacagcgtcttctccatgatcatcatgtgcaccatcctgaccaactgtgtgttcatgaccttcagcaaccccccagactggagcaagaatgtggagtacaccttcaccggcatctacacctttgagagcctggtgaagatcatcgcccggggcttctgcattgatggcttcaccttcctgcgggacccctggaactggctggacttcagcgtcatcatgatggcctacatcacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgtgtggtgtggcccatcaacttcaatgaaagctacctggagaatggcaccaagggctttgactgggaggagtacatcaacaacaagaccaacttctacacagtgcccggcatgctggagcccctgctgtgtggcaacagcagtgatgctggccagtgcccagagggctaccagtgcatgaaggccggcaggaaccccaactacggctacaccagctttgacaccttctcctgggccttcctggccctcttccggctgatgacccaggactactgggagaacctgtaccagctgaccctgcgggctgctgggaagacctacatgatcttctttgtgctggtgatctttgtgggcagcttctacctggtgaacctgatcctggccgtggtggccatggcctatgaggagcagaaccaggccaccctggaggaggccgagcagaaggaggccgagttcaaggccatgctggagcagctgaagaagcagcaggaggaggcccaggccgccgccatggccaccagcgctggcaccgtgtctgaagatgccatcgaggaggagggggaggagggcggcggcagccccaggagcagcagcgagatcagcaagctgagcagcaagagcgccaaggagaggaggaacagaaggaagaagaggaagcagaaggagctgtctgagggggaggagaagggggaccctgagaaggtgttcaagtctgagagtgaagatggcatgaggaggaaggccttccggctgcctgacaaccgcatcggcaggaagttcagcatcatgaaccagagcctgctgagcatccctggcagccccttcctgagccgccacaacagcaagagcagcatcttctccttccggggccctggccgcttccgggaccccggctctgaaaatgaatttgctgatgatgagcacagcacagtggaggagagcgagggcagaagagacagcctcttcatccccatccgggcccgggagcggcgcagcagctacagcggctacagcggctacagccagggcagccgcagcagccgcatcttccccagcctgcggcgctctgtgaagaggaacagcacagtggactgcaatggagtggtgtccctcatcggcggccctggcagccacatcggcggccgcctgctgcctgaggccaccacagaggtggagatcaagaagaagggccctggcagcctgctggtgtccatggaccagctggccagctatggcaggaaggaccgcatcaacagcatcatgtctgtggtgaccaacaccctggtggaggagctggaggagagccagaggaagtgccccccctgctggtacaagtttgccaacaccttcctgatctgggagtgccacccctactggatcaagctgaaggagatcgtgaacctgattgtgatggacccctttgtggacctggccatcaccatctgcatcgtgctgaacaccctcttcatggccatggagcaccaccccatgaccccccagtttgaacatgtgctggccgtgggcaacctggtgttcaccggcatcttcaccgctgagatgttcctgaagctgattgccatggacccctactactacttccaggagggctggaacatctttgatggcttcatcgtgtccctgagcctgatggagctgagcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaaccaggactgtgagctgccccgctggcacatgcatgacttcttccacagcttcctgattgtgttccgggtgctgtgtggggagtggattgagaccatgtgggactgcatggaggtggccggccaggccatgtgcctgattgtgttcatgatggtgatggtgattggcaacctggtggtgctgaacctcttcctggccctgctgctgagcagcttctctgctgacaacctggccgccacagatgatgatggagagatgaacaacctgcagatcagcgtcatccgcatcaagaagggcgtggcctggaccaagctgaaggtgcacgccttcatgcaggcccacttcaagcagcgggaggctgatgaggtgaagcccctggatgagctgtatgagaagaaggccaactgcatcgccaaccacactggagctgacatccacagaaatggagacttccagaagaatggaaatggcaccaccagcggcatcggcagctctgtggagaagtacatcattgatgaggaccacatgtccttcatcaacaaccccaacctgactgtgcgggtgcccatcgctgtgggggagagtgactttgagaacctgaacacagaagatgtgtcctctgagagtgaccctgagggcagcaaggacaagctggatgacaccagcagcagcgagggcagcaccatcgacatcaagccagaggtggaggaggtgcctgtggagcagcctgaggagtacctggaccctgatgcctgcttcacagagggctgtgtgcagcgcttcaagtgctgccaggtgaacatcgaggagggcctgggcaagtcctggtggatcctgaggaagacctgcttcctgattgtggagcacaactggtttgagaccttcatcatcttcatgatcctgctgagcagcggggccctggcctttgaggacatctacatcgagcagaggaagaccatccgcaccatcctggagtatgctgacaaggtgttcacctacatcttcatcctggagatgctgctgaagtggacagcctacggctttgtgaagttcttcaccaatgcctggtgctggctggacttcctgattgtggccgtggtggtgaatgccctggtgggcgccatccccagcatcatgaatgtgctgctggtgtgcctgatcttctggctgatcttcagcatcatgggcgtgaacctgtttgctgggaagtaccactactgcttcaatgagaccagcgagatccgctttgaaattgaagatgtgaacaacaagacagaatgtgagaagctgatggagggcaacaacacagagatccgctggaagaatgtgaagatcaactttgacaacgtgggcgccggctacctggccctgctgcaggtggccaccttcaagggctggatggacatcatgtatgctgctgtggacagcaggaagccagatgagcagcccaagtatgaggacaacatctacatgtacatctactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatcccccggcccctgaacaagatccagggcatcgtgtttgattttgtgacccagcaggcctttgatattgtcatcatgatgctgatctgcctgaacatggtgaccatgatggtggagacagacacccagagcaagcagatggagaacatcctgtactggatcaacctggtgtttgtgatcttcttcacctgtgaatgtgtgctgaagatgtttgccctgcggcactactacttcaccatcggctggaacatctttgattttgtggtggtgatcctgagcatcgtgtag

SEQ ID NO: 170074 - DNA, 3588 bp, Artificial Sequence
  Description of Artificial Sequence: Synthetic coding sequence
ttcctgagcccccagacctttgtggtgctgaacagaggcaagaccctcttccgcttcagcgccaccccagccctgtacatcctgagccccttcaacctgatcagaagaattgccatcaagatcctgatccacagcctcttctccatgatcatcatgtgcaccatcctgaccaactgtgtgttcatgaccttcagcaaccccccagactggagcaagaatgtggagtacaccttcaccggcatctacacctttgagagcctggtgaagatcatcgcccggggcttctgcattgatggcttcaccttcctgcgggacccctggaactggctggacttcagcgtcatcatgatggcctacatcacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgagaaataaatgtgtggtgtggcccatcaacttcaatgaaagctacctggagaatggcaccaagggctttgactgggaggagtacatcaacaacaagaccaacttctacacagtgcccggcatgctggagcccctgctgtgtggcaacagcagtgatgctggccagtgcccagagggctaccagtgcatgaaggccggcaggaaccccaactacggctacaccagctttgacaccttctcctgggccttcctggccctcttccggctgatgacccaggactactgggagaacctgtaccagctgaccctgcgggccgccggcaagacctacatgatcttctttgtgctggtgatctttgtgggcagcttctacctggtgaacctgatcctggccgtggtggccatggcctatgaggagcagaaccaggccaccctggaggaggccgagcagaaggaggccgagttcaaggccatgctggagcagctgaagaagcagcaggaggaggcccaggccgccgccatggccaccagcgctggcaccgtgtctgaagatgccatcgaggaggagggggaggagggcggcggcagccccaggagcagcagcgagatcagcaagctgagcagcaagagcgccaaggagaggaggaacagaaggaagaagaggaagcagaaggagctgtctgagggggaggagaagggggaccctgagaaggtgttcaagtctgagagtgaagatggcatgaggaggaaggccttccggctgcctgacaacagaattggaaggaagttcagcatcatgaaccagagcctgctgagcatccctggcagccccttcctgagccgccacaacagcaagagcagcatcttctccttccggggccctggccgcttccgggaccccggctctgaaaatgaatttgctgatgatgagcacagcacagtggaggagagcgagggccggcgggacagcctcttcatccccatccgggcccgggagaggaggagcagctacagcggctacagcggctacagccagggcagccgcagcagccgcatcttccccagcctgcggcgctctgtgaagaggaacagcacagtggactgcaatggagtggtgtccctgattggaggccctggcagccacatcggcggccgcctgctgcctgaggccaccacagaggtggagatcaagaagaagggccctggcagcctgctggtgtccatggaccagctggccagctatggcaggaaggaccgcatcaacagcatcatgtctgtggtgaccaacaccctggtggaggagctggaggagagccagaggaaatgtcctccctgctggtacaagtttgccaacaccttcctgatctgggagtgccacccctactggatcaagctgaaggagatcgtgaacctgattgtgatggacccctttgtggacctggccatcaccatctgcatcgtgctgaacaccctcttcatggccatggagcaccaccccatgaccccccagtttgagcacgtgctggccgtgggcaacctggtgttcaccggcatcttcaccgctgagatgttcctgaagctgattgccatggacccctactactacttccaggagggctggaacatctttgatggcttcatcgtgtccctgagcctgatggagctgagcctggctgatgtggagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaaccaggactgtgagctgccccgctggcacatgcatgacttcttccacagcttcctgattgtgttccgggtgctgtgtggggagtggattgagaccatgtgggactgcatggaggtggccggccaggccatgtgcctgattgtgttcatgatggtgatggtgattggcaacctggtggtgctgaacctcttcctggccctgctgctgagcagcttctctgctgacaacctggccgccacagatgatgatggagagatgaacaacctgcagatcagcgtcatccgcatcaagaagggcgtggcctggaccaagctgaaggtgcacgccttcatgcaggcccacttcaagcagcgggaggctgatgaggtgaagcccctggatgagctgtatgagaagaaggccaactgcatcgccaaccacactggagctgacatccacagaaatggagacttccagaagaatggaaatggcaccaccagcggcatcggcagctctgtggagaagtacatcattgatgaggaccacatgtccttcatcaacaaccccaacctgactgtgcgggtgcccatcgctgtgggggagagtgactttgagaacctgaacacagaagatgtgagcagcgagagtgaccctgagggcagcaaggacaagctggatgacaccagcagcagcgagggcagcaccatcgacatcaagccagaggtggaggaggtgcctgtggagcagcctgaggagtacctggaccctgatgcctgcttcacagagggctgtgtgcagcgcttcaagtgctgccaggtgaacatcgaggagggcctgggcaagtcctggtggatcctgaggaagacctgcttcctgattgtggagcacaactggtttgagaccttcatcatcttcatgatcctgctgagcagcggggccctggcctttgaggacatctacatcgagcagaggaagaccatccgcaccatcctggagtatgctgacaaggtgttcacctacatcttcatcctggagatgctgctgaagtggacagcctacggctttgtgaagttcttcaccaatgcctggtgctggctggacttcctgattgtggccgtgcccctgaacctgagcggcctcatctag

SEQ ID NO: 170075 - DNA, 5820 bp, Artificial Sequence
  Description of Artificial Sequence: Synthetic coding sequence
atggccgcccggctgctggcccctcctggccctgacagcttcaagcccttcaccccagagagcctggccaacattgaaagaagaattgctgagagcaagctgaagaagccacccaaggcagatggcagccaccgggaggatgatgaggacagcaagcccaagcccaacagcgacctggaggccggcaagagcctgcccttcatctatggagacatcccccagggcctggtggccgtgcccctggaggactttgacccctactacctgacccagaagacctttgtggtgctgaacagaggcaagaccctcttccgcttcagcgccaccccagccctgtacatcctgagccccttcaacctgatccgccgcatcgccatcaagatcctgatccacagcgtcttctccatgatcatcatgtgcaccatcctgaccaactgtgtgttcatgaccttcagcaaccccccagactggagcaagaatgtggagtacaccttcaccggcatctacacctttgagagcctggtgaagatcatcgcccggggcttctgcattgatggcttcaccttcctgcgggacccctggaactggctggacttcagcgtcatcatgatggcctacatcacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgtgtggtgtggcccatcaacttcaatgaaagctacctggagaatggcaccaagggctttgactgggaggagtacatcaacaacaagaccaacttctacacagtgcccggcatgctggagcccctgctgtgtggcaacagcagtgatgctggccagtgcccagagggctaccagtgcatgaaggccggcaggaaccccaactacggctacaccagctttgacaccttctcctgggccttcctggccctcttccggctgatgacccaggactactgggagaacctgtaccagctgaccctgcgggctgctgggaagacctacatgatcttctttgtgctggtgatctttgtgggcagcttctacctggtgaacctgatcctggccgtggtggccatggcctatgaggagcagaaccaggccaccctggaggaggccgagcagaaggaggccgagttcaaggccatgctggagcagctgaagaagcagcaggaggaggcccaggccgccgccatggccaccagcgctggcaccgtgtctgaagatgccatcgaggaggagggggaggagggcggcggcagccccaggagcagcagcgagatcagcaagctgagcagcaagagcgccaaggagaggaggaacagaaggaagaagaggaagcagaaggagctgtctgagggggaggagaagggggaccctgagaaggtgttcaagtctgagagtgaagatggcatgaggaggaaggccttccggctgcctgacaaccgcatcggcaggaagttcagcatcatgaaccagagcctgctgagcatccctggcagccccttcctgagccgccacaacagcaagagcagcatcttctccttccggggccctggccgcttccgggaccccggctctgaaaatgaatttgctgatgatgagcacagcacagtggaggagagcgagggcagaagagacagcctcttcatccccatccgggcccgggagcggcgcagcagctacagcggctacagcggctacagccagggcagccgcagcagccgcatcttccccagcctgcggcgctctgtgaagaggaacagcacagtggactgcaatggagtggtgtccctcatcggcggccctggcagccacatcggcggccgcctgctgcctgaggccaccacagaggtggagatcaagaagaagggccctggcagcctgctggtgtccatggaccagctggccagctatggcaggaaggaccgcatcaacagcatcatgtctgtggtgaccaacaccctggtggaggagctggaggagagccagaggaagtgccccccctgctggtacaagtttgccaacaccttcctgatctgggagtgccacccctactggatcaagctgaaggagatcgtgaacctgattgtgatggacccctttgtggacctggccatcaccatctgcatcgtgctgaacaccctcttcatggccatggagcaccaccccatgaccccccagtttgaacatgtgctggccgtgggcaacctggtgttcaccggcatcttcaccgctgagatgttcctgaagctgattgccatggacccctactactacttccaggagggctggaacatctttgatggcttcatcgtgtccctgagcctgatggagctgagcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaaccaggactgtgagctgccccgctggcacatgcatgacttcttccacagcttcctgattgtgttccgggtgctgtgtggggagtggattgagaccatgtgggactgcatggaggtggccggccaggccatgtgcctgattgtgttcatgatggtgatggtgattggcaacctggtggtgctgaacctcttcctggccctgctgctgagcagcttctctgctgacaacctggccgccacagatgatgatggagagatgaacaacctgcagatcagcgtcatccgcatcaagaagggcgtggcctggaccaagctgaaggtgcacgccttcatgcaggcccacttcaagcagcgggaggctgatgaggtgaagcccctggatgagctgtatgagaagaaggccaactgcatcgccaaccacactggagctgacatccacagaaatggagacttccagaagaatggaaatggcaccaccagcggcatcggcagctctgtggagaagtacatcattgatgaggaccacatgtccttcatcaacaaccccaacctgactgtgcgggtgcccatcgctgtgggggagagtgactttgagaacctgaacacagaagatgtgtcctctgagagtgaccctgagggcagcaaggacaagctggatgacaccagcagcagcgagggcagcaccatcgacatcaagccagaggtggaggaggtgcctgtggagcagcctgaggagtacctggaccctgatgcctgcttcacagagggctgtgtgcagcgcttcaagtgctgccaggtgaacatcgaggagggcctgggcaagtcctggtggatcctgaggaagacctgcttcctgattgtggagcacaactggtttgagaccttcatcatcttcatgatcctgctgagcagcggggccctggcctttgaggacatctacatcgagcagaggaagaccatccgcaccatcctggagtatgctgacaaggtgttcacctacatcttcatcctggagatgctgctgaagtggacagcctacggctttgtgaagttcttcaccaatgcctggtgctggctggacttcctgattgtggccgtggtggtgaatgccctggtgggcgccatccccagcatcatgaatgtgctgctggtgtgcctgatcttctggctgatcttcagcatcatgggcgtgaacctgtttgctgggaagtaccactactgcttcaatgagaccagcgagatccgctttgaaattgaagatgtgaacaacaagacagaatgtgagaagctgatggagggcaacaacacagagatccgctggaagaatgtgaagatcaactttgacaacgtgggcgccggctacctggccctgctgcaggtggccaccttcaagggctggatggacatcatgtatgctgctgtggacagcaggaagccagatgagcagcccaagtatgaggacaacatctacatgtacatctactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatcccccggcccctgaacaagatccagggcatcgtgtttgattttgtgacccagcaggcctttgatattgtcatcatgatgctgatctgcctgaacatggtgaccatgatggtggagacagacacccagagcaagcagatggagaacatcctgtactggatcaacctggtgtttgtgatcttcttcacctgtgaatgtgtgctgaagatgtttgccctgcggcactactacttcaccatcggctggaacatctttgattttgtggtggtgatcctgagcatcgtgggcatgttcctggccgacatcatcgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatcttcagcatcttcggcatgagcaactttgcctacgtgaagcatgaagctggcattgatgacatgttcaactttgagaccttcggcaacagcatgatctgcctcttccagatcaccaccagcgctggctgggatggcctgctgctgcccatcctgaacagacctccagactgcagcctggacaaggagcaccctggcagcggcttcaagggggactgtggcaaccccagcgtgggcatcttcttctttgtgtcctacatcatcatctccttcctgattgtggtgaacatgtacatcgccatcatcctggagaacttctctgtggccacagaggagagcgctgaccccctgtctgaagatgactttgagaccttctatgagatctgggagaagtttgatcctgatgccacccagttcatcgagtactgcaagctggccgactttgctgatgccctggagcaccccctgcgggtgcccaagcccaacaccatcgagctgattgccatggacctgcccatggtgtctggggaccgcatccactgcctggacatcctgtttgccttcaccaagagggtgctgggggacagcggggagctggacatcctgcggcagcagatggaggagagatttgtggccagcaaccccagcaaggtgtcctatgagcccatcaccaccaccctgcggaggaagcaggaggaggtgtctgctgtggtgctgcagagggcctaccggggccacctggcccggcggggcttcatctgcaagaagaccaccagcaacaagctggagaatggaggcacccaccgggagaagaaggagagcacccccagcacagccagcctgcccagctatgacagcgtgaccaagccagagaaggagaagcagcagagagctgaggagggccggcgggagcgggccaagaggcagaaggaggtgcgggagagcaagtgctag

SEQ ID NO: 170076 - DNA, 2919 bp, Artificial Sequence
  Description of Artificial Sequence: Synthetic coding sequence
atggccgcccggctgctggcccctcctggccctgacagcttcaagcccttcaccccagagagcctggccaacattgaaagaagaattgctgagagcaagctgaagaagccacccaaggcagatggcagccaccgggaggatgatgaggacagcaagcccaagcccaacagcgacctggaggccggcaagagcctgcccttcatctatggagacatcccccagggcctggtggccgtgcccctggaggactttgacccctactacctgacccagaagacctttgtggtgctgaacagaggcaagaccctcttccgcttcagcgccaccccagccctgtacatcctgagccccttcaacctgatccgccgcatcgccatcaagatcctgatccacagcgtcttctccatgatcatcatgtgcaccatcctgaccaactgtgtgttcatgaccttcagcaaccccccagactggagcaagaatgtggagtacaccttcaccggcatctacacctttgagagcctggtgaagatcatcgcccggggcttctgcattgatggcttcaccttcctgcgggacccctggaactggctggacttcagcgtcatcatgatggcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgtgtggtgtggcccatcaacttcaatgaaagctacctggagaatggcaccaagggctttgactgggaggagtacatcaacaacaagaccaacttctacacagtgcccggcatgctggagcccctgctgtgtggcaacagcagtgatgctggccagtgcccagagggctaccagtgcatgaaggccggcaggaaccccaactacggctacaccagctttgacaccttctcctgggccttcctggccctcttccggctgatgacccaggactactgggagaacctgtaccagctgaccctgcgggctgctgggaagacctacatgatcttctttgtgctggtgatctttgtgggcagcttctacctggtgaacctgatcctggccgtggtggccatggcctatgaggagcagaaccaggccaccctggaggaggccgagcagaaggaggccgagttcaaggccatgctggagcagctgaagaagcagcaggaggaggcccaggccgccgccatggccaccagcgctggcaccgtgtctgaagatgccatcgaggaggagggggaggagggcggcggcagccccaggagcagcagcgagatcagcaagctgagcagcaagagcgccaaggagaggaggaacagaaggaagaagaggaagcagaaggagctgtctgagggggaggagaagggggaccctgagaaggtgttcaagtctgagagtgaagatggcatgaggaggaaggccttccggctgcctgacaaccgcatcggcaggaagttcagcatcatgaaccagagcctgctgagcatccctggcagccccttcctgagccgccacaacagcaagagcagcatcttctccttccggggccctggccgcttccgggaccccggctctgaaaatgaatttgctgatgatgagcacagcacagtggaggagagcgagggcagaagagacagcctcttcatccccatccgggcccgggagcggcgcagcagctacagcggctacagcggctacagccagggcagccgcagcagccgcatcttccccagcctgcggcgctctgtgaagaggaacagcacagtggactgcaatggagtggtgtccctcatcggcggccctggcagccacatcggcggccgcctgctgcctgaggccaccacagaggtggagatcaagaagaagggccctggcagcctgctggtgtccatggaccagctggccagctatggcaggaaggaccgcatcaacagcatcatgtctgtggtgaccaacaccctggtggaggagctggaggagagccagaggaagtgccccccctgctggtacaagtttgccaacaccttcctgatctgggagtgccacccctactggatcaagctgaaggagatcgtgaacctgattgtgatggacccctttgtggacctggccatcaccatctgcatcgtgctgaacaccctcttcatggccatggagcaccaccccatgaccccccagtttgaacatgtgctggccgtgggcaacctggtgttcaccggcatcttcaccgctgagatgttcctgaagctgattgccatggacccctactactacttccaggagggctggaacatctttgatggcttcatcgtgtccctgagcctgatggagctgagcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaaccaggactgtgagctgccccgctggcacatgcatgacttcttccacagcttcctgattgtgttccgggtgctgtgtggggagtggattgagaccatgtgggactgcatggaggtggccggccaggccatgtgcctgattgtgttcatgatggtgatggtgattggcaacctggtggtgtccaccaacctgtag

SEQ ID NO: 170077 - DNA, 6030 bp, Artificial Sequence
  Description of Artificial Sequence: Synthetic coding sequence
atggagcagacagtgctggtgcccccaggccctgacagcttcaacttcttcacccgggagagcctggccgccattgaaagaagaattgctgaggagaaggccaagaaccccaagccagacaagaaggatgatgatgaaaatggccccaagcccaacagcgacctggaggccggcaagaacctgcccttcatctatggagacatccccccagagatggtgtctgagcccctggaggacctggacccctactacatcaacaagaagaccttcatcgtgctgaacaagggcaaggccatcttccgcttcagcgccaccagcgccctgtacatcctgacccccttcaaccccctgaggaagatcgccatcaagatcctggtgcacagcctcttctccatgctgatcatgtgcaccatcctgaccaactgtgtgttcatgaccatgagcaaccccccagactggaccaagaatgtggagtacaccttcaccggcatctacacctttgagagcctcatcaagatcatcgcccggggcttctgcctggaggacttcaccttcctgcgggacccctggaactggctggacttcaccgtcatcacctttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcatccagtggccacccaccaatgccagcctggaggagcacagcattgagaagaacatcaccgtgaactacaacggcaccctcatcaatgagaccgtgtttgaatttgactggaagagctacatccaggacagccgctaccactacttcctggagggcttcctggatgccctgctgtgtggcaacagcagtgatgctggccagtgcccagagggctacatgtgtgtgaaggccggcaggaaccccaactacggctacaccagctttgacaccttctcctgggccttcctgagcctcttccggctgatgacccaggacttctgggagaacctgtaccagctgaccctgcgggctgctgggaagacctacatgatcttctttgtgctggtgatcttcctgggcagcttctacctgatcaacctgatcctggccgtggtggccatggcctatgaggagcagaaccaggccaccctggaggaggccgagcagaaggaggccgagttccagcagatgattgagcagctgaagaagcagcaggaggccgcccagcaggccgccacagccacagccagcgagcacagccgggagcccagcgctgctggccgcctgagtgacagcagcagcgaggccagcaagctgagcagcaagagcgccaaggagaggaggaacagaaggaagaagaggaagcagaaggagcagagcggcggggaggagaaggatgaagatgagttccagaagtctgagagcgaggacagcatccggaggaagggcttccgcttcagcattgagggcaaccggctgacctatgagaagcgctacagcagcccccaccagagcctgctgagcatccggggcagcctcttcagccccaggaggaacagcaggaccagcctcttctccttccggggccgggccaaggatgtgggctctgaaaatgactttgctgatgatgagcacagcacctttgaagataatgaaagccggcgggacagcctgtttgtgccccggcggcacggggagaggaggaacagcaacctgagccagaccagccgcagcagcaggatgctggccgtgtttcctgccaacgggaagatgcacagcacagtggactgcaatggagtggtgtccctggtgggcggccccagcgtgcccaccagccctgtgggccagctgctgcctgaggtgatcatcgacaagccagccacagatgacaatggcaccaccacagaaacagagatgaggaagaggaggagcagcagcttccacgtgtccatggacttcctggaggaccccagccagaggcagagggccatgagcatcgccagcatcctgaccaacacagtggaggagctggaggagagccggcagaagtgccccccctgctggtacaagttcagcaacatcttcctgatctgggactgcagcccctactggctgaaggtgaagcacgtggtgaacctggtggtgatggacccctttgtggacctggccatcaccatctgcatcgtgctgaacaccctcttcatggccatggagcactaccccatgacagaccacttcaacaacgtgctgactgtgggcaacctggtgttcaccggcatcttcaccgctgagatgttcctgaagatcatcgccatggacccctactactacttccaggagggctggaacatctttgatggcttcatcgtgaccctgagcctggtggagctgggcctggccaacgtggagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggactgtgtgtgcaagatcgccagtgactgccagctgccccgctggcacatgaatgacttcttccacagcttcctgattgtgttccgggtgctgtgtggggagtggattgagaccatgtgggactgcatggaggtggccggccaggccatgtgcctgaccgtcttcatgatggtgatggtgattggcaacctggtggtgctgaacctcttcctggccctgctgctgagcagcttctctgctgacaacctggccgccacagatgatgacaatgagatgaacaacctgcagattgctgtggacaggatgcacaagggcgtggcctacgtgaagaggaagatctatgagttcatccagcagagcttcatcaggaagcagaagatcctggatgagatcaagcccctggatgacctgaacaacaagaaggacagctgcatgagcaaccacacagctgagatcggcaaggacctggactacctgaaggatgtgaatggcaccaccagcggcatcggcaccggcagctctgtggagaagtacatcattgatgaaagtgactacatgtccttcatcaacaaccccagcctgactgtgacagtgcccatcgctgtgggggagagtgactttgagaacctgaacacagaggacttcagcagcgagagtgacctggaggagagcaaggagaagctgaatgaaagcagcagcagcagcgagggcagcacagtggacattggagcccctgtggaggagcagcctgtggtggagcctgaggagaccctggagcctgaggcctgcttcacagagggctgtgtgcagcgcttcaagtgctgccagatcaacgtggaggagggccggggcaagcagtggtggaacctgcggaggacctgcttccgcatcgtggagcacaactggtttgagaccttcatcgtgttcatgatcctgctgagcagcggggccctggcctttgaggacatctacatcgaccagaggaagaccatcaagaccatgctggagtatgctgacaaggtgttcacctacatcttcatcctggagatgctgctgaagtgggtggcctacggctaccagacctacttcaccaatgcctggtgctggctggacttcctgattgtggatgtgtccctggtgtccctgacagccaatgccctgggctacagcgagctgggcgccatcaagagcctgcggaccctgcgggccctgcggcccctgcgggccctgagcagatttgagggcatgagggtggtggtgaatgccctgctgggcgccatccccagcatcatgaatgtgctgctggtgtgcctgatcttctggctgatcttcagcatcatgggcgtgaacctgtttgctgggaagttctaccactgcatcaacaccaccactggagacagatttgatattgaagatgtgaacaaccacacagactgcctgaagctgattgaaagaaatgaaacagcccgctggaagaatgtgaaggtgaactttgacaacgtgggcttcggctacctgagcctgctgcaggtggccaccttcaagggctggatggacatcatgtatgctgctgtggacagcagaaatgtggagctgcagcccaagtatgaggagagcctgtacatgtacctgtactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatcccccggcccggcaacaagttccagggcatggtgtttgattttgtgacccggcaggtgtttgacatcagcatcatgatcctgatctgcctgaacatggtgaccatgatggtggagacagatgaccagagtgaatatgtgaccaccatcctgagccgcatcaacctggtgttcatcgtgctcttcaccggagaatgtgtgctgaagctgatcagcctgcggcactactacttcaccatcggctggaacatctttgattttgtggtggtgatcctgagcatcgtgggcatgttcctggccgagctgattgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagcgggaggtgggcattgatgacatgttcaactttgagaccttcggcaacagcatgatctgcctcttccagatcaccaccagcgctggctgggatggcctgctggcccccatcctgaacagcaagcccccagactgtgaccccaacaaggtgaaccctggcagctctgtgaagggggactgtggcaaccccagcgtgggcatcttcttctttgtgtcctacatcatcatctccttcctggtggtggtgaacatgtacatcgctgtgatcctggagaacttctctgtggccacagaggagagcgctgagcccctgtctgaagatgactttgagatgttttatgaggtgtgggagaagtttgatcctgatgccacccagttcatggagtttgagaagctgagccagtttgctgctgccctggagccccccctgaacctgccccagcccaacaagctgcagctgattgccatggacctgcccatggtgtctggggaccgcatccactgcctggacatcctgtttgccttcaccaagagggtgctgggggagagcggggagatggatgccctgcgcatccagatggaggagcgcttcatggccagcaaccccagcaaggtgtcctaccagcccatcaccaccaccctgaagaggaagcaggaggaggtgtctgctgtgatcatccagagggcctacagaagacacctgctgaagaggacagtgaagcaggccagcttcacctacaacaagaacaagatcaagggcggggccaacctgctgatcaaggaggacatgatcatcgaccgcatcaatgaaaacagcatcacagagaagacagacctgaccatgagcacagctgcctgccccccatcctatgacagagtgaccaagcccatcgtggagaagcatgagcaggagggcaaggatgagaaggccaagggcaagtag

SEQ ID NO: 170078 - DNA, 5997 bp, Artificial Sequence
  Description of Artificial Sequence: Synthetic coding sequence
atggagcagacagtgctggtgcccccaggccctgacagcttcaacttcttcacccgggagagcctggccgccattgaaagaagaattgctgaggagaaggccaagaaccccaagccagacaagaaggatgatgatgaaaatggccccaagcccaacagcgacctggaggccggcaagaacctgcccttcatctatggagacatccccccagagatggtgtctgagcccctggaggacctggacccctactacatcaacaagaagaccttcatcgtgctgaacaagggcaaggccatcttccgcttcagcgccaccagcgccctgtacatcctgacccccttcaaccccctgaggaagatcgccatcaagatcctggtgcacagcctcttctccatgctgatcatgtgcaccatcctgaccaactgtgtgttcatgaccatgagcaaccccccagactggaccaagaatgtggagtacaccttcaccggcatctacacctttgagagcctcatcaagatcatcgcccggggcttctgcctggaggacttcaccttcctgcgggacccctggaactggctggacttcaccgtcatcacctttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcatccagtggccacccaccaatgccagcctggaggagcacagcattgagaagaacatcaccgtgaactacaacggcaccctcatcaatgagaccgtgtttgaatttgactggaagagctacatccaggacagccgctaccactacttcctggagggcttcctggatgccctgctgtgtggcaacagcagtgatgctggccagtgcccagagggctacatgtgtgtgaaggccggcaggaaccccaactacggctacaccagctttgacaccttctcctgggccttcctgagcctcttccggctgatgacccaggacttctgggagaacctgtaccagctgaccctgcgggctgctgggaagacctacatgatcttctttgtgctggtgatcttcctgggcagcttctacctgatcaacctgatcctggccgtggtggccatggcctatgaggagcagaaccaggccaccctggaggaggccgagcagaaggaggccgagttccagcagatgattgagcagctgaagaagcagcaggaggccgcccagcaggccgccacagccacagccagcgagcacagccgggagcccagcgctgctggccgcctgagtgacagcagcagcgaggccagcaagctgagcagcaagagcgccaaggagaggaggaacagaaggaagaagaggaagcagaaggagcagagcggcggggaggagaaggatgaagatgagttccagaagtctgagagcgaggacagcatccggaggaagggcttccgcttcagcattgagggcaaccggctgacctatgagaagcgctacagcagcccccaccagagcctgctgagcatccggggcagcctcttcagccccaggaggaacagcaggaccagcctcttctccttccggggccgggccaaggatgtgggctctgaaaatgactttgctgatgatgagcacagcacctttgaagataatgaaagccggcgggacagcctgtttgtgccccggcggcacggggagaggaggaacagcaacctgagccagaccagccgcagcagcaggatgctggccgtgtttcctgccaacgggaagatgcacagcacagtggactgcaatggagtggtgtccctggtgggcggccccagcgtgcccaccagccctgtgggccagctgctgcctgagggcaccaccacagaaacagagatgaggaagagaagaagcagcagcttccacgtgtccatggacttcctggaggaccccagccagaggcagagggccatgagcatcgccagcatcctgaccaacacagtggaggagctggaggagagccggcagaagtgccccccctgctggtacaagttcagcaacatcttcctgatctgggactgcagcccctactggctgaaggtgaagcacgtggtgaacctggtggtgatggacccctttgtggacctggccatcaccatctgcatcgtgctgaacaccctcttcatggccatggagcactaccccatgacagaccacttcaacaacgtgctgactgtgggcaacctggtgttcaccggcatcttcaccgctgagatgttcctgaagatcatcgccatggacccctactactacttccaggagggctggaacatctttgatggcttcatcgtgaccctgagcctggtggagctgggcctggccaacgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggactgtgtgtgcaagatcgccagtgactgccagctgccccgctggcacatgaatgacttcttccacagcttcctgattgtgttccgggtgctgtgtggggagtggattgagaccatgtgggactgcatggaggtggccggccaggccatgtgcctgactgtgttcatgatggtgatggtgattggcaacctggtggtgctgaacctcttcctggccctgctgctgagcagcttctctgctgacaacctggccgccacagatgatgacaatgagatgaacaacctgcagattgctgtggacaggatgcacaagggcgtggcctacgtgaagaggaagatctatgagttcatccagcagagcttcatcaggaagcagaagatcctggatgagatcaagcccctggatgacctgaacaacaagaaggacagctgcatgagcaaccacacagctgagatcggcaaggacctggactacctgaaggatgtgaatggcaccaccagcggcattggaacaggcagctctgtggagaagtacatcattgatgaaagtgactacatgtccttcatcaacaaccccagcctgactgtgacagtgcccatcgctgtgggggagagtgactttgagaacctgaacacagaggacttcagcagcgagagtgacctggaggagagcaaggagaagctgaatgaaagcagcagcagcagcgagggcagcacagtggacatcggggcccctgtggaggagcagcctgtggtggagcctgaggagaccctggagcctgaggcctgcttcacagagggctgtgtgcagcgcttcaagtgctgccagatcaacgtggaggagggccggggcaagcagtggtggaacctgcggaggacctgcttcagaattgtggagcacaactggtttgagaccttcatcgtgttcatgatcctgctgagcagcggggccctggcctttgaggacatctacatcgaccagaggaagaccatcaagaccatgctggagtatgctgacaaggtgttcacctacatcttcatcctggagatgctgctgaagtgggtggcctacggctaccagacctacttcaccaatgcctggtgctggctggacttcctgattgtggatgtgtccctggtgtccctgacagccaatgccctgggctacagcgagctgggcgccatcaagagcctgcggaccctgcgggccctgcggcccctgcgggccctgagcagatttgagggcatgagggtggtggtgaatgccctgctgggcgccatccccagcatcatgaatgtgctgctggtgtgcctgatcttctggctgatcttcagcatcatgggcgtgaacctgtttgctgggaagttctaccactgcatcaacaccaccaccggggacagatttgatattgaagatgtgaacaaccacacagactgcctgaagctgattgaaagaaatgaaacagcccgctggaagaatgtgaaggtgaactttgacaacgtgggcttcggctacctgagcctgctgcaggtggccaccttcaagggctggatggacatcatgtatgctgctgtggacagcagaaatgtggagctgcagcccaagtatgaggagagcctgtacatgtacctgtacttcgtcatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatccccaggcctggcaacaagttccagggcatggtgtttgattttgtgacccggcaggtgtttgacatcagcatcatgatcctgatctgcctgaacatggtgaccatgatggtggagacagatgaccagagtgaatatgtgaccaccatcctgagccgcatcaacctggtgttcatcgtgctcttcaccggggagtgtgtgctgaagctgatcagcctgcggcactactacttcaccatcggctggaacatctttgattttgtggtggtgatcctgagcatcgtgggcatgttcctggccgagctgattgagaagtactttgtgagccccaccctcttccgggtcatccggctggcccgcatcggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagcgggaggtgggcattgatgacatgttcaactttgagacctttggaaacagcatgatctgcctcttccagatcaccaccagcgctggctgggatggcctgctggcccccatcctgaacagcaagcccccagactgtgaccccaacaaggtgaaccctggcagctctgtgaagggggactgtggcaaccccagcgtgggcatcttcttctttgtgtcctacatcatcatctccttcctggtggtggtgaacatgtacatcgccgtcatcctggagaacttctctgtggccacagaggagagcgctgagcccctgtctgaagatgactttgagatgttttatgaggtgtgggagaagtttgatcctgatgccacccagttcatggagtttgagaagctgagccagtttgctgctgccctggagccccccctgaacctgccccagcccaacaagctgcagctgattgccatggacctgcccatggtgtctggggaccgcatccactgcctggacatcctgtttgccttcaccaagagggtgctgggggagagcggggagatggatgccctgcgcatccagatggaggagcgcttcatggccagcaaccccagcaaggtgtcctaccagcccatcaccaccaccctgaagaggaagcaggaggaggtgtctgctgtgatcatccagagggcctaccgccgccacctgctgaagaggacagtgaagcaggccagcttcacctacaacaagaacaagatcaagggcggggccaacctgctgatcaaggaggacatgatcatcgaccgcatcaatgaaaattccatcacagagaagacagacctgaccatgagcacagctgcctgcccccccagctatgacagagtgaccaagcccatcgtggagaagcatgagcaggagggcaaggatgagaaggccaagggcaagtag

SEQ ID NO: 170079 - DNA, 5946 bp, Artificial Sequence
  Description of Artificial Sequence: Synthetic coding sequence
atggagcagacagtgctggtgcccccaggccctgacagcttcaacttcttcacccgggagagcctggccgccattgaaagaagaattgctgaggagaaggccaagaaccccaagccagacaagaaggatgatgatgaaaatggccccaagcccaacagcgacctggaggccggcaagaacctgcccttcatctatggagacatccccccagagatggtgtctgagcccctggaggacctggacccctactacatcaacaagaagaccttcatcgtgctgaacaagggcaaggccatcttccgcttcagcgccaccagcgccctgtacatcctgacccccttcaaccccctgaggaagatcgccatcaagatcctggtgcacagcctcttctccatgctgatcatgtgcaccatcctgaccaactgtgtgttcatgaccatgagcaaccccccagactggaccaagaatgtggagtacaccttcaccggcatctacacctttgagagcctcatcaagatcatcgcccggggcttctgcctggaggacttcaccttcctgcgggacccctggaactggctggacttcaccgtcatcacctttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcatccagtggccacccaccaatgccagcctggaggagcacagcattgagaagaacatcaccgtgaactacaacggcaccctcatcaatgagaccgtgtttgaatttgactggaagagctacatccaggacagccgctaccactacttcctggagggcttcctggatgccctgctgtgtggcaacagcagtgatgctggccagtgcccagagggctacatgtgtgtgaaggccggcaggaaccccaactacggctacaccagctttgacaccttctcctgggccttcctgagcctcttccggctgatgacccaggacttctgggagaacctgtaccagctgaccctgcgggctgctgggaagacctacatgatcttctttgtgctggtgatcttcctgggcagcttctacctgatcaacctgatcctggccgtggtggccatggcctatgaggagcagaaccaggccaccctggaggaggccgagcagaaggaggccgagttccagcagatgattgagcagctgaagaagcagcaggaggccgcccagcaggccgccacagccacagccagcgagcacagccgggagcccagcgctgctggccgcctgagtgacagcagcagcgaggccagcaagctgagcagcaagagcgccaaggagaggaggaacagaaggaagaagaggaagcagaaggagcagagcggcggggaggagaaggatgaagatgagttccagaagtctgagagcgaggacagcatccggaggaagggcttccgcttcagcattgagggcaaccggctgacctatgagaagcgctacagcagcccccaccagagcctgctgagcatccggggcagcctcttcagccccaggaggaacagcaggaccagcctcttctccttccggggccgggccaaggatgtgggctctgaaaatgactttgctgatgatgagcacagcacctttgaagataatgaaagccggcgggacagcctgtttgtgccccggcggcacggggagaggaggaacagcaacctgagccagaccagccgcagcagcaggatgctggccgtgtttcctgccaacgggaagatgcacagcacagtggactgcaatggagtggtgtccctgggcaccaccacagaaacagagatgaggaagaggaggagcagcagcttccacgtgtccatggacttcctggaggaccccagccagaggcagagggccatgagcatcgccagcatcctgaccaacacagtggaggagctggaggagagccggcagaagtgccccccctgctggtacaagttcagcaacatcttcctgatctgggactgcagcccctactggctgaaggtgaagcacgtggtgaacctggtggtgatggacccctttgtggacctggccatcaccatctgcatcgtgctgaacaccctcttcatggccatggagcactaccccatgacagaccacttcaacaacgtgctgactgtgggcaacctggtgttcaccggcatcttcaccgctgagatgttcctgaagatcatcgccatggacccctactactacttccaggagggctggaacatctttgatggcttcatcgtgaccctgagcctggtggagctgggcctggccaacgtggagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggactgtgtgtgcaagatcgccagtgactgccagctgccccgctggcacatgaatgacttcttccacagcttcctgattgtgttccgggtgctgtgtggggagtggattgagaccatgtgggactgcatggaggtggccggccaggccatgtgcctgaccgtcttcatgatggtgatggtgattggcaacctggtggtgctgaacctcttcctggccctgctgctgagcagcttctctgctgacaacctggccgccacagatgatgacaatgagatgaacaacctgcagattgctgtggacaggatgcacaagggcgtggcctacgtgaagaggaagatctatgagttcatccagcagagcttcatcaggaagcagaagatcctggatgagatcaagcccctggatgacctgaacaacaagaaggacagctgcatgagcaaccacacagctgagatcggcaaggacctggactacctgaaggatgtgaatggcaccaccagcggcatcggcaccggcagctctgtggagaagtacatcattgatgaaagtgactacatgtccttcatcaacaaccccagcctgactgtgacagtgcccatcgctgtgggggagagtgactttgagaacctgaacacagaggacttcagcagcgagagtgacctggaggagagcaaggagaagctgaatgaaagcagcagcagcagcgagggcagcacagtggacattggagcccctgtggaggagcagcctgtggtggagcctgaggagaccctggagcctgaggcctgcttcacagagggctgtgtgcagcgcttcaagtgctgccagatcaacgtggaggagggccggggcaagcagtggtggaacctgcggaggacctgcttccgcatcgtggagcacaactggtttgagaccttcatcgtgttcatgatcctgctgagcagcggggccctggcctttgaggacatctacatcgaccagaggaagaccatcaagaccatgctggagtatgctgacaaggtgttcacctacatcttcatcctggagatgctgctgaagtgggtggcctacggctaccagacctacttcaccaatgcctggtgctggctggacttcctgattgtggatgtgtccctggtgtccctgacagccaatgccctgggctacagcgagctgggcgccatcaagagcctgcggaccctgcgggccctgcggcccctgcgggccctgagcagatttgagggcatgagggtggtggtgaatgccctgctgggcgccatccccagcatcatgaatgtgctgctggtgtgcctgatcttctggctgatcttcagcatcatgggcgtgaacctgtttgctgggaagttctaccactgcatcaacaccaccactggagacagatttgatattgaagatgtgaacaaccacacagactgcctgaagctgattgaaagaaatgaaacagcccgctggaagaatgtgaaggtgaactttgacaacgtgggcttcggctacctgagcctgctgcaggtggccaccttcaagggctggatggacatcatgtatgctgctgtggacagcagaaatgtggagctgcagcccaagtatgaggagagcctgtacatgtacctgtactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatcccccggcccggcaacaagttccagggcatggtgtttgattttgtgacccggcaggtgtttgacatcagcatcatgatcctgatctgcctgaacatggtgaccatgatggtggagacagatgaccagagtgaatatgtgaccaccatcctgagccgcatcaacctggtgttcatcgtgctcttcaccggagaatgtgtgctgaagctgatcagcctgcggcactactacttcaccatcggctggaacatctttgattttgtggtggtgatcctgagcatcgtgggcatgttcctggccgagctgattgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagcgggaggtgggcattgatgacatgttcaactttgagaccttcggcaacagcatgatctgcctcttccagatcaccaccagcgctggctgggatggcctgctggcccccatcctgaacagcaagcccccagactgtgaccccaacaaggtgaaccctggcagctctgtgaagggggactgtggcaaccccagcgtgggcatcttcttctttgtgtcctacatcatcatctccttcctggtggtggtgaacatgtacatcgctgtgatcctggagaacttctctgtggccacagaggagagcgctgagcccctgtctgaagatgactttgagatgttttatgaggtgtgggagaagtttgatcctgatgccacccagttcatggagtttgagaagctgagccagtttgctgctgccctggagccccccctgaacctgccccagcccaacaagctgcagctgattgccatggacctgcccatggtgtctggggaccgcatccactgcctggacatcctgtttgccttcaccaagagggtgctgggggagagcggggagatggatgccctgcgcatccagatggaggagcgcttcatggccagcaaccccagcaaggtgtcctaccagcccatcaccaccaccctgaagaggaagcaggaggaggtgtctgctgtgatcatccagagggcctacagaagacacctgctgaagaggacagtgaagcaggccagcttcacctacaacaagaacaagatcaagggcggggccaacctgctgatcaaggaggacatgatcatcgaccgcatcaatgaaaacagcatcacagagaagacagacctgaccatgagcacagctgcctgccccccatcctatgacagagtgaccaagcccatcgtggagaagcatgagcaggagggcaaggatgagaaggccaagggcaagtag

SEQ ID NO: 170080 - DNA, 6030 bp, Artificial Sequence; identical to SEQ ID NO: 170077
  Description of Artificial Sequence: Synthetic coding sequence

SEQ ID NO: 170081 - DNA, 657 bp, Artificial Sequence
  Description of Artificial Sequence: Synthetic coding sequence
atgggccgcctgctggccctggtggtgggcgccgccctggtgagcagcgcctgtggcggctgtgtggaggtggacagcgagacagaggccgtgtatggcatgaccttcaagatcctgtgcatcagctgcaagagaagaagtgagaccaatgctgagaccttcacagagtggaccttccggcagaagggcacagaggagtttgtgaagatcctgcgctatgaaaatgaggtgctgcagctggaggaggatgaaagatttgagggccgggtggtgtggaatggcagccggggcaccaaggacctgcaggacctgagcatcttcatcaccaacgtgacctacaaccacagcggggactatgagtgccacgtgtaccgcctgctcttctttgagaactatgagcacaacacctctgtggtgaagaagatccacatcgaggtggtggacaaggccaacagagacatggccagcatcgtgtctgagatcatgatgtatgtgctgattgtggtgctgaccatctggctggtggccgagatgatctactgctacaagaagattgctgctgccacagaaacagctgcccaggagaatgccagcgagtacctggccatcaccagcgagagcaaagaaaactgcaccggggtgcaggtggccgagtag

SEQ ID NO: 170082 - DNA, 807 bp, Artificial Sequence
  Description of Artificial Sequence: Synthetic coding sequence
atgggccgcctgctggccctggtggtgggcgccgccctggtgagcagcgcctgtggcggctgtgtggaggtggacagcgagacagaggccgtgtatggcatgaccttcaagatcctgtgcatcagctgcaagagaagaagtgagaccaatgctgagaccttcacagagtggaccttccggcagaagggcacagaggagtttgtgaagatcctgcgctatgaaaatgaggtgctgcagctggaggaggatgaaagatttgagggccgggtggtgtggaatggcagccggggcaccaaggacctgcaggacctgagcatcttcatcaccaacgtgacctacaaccacagcggggactatgagtgccacgtgtaccgcctgctcttctttgagaactatgagcacaacacctctgtggtgaagaagatccacatcgaggtggtggacaagggggagagcggggccgcctgccccttcaccgtgacccacagaagagcccgctggagggaccgctggcaggccgtggacagaacaggctggctgtgtgcctggccagccaaccggccccagcagagagctgagggggagggcagcagccccagctgccccctgcagctgtggcccctcttcctgagcagcccccggcggggccagagcatgcctgtgccccaccggcgcagcggctaccgcacccagctgtgccacctgtgctgcatgaccagcggccgctgcctgctgagcctgagccagagggtggtgctgggcctgcccggcatcatcatccgctgtgtgtcccggggcgtggtgtag

SEQ ID NO: 170083 - DNA, 6018 bp, Artificial Sequence
  Description of Artificial Sequence: Synthetic coding sequence
atggcccagagcgtgctggtgcccccaggccctgacagcttccgcttcttcacccgggagagcctggccgccatcgagcagagaattgctgaggagaaggccaagaggcccaagcaggagaggaaggatgaagatgatgaaaatggccccaagcccaacagcgacctggaggccggcaagagcctgcccttcatctacggggacatccccccagagatggtgtctgtgcccctggaggacctggacccctactacatcaacaagaagaccttcatcgtgctgaacaagggcaaggccatcagccgcttcagcgccaccccagccctgtacatcctgacccccttcaaccccatcaggaagctggccatcaagatcctggtgcacagcctcttcaacatgctgatcatgtgcaccatcctgaccaactgtgtgttcatgaccatgagcaaccccccagactggaccaagaatgtggagtacaccttcaccggcatctacacctttgagagcctcatcaagatcctggcccggggcttctgcctggaggacttcaccttcctgcgggacccctggaactggctggacttcaccgtcatcacctttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgaggaacaagtgcctgcagtggcccccagacaacagcagctttgagatcaacatcaccagcttcttcaacaacagcctggatggaaatggcaccaccttcaacagaacagtgtccatcttcaactgggatgagtacatcgaggacaagagccacttctacttcctggagggccagaatgatgccctgctgtgtggcaacagcagtgatgctggccagtgcccagagggctacatctgtgtgaaggccggcaggaaccccaactacggctacaccagctttgacaccttctcctgggccttcctgagcctcttccggctgatgacccaggacttctgggagaacctgtaccagctgaccctgcgggctgctgggaagacctacatgatcttctttgtgctggtgatcttcctgggcagcttctacctgatcaacctgatcctggccgtggtggccatggcctatgaggagcagaaccaggccaccctggaggaggccgagcagaaggaggccgagttccagcagatgctggagcagctgaagaagcagcaggaggaggcccaggccgctgctgctgctgccagcgctgagagccgggacttctctggagctgggggcatcggggtcttcagcgagagcagctctgtggccagcaagctgagcagcaagtctgagaaggagctgaagaacagaaggaagaagaagaagcagaaggagcagagcggggaggaggagaagaatgacagagtgaggaagtctgagagtgaagattccatccggaggaagggcttccgcttcagcctggagggcagccggctgacctatgagaagcgcttcagcagcccccaccagagcctgctgagcatccggggcagcctcttcagccccaggaggaacagccgggccagcctcttctccttccggggccgggccaaggacatcggctctgaaaatgactttgctgatgatgagcacagcacctttgaggacaatgacagcagaagagacagcctgtttgtgccccacagacatggagagcggcggcacagcaatgtgtcccaggccagccgggccagccgggtgctgcccatcctgcccatgaatggcaagatgcacagcgctgtggactgcaatggagtggtgtccctggtgggcggccccagcaccctgaccagcgctggccagctgctgcctgagggcaccaccacagaaacagagatcaggaagagaagaagcagcagctaccacgtgtccatggacctgctggaggaccccaccagccggcagagggccatgagcatcgccagcatcctgaccaacaccatggaggagctggaggagagccggcagaagtgccccccctgctggtacaagtttgccaacatgtgcctgatctgggactgctgcaagccctggctgaaggtgaagcacctggtgaacctggtggtgatggacccctttgtggacctggccatcaccatctgcatcgtgctgaacaccctcttcatggccatggagcactaccccatgacagagcagttcagctctgtgctgtctgtgggcaacctggtgttcaccggcatcttcaccgctgagatgttcctgaagatcatcgccatggacccctactactacttccaggagggctggaacatctttgatggcttcatcgtgtccctgagcctgatggagctgggcctggccaacgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcagcaatgactgtgagctgccccgctggcacatgcatgacttcttccacagcttcctgattgtgttccgggtgctgtgtggggagtggattgagaccatgtgggactgcatggaggtggccggccagaccatgtgcctgactgtgttcatgatggtgatggtgattggcaacctggtggtgctgaacctcttcctggccctgctgctgagcagcttcagcagtgacaacctggccgccacagatgatgacaatgagatgaacaacctgcagattgctgtgggccgcatgcagaagggcatcgactttgtgaagaggaagatccgggagttcatccagaaggcctttgtgaggaagcagaaggccctggatgagatcaagcccctggaggacctgaacaacaagaaggacagctgcatcagcaaccacaccaccattgaaattggcaaggacctgaactacctgaaggatggaaatggcaccaccagcggcatcggcagctctgtggagaagtatgtggtggatgaaagtgactacatgtccttcatcaacaaccccagcctgactgtgacagtgcccatcgctgtgggggagagtgactttgagaacctgaacacagaggagttcagcagcgagagtgacatggaggagagcaaggagaagctgaatgccaccagcagcagcgagggcagcacagtggacatcggggccccagctgagggggagcagcctgaggtggagcctgaggagagcctggagcctgaggcctgcttcacagaggactgtgtgaggaagttcaagtgctgccagatcagcattgaggagggcaagggcaagctgtggtggaacctgaggaagacctgctacaagatcgtggagcacaactggtttgagaccttcatcgtgttcatgatcctgctgagcagcggggccctggcctttgaggacatctacatcgagcagaggaagaccatcaagaccatgctggagtatgctgacaaggtgttcacctacatcttcatcctggagatgctgctgaagtgggtggcctacggcttccaggtgtacttcaccaatgcctggtgctggctggacttcctgattgtggatgtgtccctggtgtccctgacagccaatgccctgggctacagcgagctgggcgccatcaagagcctgcggaccctgcgggccctgcggcccctgcgggccctgagcagatttgagggcatgagggtggtggtgaatgccctgctgggcgccatccccagcatcatgaatgtgctgctggtgtgcctgatcttctggctgatcttcagcatcatgggcgtgaacctgtttgctgggaagttctaccactgcatcaactacaccactggagagatgtttgatgtgtctgtggtgaacaactacagcgagtgcaaggccctgattgagagcaaccagacagcccgctggaagaatgtgaaggtgaactttgacaacgtgggcctgggctacctgagcctgctgcaggtggccaccttcaagggctggatggacatcatgtatgctgctgtggacagcagaaatgtggagctgcagcccaagtatgaggacaacctgtacatgtacctgtactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatccccaggcctgccaacaagttccagggcatggtgtttgattttgtgaccaagcaggtgtttgacatcagcatcatgatcctgatctgcctgaacatggtgaccatgatggtggagacagatgaccagagccaggagatgaccaacatcctgtactggatcaacctggtgttcatcgtgctcttcaccggagaatgtgtgctgaagctgatcagcctgcgctactactacttcaccatcggctggaacatctttgattttgtggtggtgatcctgagcatcgtgggcatgttcctggccgagctgattgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagcgggaggtgggcattgatgacatgttcaactttgagaccttcggcaacagcatgatctgcctcttccagatcaccaccagcgctggctgggatggcctgctggcccccatcctgaacagcggccccccagactgtgaccctgacaaggaccaccctggcagctctgtgaagggggactgtggcaaccccagcgtgggcatcttcttctttgtgtcctacatcatcatctccttcctggtggtggtgaacatgtacatcgctgtgatcctggagaacttctctgtggccacagaggagagcgctgagcccctgtctgaagatgactttgagatgttttatgaggtgtgggagaagtttgatcctgatgccacccagttcattgaatttgccaagctgagtgactttgctgatgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggatgccctgcgcatccagatggaggagcgcttcatggccagcaaccccagcaaggtgtcctatgagcccatcaccaccaccctgaagaggaagcaggaggaggtgtctgccatcatcatccagagggcctaccgccgctacctgctgaagcagaaggtgaagaaggtgagcagcatctacaagaaggacaagggcaaggaatgtgatggcacccccatcaaggaggacaccctgattgacaagctgaatgaaaacagcaccccagagaagacagacatgacccccagcaccaccagcccccccagctatgattctgtgaccaagccagagaaggagaagtttgagaaggacaagtctgagaaggaggacaagggcaaggacatccgggagagcaagaagtag

SEQ ID NO: 170084 - DNA, 6018 bp, Artificial Sequence
  Description of Artificial Sequence: Synthetic coding sequence
atggcccagagcgtgctggtgcccccaggccctgacagcttccgcttcttcacccgggagagcctggccgccatcgagcagagaattgctgaggagaaggccaagaggcccaagcaggagaggaaggatgaagatgatgaaaatggccccaagcccaacagcgacctggaggccggcaagagcctgcccttcatctacggggacatccccccagagatggtgtctgtgcccctggaggacctggacccctactacatcaacaagaagaccttcatcgtgctgaacaagggcaaggccatcagccgcttcagcgccaccccagccctgtacatcctgacccccttcaaccccatcaggaagctggccatcaagatcctggtgcacagcctcttcaacatgctgatcatgtgcaccatcctgaccaactgtgtgttcatgaccatgagcaaccccccagactggaccaagaatgtggagtacaccttcaccggcatctacacctttgagagcctcatcaagatcctggcccggggcttctgcctggaggacttcaccttcctgcgggacccctggaactggctggacttcaccgtcatcacctttgcctacgtgacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgaggaacaagtgcctgcagtggcccccagacaacagcagctttgagatcaacatcaccagcttcttcaacaacagcctggatggaaatggcaccaccttcaacagaacagtgtccatcttcaactgggatgagtacatcgaggacaagagccacttctacttcctggagggccagaatgatgccctgctgtgtggcaacagcagtgatgctggccagtgcccagagggctacatctgtgtgaaggccggcaggaaccccaactacggctacaccagctttgacaccttctcctgggccttcctgagcctcttccggctgatgacccaggacttctgggagaacctgtaccagctgaccctgcgggctgctgggaagacctacatgatcttctttgtgctggtgatcttcctgggcagcttctacctgatcaacctgatcctggccgtggtggccatggcctatgaggagcagaaccaggccaccctggaggaggccgagcagaaggaggccgagttccagcagatgctggagcagctgaagaagcagcaggaggaggcccaggccgctgctgctgctgccagcgctgagagccgggacttctctggagctgggggcatcggggtcttcagcgagagcagctctgtggccagcaagctgagcagcaagtctgagaaggagctgaagaacagaaggaagaagaagaagcagaaggagcagagcggggaggaggagaagaatgacagagtgaggaagtctgagagtgaagattccatccggaggaagggcttccgcttcagcctggagggcagccggctgacctatgagaagcgcttcagcagcccccaccagagcctgctgagcatccggggcagcctcttcagccccaggaggaacagccgggccagcctcttctccttccggggccgggccaaggacatcggctctgaaaatgactttgctgatgatgagcacagcacctttgaggacaatgacagcagaagagacagcctgtttgtgccccacagacatggagagcggcggcacagcaatgtgtcccaggccagccgggccagccgggtgctgcccatcctgcccatgaatggcaagatgcacagcgctgtggactgcaatggagtggtgtccctggtgggcggccccagcaccctgaccagcgctggccagctgctgcctgagggcaccaccacagaaacagagatcaggaagagaagaagcagcagctaccacgtgtccatggacctgctggaggaccccaccagccggcagagggccatgagcatcgccagcatcctgaccaacaccatggaggagctggaggagagccggcagaagtgccccccctgctggtacaagtttgccaacatgtgcctgatctgggactgctgcaagccctggctgaaggtgaagcacctggtgaacctggtggtgatggacccctttgtggacctggccatcaccatctgcatcgtgctgaacaccctcttcatggccatggagcactaccccatgacagagcagttcagctctgtgctgtctgtgggcaacctggtgttcaccggcatcttcaccgctgagatgttcctgaagatcatcgccatggacccctactactacttccaggagggctggaacatctttgatggcttcatcgtgtccctgagcctgatggagctgggcctggccaacgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcagcaatgactgtgagctgccccgctggcacatgcatgacttcttccacagcttcctgattgtgttccgggtgctgtgtggggagtggattgagaccatgtgggactgcatggaggtggccggccagaccatgtgcctgactgtgttcatgatggtgatggtgattggcaacctggtggtgctgaacctcttcctggccctgctgctgagcagcttcagcagtgacaacctggccgccacagatgatgacaatgagatgaacaacctgcagattgctgtgggccgcatgcagaagggcatcgactttgtgaagaggaagatccgggagttcatccagaaggcctttgtgaggaagcagaaggccctggatgagatcaagcccctggaggacctgaacaacaagaaggacagctgcatcagcaaccacaccaccattgaaattggcaaggacctgaactacctgaaggatggaaatggcaccaccagcggcatcggcagctctgtggagaagtatgtggtggatgaaagtgactacatgtccttcatcaacaaccccagcctgactgtgacagtgcccatcgctgtgggggagagtgactttgagaacctgaacacagaggagttcagcagcgagagtgacatggaggagagcaaggagaagctgaatgccaccagcagcagcgagggcagcacagtggacatcggggccccagctgagggggagcagcctgaggtggagcctgaggagagcctggagcctgaggcctgcttcacagaggactgtgtgaggaagttcaagtgctgccagatcagcattgaggagggcaagggcaagctgtggtggaacctgaggaagacctgctacaagatcgtggagcacaactggtttgagaccttcatcgtgttcatgatcctgctgagcagcggggccctggcctttgaggacatctacatcgagcagaggaagaccatcaagaccatgctggagtatgctgacaaggtgttcacctacatcttcatcctggagatgctgctgaagtgggtggcctacggcttccaggtgtacttcaccaatgcctggtgctggctggacttcctgattgtggatgtgtccctggtgtccctgacagccaatgccctgggctacagcgagctgggcgccatcaagagcctgcggaccctgcgggccctgcggcccctgcgggccctgagcagatttgagggcatgagggtggtggtgaatgccctgctgggcgccatccccagcatcatgaatgtgctgctggtgtgcctgatcttctggctgatcttcagcatcatgggcgtgaacctgtttgctgggaagttctaccactgcatcaactacaccactggagagatgtttgatgtgtctgtggtgaacaactacagcgagtgcaaggccctgattgagagcaaccagacagcccgctggaagaatgtgaaggtgaactttgacaacgtgggcctgggctacctgagcctgctgcaggtggccaccttcaagggctggatggacatcatgtatgctgctgtggacagcagaaatgtggagctgcagcccaagtatgaggacaacctgtacatgtacctgtactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatccccaggcctgccaacaagttccagggcatggtgtttgattttgtgaccaagcaggtgtttgacatcagcatcatgatcctgatctgcctgaacatggtgaccatgatggtggagacagatgaccagagccaggagatgaccaacatcctgtactggatcaacctggtgttcatcgtgctcttcaccggagaatgtgtgctgaagctgatcagcctgcgctactactacttcaccatcggctggaacatctttgattttgtggtggtgatcctgagcatcgtgggcatgttcctggccgagctgattgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagcgggaggtgggcattgatgacatgttcaactttgagaccttcggcaacagcatgatctgcctcttccagatcaccaccagcgctggctgggatggcctgctggcccccatcctgaacagcggccccccagactgtgaccctgacaaggaccaccctggcagctctgtgaagggggactgtggcaaccccagcgtgggcatcttcttctttgtgtcctacatcatcatctccttcctggtggtggtgaacatgtacatcgctgtgatcctggagaacttctctgtggccacagaggagagcgctgagcccctgtctgaagatgactttgagatgttttatgaggtgtgggagaagtttgatcctgatgccacccagttcattgaatttgccaagctgagtgactttgctgatgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggatgccctgcgcatccagatggaggagcgcttcatggccagcaaccccagcaaggtgtcctatgagcccatcaccaccaccctgaagaggaagcaggaggaggtgtctgccatcatcatccagagggcctaccgccgctacctgctgaagcagaaggtgaagaaggtgagcagcatctacaagaaggacaagggcaaggaatgtgatggcacccccatcaaggaggacaccctgattgacaagctgaatgaaaacagcaccccagagaagacagacatgacccccagcaccaccagcccccccagctatgattctgtgaccaagccagagaaggagaagtttgagaaggacaagtctgagaaggaggacaagggcaaggacatccgggagagcaagaagtag

SEQ ID NO: 170085 - DNA, 6018 bp, Artificial Sequence; identical to SEQ ID NO: 170084
  Description of Artificial Sequence: Synthetic coding sequence

SEQ ID NO: 170086 - DNA, 6018 bp, Artificial Sequence; identical to SEQ ID NO: 170083
  Description of Artificial Sequence: Synthetic coding sequence

SEQ ID NO: 170087 - DNA, 1512 bp, Artificial Sequence
  Description of Artificial Sequence: Synthetic coding sequence
atggcccagagcgtgctggtgcccccaggccctgacagcttccgcttcttcacccgggagagcctggccgccatcgagcagagaattgctgaggagaaggccaagaggcccaagcaggagaggaaggatgaagatgatgaaaatggccccaagcccaacagcgacctggaggccggcaagagcctgcccttcatctacggggacatccccccagagatggtgtctgtgcccctggaggacctggacccctactacatcaacaagaagaccttcatcgtgctgaacaagggcaaggccatcagccgcttcagcgccaccccagccctgtacatcctgacccccttcaaccccatcaggaagctggccatcaagatcctggtgcacagcctcttcaacatgctgatcatgtgcaccatcctgaccaactgtgtgttcatgaccatgagcaaccccccagactggaccaagaatgtggagtacaccttcaccggcatctacacctttgagagcctcatcaagatcctggcccggggcttctgcctggaggacttcaccttcctgcgggacccctggaactggctggacttcaccgtcatcacctttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgaggaacaagtgcctgcagtggcccccagacaacagcagctttgagatcaacatcaccagcttcttcaacaacagcctggatggaaatggcaccaccttcaacagaacagtgtccatcttcaactgggatgagtacatcgaggacaagagccacttctacttcctggagggccagaatgatgccctgctgtgtggcaacagcagtgatgctggccagtgcccagagggctacatctgtgtgaaggccggcaggaaccccaactacggctacaccagctttgacaccttctcctgggccttcctgagcctcttccggctgatgacccaggacttctgggagaacctgtaccagctgaccctgcgggctgctgggaagacctacatgatcttctttgtgctggtgatcttcctgggcagcttctacctgatcaacctgatcctggccgtggtggccatggcctatgaggagcagaaccaggccaccctggaggaggccgagcagaaggaggccgagttccagcagatgctggagcagctgaagaagcagcaggaggaggcccaggccgctgctgctgctgccagcgctgagagccgggacttctctggagctgggggcatcggggtcttcagcgagagcagctctgtggccagcaagctgagcagcaagtctgagaaggagctgaagaactag

SEQ ID NO: 170088 - DNA, 648 bp, Artificial Sequence
  Description of Artificial Sequence: Synthetic coding sequence
atgcacagagatgcctggctgcccaggcctgccttcagcctgaccggcctgagcctcttcttcagcctggtgcccccaggccgctccatggaggtgacagtgcctgccaccctgaatgtgctgaatggaagtgatgcccggctgccctgcaccttcaacagctgctacacagtgaaccacaagcagttcagcctgaactggacctaccaggagtgcaacaactgcagcgaggagatgttcctgcagttcaggatgaagatcatcaacctgaagctggagcgcttccaggacagagtggagttcagcggcaaccccagcaaatatgatgtgtctgtgatgctgagaaatgtgcagccagaagatgagggcatctacaactgctacatcatgaaccccccagacagacaccggggccacggcaagatccacctgcaggtgctgatggaggagcccccagagcgggacagcacagtggccgtgattgtgggcgcctctgtgggcggcttcctggccgtggtgatcctggtgctgatggtggtgaagtgtgtgcggaggaagaaggagcagaagctgagcacagatgacctgaagacagaggaggagggcaagacagatggagagggcaacccagatgatggagccaagtag

SEQ ID NO: 170089 - DNA, 6003 bp, Artificial Sequence
  Description of Artificial Sequence: Synthetic coding sequence
atggcccaggccctgctggtgcccccaggccctgagagcttccgcctcttcacccgggagagcctggccgccatcgagaagagagctgctgaggagaaggccaagaagcccaagaaggagcaggacaatgatgatgagaacaagcccaagcccaacagcgacctggaggccggcaagaacctgcccttcatctatggagacatccccccagagatggtgtctgagcccctggaggacctggacccctactacatcaacaagaagaccttcatcgtgatgaacaagggcaaggccatcttccgcttcagcgccaccagcgccctgtacatcctgacccccctgaaccctgtgaggaagatcgccatcaagatcctggtgcacagcctcttctccatgctgatcatgtgcaccatcctgaccaactgtgtgttcatgaccctgagcaaccccccagactggaccaagaatgtggagtacaccttcaccggcatctacacctttgagagcctcatcaagatcctggcccggggcttctgcctggaggacttcaccttcctgcgggacccctggaactggctggacttcagcgtcatcgtgatggcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcctgcagtggcccccaagtgacagcgcctttgagaccaacaccaccagctacttcaacggcaccatggacagcaatggcacctttgtgaatgtgaccatgagcaccttcaactggaaggactacatcggagatgacagccacttctacgtgctggatggccagaaggaccccctgctgtgtggaaatggaagtgatgctggccagtgcccagagggctacatctgtgtgaaggccggcaggaaccccaactacggctacaccagctttgacaccttctcctgggccttcctgagcctcttccggctgatgacccaggactactgggagaacctgtaccagctgaccctgcgggccgccggcaagacctacatgatcttctttgtgctggtgatcttcctgggcagcttctacctggtgaacctgatcctggccgtggtggccatggcctatgaggagcagaaccaggccaccctggaggaggccgagcagaaggaggccgagttccagcagatgctggagcagctgaagaagcagcaggaggaggcccaggccgtggccgccgccagcgctgccagccgggacttctctggaattggaggcctgggggagctgctggagagcagcagcgaggccagcaagctgagcagcaagagcgccaaggagtggaggaacagaaggaagaagaggcggcagcgggagcacctggagggcaacaacaagggggagcgggacagcttccccaagtctgagagtgaagattctgtgaagaggagcagcttcctgttctccatggatggcaaccggctgaccagtgacaagaagttctgcagcccccaccagagcctgctgagcatccggggcagcctcttcagccccaggaggaacagcaagaccagcatcttctccttccggggccgggccaaggatgtgggctctgaaaatgactttgctgatgatgagcacagcacctttgaggacagcgagagcagaagagacagcctgtttgtgccccacagacatggagagaggaggaacagcaatgtgtcccaggcctccatgagcagcaggatggtgcccggcctgcctgccaacgggaagatgcacagcacagtggactgcaatggagtggtgtccctggtgggcggccccagcgccctgaccagccccaccggccagctgcccccagagggcaccaccacagaaacagaggtgaggaagaggcggctgagcagctaccagatctccatggagatgctggaggacagcagcggccggcagagagctgtgtccatcgccagcatcctgaccaacaccatggaggagctggaggagagccggcagaagtgccccccctgctggtacagatttgccaacgtgttcctgatctgggactgctgtgatgcctggctgaaggtgaagcacctggtgaacctgattgtgatggacccctttgtggacctggccatcaccatctgcatcgtgctgaacaccctcttcatggccatggagcactaccccatgacagagcagttcagctctgtgctgactgtgggcaacctggtgttcaccggcatcttcaccgctgagatggtgctgaagatcatcgccatggacccctactactacttccaggagggctggaacatctttgatggcatcatcgtgtccctgagcctgatggagctgggcctgagcaatgtggagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccagaccatgtgcctgattgtgttcatgctggtgatggtgattggcaacctggtggtgctgaacctcttcctggccctgctgctgagcagcttcagcagtgacaacctggccgccacagatgatgacaatgagatgaacaacctgcagattgctgtgggccgcatgcagaagggcattgattatgtgaagaacaagatgagggagtgcttccagaaggccttcttcaggaagcccaaggtgattgagatccacgagggcaacaagattgacagctgcatgagcaacaacacaggaattgagatcagcaaggagctgaactacctgagagatggaaatggcaccaccagcggcgtgggcaccggcagctctgtggagaagtatgtgattgatgaaaatgactacatgtccttcatcaacaaccccagcctgactgtgacagtgcccatcgctgtgggggagagtgactttgagaacctgaacacagaggagttcagcagcgagagcgagctggaggagagcaaggagaagctgaatgccaccagcagcagcgagggcagcacagtggatgtggtgctgccccgggagggggagcaggccgagacagagcctgaggaggacctgaagccagaggcctgcttcacagagggctgcatcaagaagttccccttctgccaggtgtccacagaggagggcaagggcaagatctggtggaacctgaggaagacctgctacagcatcgtggagcacaactggtttgagaccttcatcgtgttcatgatcctgctgagcagcggggccctggcctttgaggacatctacatcgagcagaggaagaccatcaagaccatgctggagtatgctgacaaggtgttcacctacatcttcatcctggagatgctgctgaagtgggtggcctacggcttccagacctacttcaccaatgcctggtgctggctggacttcctgattgtggatgtgtccctggtgtccctggtggccaatgccctgggctacagcgagctgggcgccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagttctaccactgtgtgaacatgaccactggaaacatgtttgacatcagtgatgtgaacaacctgagtgactgccaggccctgggcaagcaggcccgctggaagaatgtgaaggtgaactttgacaacgtgggcgccggctacctggccctgctgcaggtggccaccttcaagggctggatggacatcatgtatgctgctgtggacagcagagatgtgaagctgcagcctgtgtatgaggagaacctgtacatgtacctgtacttcgtcatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatccccaggcctgccaacaagttccagggcatggtgtttgattttgtgacccggcaggtgtttgacatcagcatcatgatcctgatctgcctgaacatggtgaccatgatggtggagacagatgaccagggcaagtacatgaccctggtgctgagccgcatcaacctggtgttcatcgtgctcttcaccggggagtttgtgctgaagctggtgtccctgcggcactactacttcaccatcggctggaacatctttgattttgtggtggtgatcctgagcatcgtgggcatgttcctggccgagatgattgagaagtactttgtgagccccaccctcttccgggtcatccggctggcccgcatcggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggccggcattgatgacatgttcaactttgagacctttggaaacagcatgatctgcctcttccagatcaccaccagcgctggctgggatggcctgctggcccccatcctgaacagcgcccccccagactgtgaccctgacaccatccaccctggcagctctgtgaagggggactgtggcaaccccagcgtgggcatcttcttctttgtgtcctacatcatcatctccttcctggtggtggtgaacatgtacatcgccgtcatcctggagaacttctctgtggccacagaggagagcgctgagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggatgccctgcgcatccagatggaggaccgcttcatggccagcaaccccagcaaggtgtcctatgagcccatcaccaccaccctgaagaggaagcaggaggaggtgtctgctgccatcatccagaggaacttccgctgctacctgctgaagcagaggctgaagaacatcagcagcaactacaacaaggaggccatcaagggcagaattgacctgcccatcaagcaggacatgatcatcgacaagctgaatggaaacagcaccccagagaagacagatggcagcagcagcaccaccagccccccatcctatgacagcgtgaccaagccagacaaggagaagtttgagaaggacaagccagagaaggagagcaagggcaaggaggtgcgggagaaccagaagtag

SEQ ID NO: 170090 - DNA, 6003 bp, Artificial Sequence
  Description of Artificial Sequence: Synthetic coding sequence
atggcccaggccctgctggtgcccccaggccctgagagcttccgcctcttcacccgggagagcctggccgccatcgagaagagagctgctgaggagaaggccaagaagcccaagaaggagcaggacaatgatgatgagaacaagcccaagcccaacagcgacctggaggccggcaagaacctgcccttcatctatggagacatccccccagagatggtgtctgagcccctggaggacctggacccctactacatcaacaagaagaccttcatcgtgatgaacaagggcaaggccatcttccgcttcagcgccaccagcgccctgtacatcctgacccccctgaaccctgtgaggaagatcgccatcaagatcctggtgcacagcctcttctccatgctgatcatgtgcaccatcctgaccaactgtgtgttcatgaccctgagcaaccccccagactggaccaagaatgtggagtacaccttcaccggcatctacacctttgagagcctcatcaagatcctggcccggggcttctgcctggaggacttcaccttcctgcgggacccctggaactggctggacttcagcgtcatcgtgatggcctacgtgacagaatttgtgtccctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcctgcagtggcccccaagtgacagcgcctttgagaccaacaccaccagctacttcaacggcaccatggacagcaatggcacctttgtgaatgtgaccatgagcaccttcaactggaaggactacatcggagatgacagccacttctacgtgctggatggccagaaggaccccctgctgtgtggaaatggaagtgatgctggccagtgcccagagggctacatctgtgtgaaggccggcaggaaccccaactacggctacaccagctttgacaccttctcctgggccttcctgagcctcttccggctgatgacccaggactactgggagaacctgtaccagctgaccctgcgggccgccggcaagacctacatgatcttctttgtgctggtgatcttcctgggcagcttctacctggtgaacctgatcctggccgtggtggccatggcctatgaggagcagaaccaggccaccctggaggaggccgagcagaaggaggccgagttccagcagatgctggagcagctgaagaagcagcaggaggaggcccaggccgtggccgccgccagcgctgccagccgggacttctctggaattggaggcctgggggagctgctggagagcagcagcgaggccagcaagctgagcagcaagagcgccaaggagtggaggaacagaaggaagaagaggcggcagcgggagcacctggagggcaacaacaagggggagcgggacagcttccccaagtctgagagtgaagattctgtgaagaggagcagcttcctgttctccatggatggcaaccggctgaccagtgacaagaagttctgcagcccccaccagagcctgctgagcatccggggcagcctcttcagccccaggaggaacagcaagaccagcatcttctccttccggggccgggccaaggatgtgggctctgaaaatgactttgctgatgatgagcacagcacctttgaggacagcgagagcagaagagacagcctgtttgtgccccacagacatggagagaggaggaacagcaatgtgtcccaggcctccatgagcagcaggatggtgcccggcctgcctgccaacgggaagatgcacagcacagtggactgcaatggagtggtgtccctggtgggcggccccagcgccctgaccagccccaccggccagctgcccccagagggcaccaccacagaaacagaggtgaggaagaggcggctgagcagctaccagatctccatggagatgctggaggacagcagcggccggcagagagctgtgtccatcgccagcatcctgaccaacaccatggaggagctggaggagagccggcagaagtgccccccctgctggtacagatttgccaacgtgttcctgatctgggactgctgtgatgcctggctgaaggtgaagcacctggtgaacctgattgtgatggacccctttgtggacctggccatcaccatctgcatcgtgctgaacaccctcttcatggccatggagcactaccccatgacagagcagttcagctctgtgctgactgtgggcaacctggtgttcaccggcatcttcaccgctgagatggtgctgaagatcatcgccatggacccctactactacttccaggagggctggaacatctttgatggcatcatcgtgtccctgagcctgatggagctgggcctgagcaatgtggagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccagaccatgtgcctgattgtgttcatgctggtgatggtgattggcaacctggtggtgctgaacctcttcctggccctgctgctgagcagcttcagcagtgacaacctggccgccacagatgatgacaatgagatgaacaacctgcagattgctgtgggccgcatgcagaagggcattgattatgtgaagaacaagatgagggagtgcttccagaaggccttcttcaggaagcccaaggtgattgagatccacgagggcaacaagattgacagctgcatgagcaacaacacaggaattgagatcagcaaggagctgaactacctgagagatggaaatggcaccaccagcggcgtgggcaccggcagctctgtggagaagtatgtgattgatgaaaatgactacatgtccttcatcaacaaccccagcctgactgtgacagtgcccatcgctgtgggggagagtgactttgagaacctgaacacagaggagttcagcagcgagagcgagctggaggagagcaaggagaagctgaatgccaccagcagcagcgagggcagcacagtggatgtggtgctgccccgggagggggagcaggccgagacagagcctgaggaggacctgaagccagaggcctgcttcacagagggctgcatcaagaagttccccttctgccaggtgtccacagaggagggcaagggcaagatctggtggaacctgaggaagacctgctacagcatcgtggagcacaactggtttgagaccttcatcgtgttcatgatcctgctgagcagcggggccctggcctttgaggacatctacatcgagcagaggaagaccatcaagaccatgctggagtatgctgacaaggtgttcacctacatcttcatcctggagatgctgctgaagtgggtggcctacggcttccagacctacttcaccaatgcctggtgctggctggacttcctgattgtggatgtgtccctggtgtccctggtggccaatgccctgggctacagcgagctgggcgccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagttctaccactgtgtgaacatgaccactggaaacatgtttgacatcagtgatgtgaacaacctgagtgactgccaggccctgggcaagcaggcccgctggaagaatgtgaaggtgaactttgacaacgtgggcgccggctacctggccctgctgcaggtggccaccttcaagggctggatggacatcatgtatgctgctgtggacagcagagatgtgaagctgcagcctgtgtatgaggagaacctgtacatgtacctgtacttcgtcatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatccccaggcctgccaacaagttccagggcatggtgtttgattttgtgacccggcaggtgtttgacatcagcatcatgatcctgatctgcctgaacatggtgaccatgatggtggagacagatgaccagggcaagtacatgaccctggtgctgagccgcatcaacctggtgttcatcgtgctcttcaccggggagtttgtgctgaagctggtgtccctgcggcactactacttcaccatcggctggaacatctttgattttgtggtggtgatcctgagcatcgtgggcatgttcctggccgagatgattgagaagtactttgtgagccccaccctcttccgggtcatccggctggcccgcatcggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggccggcattgatgacatgttcaactttgagacctttggaaacagcatgatctgcctcttccagatcaccaccagcgctggctgggatggcctgctggcccccatcctgaacagcgcccccccagactgtgaccctgacaccatccaccctggcagctctgtgaagggggactgtggcaaccccagcgtgggcatcttcttctttgtgtcctacatcatcatctccttcctggtggtggtgaacatgtacatcgccgtcatcctggagaacttctctgtggccacagaggagagcgctgagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggatgccctgcgcatccagatggaggaccgcttcatggccagcaaccccagcaaggtgtcctatgagcccatcaccaccaccctgaagaggaagcaggaggaggtgtctgctgccatcatccagaggaacttccgctgctacctgctgaagcagaggctgaagaacatcagcagcaactacaacaaggaggccatcaagggcagaattgacctgcccatcaagcaggacatgatcatcgacaagctgaatggaaacagcaccccagagaagacagatggcagcagcagcaccaccagccccccatcctatgacagcgtgaccaagccagacaaggagaagtttgagaaggacaagccagagaaggagagcaagggcaaggaggtgcgggagaaccagaagtag

SEQ ID NO: 170091 - DNA, 5856 bp, Artificial Sequence
  Description of Artificial Sequence: Synthetic coding sequence
atggcccaggccctgctggtgcccccaggccctgagagcttccgcctcttcacccgggagagcctggccgccatcgagaagagagctgctgaggagaaggccaagaagcccaagaaggagcaggacaatgatgatgagaacaagcccaagcccaacagcgacctggaggccggcaagaacctgcccttcatctatggagacatccccccagagatggtgtctgagcccctggaggacctggacccctactacatcaacaagaagaccttcatcgtgatgaacaagggcaaggccatcttccgcttcagcgccaccagcgccctgtacatcctgacccccctgaaccctgtgaggaagatcgccatcaagatcctggtgcacagcctcttctccatgctgatcatgtgcaccatcctgaccaactgtgtgttcatgaccctgagcaaccccccagactggaccaagaatgtggagtacaccttcaccggcatctacacctttgagagcctcatcaagatcctggcccggggcttctgcctggaggacttcaccttcctgcgggacccctggaactggctggacttcagcgtcatcgtgatggcctacgtgacagaatttgtgtccctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcctgcagtggcccccaagtgacagcgcctttgagaccaacaccaccagctacttcaacggcaccatggacagcaatggcacctttgtgaatgtgaccatgagcaccttcaactggaaggactacatcggagatgacagccacttctacgtgctggatggccagaaggaccccctgctgtgtggaaatggaagtgatgctggccagtgcccagagggctacatctgtgtgaaggccggcaggaaccccaactacggctacaccagctttgacaccttctcctgggccttcctgagcctcttccggctgatgacccaggactactgggagaacctgtaccagctgaccctgcgggccgccggcaagacctacatgatcttctttgtgctggtgatcttcctgggcagcttctacctggtgaacctgatcctggccgtggtggccatggcctatgaggagcagaaccaggccaccctggaggaggccgagcagaaggaggccgagttccagcagatgctggagcagctgaagaagcagcaggaggaggcccaggccgtggccgccgccagcgctgccagccgggacttctctggaattggaggcctgggggagctgctggagagcagcagcgaggccagcaagctgagcagcaagagcgccaaggagtggaggaacagaaggaagaagaggcggcagcgggagcacctggagggcaacaacaagggggagcgggacagcttccccaagtctgagagtgaagattctgtgaagaggagcagcttcctgttctccatggatggcaaccggctgaccagtgacaagaagttctgcagcccccaccagagcctgctgagcatccggggcagcctcttcagccccaggaggaacagcaagaccagcatcttctccttccggggccgggccaaggatgtgggctctgaaaatgactttgctgatgatgagcacagcacctttgaggacagcgagagcagaagagacagcctgtttgtgccccacagacatggagagaggaggaacagcaatggcaccaccacagaaacagaggtgaggaagaggcggctgagcagctaccagatctccatggagatgctggaggacagcagcggccggcagagagctgtgtccatcgccagcatcctgaccaacaccatggaggagctggaggagagccggcagaagtgccccccctgctggtacagatttgccaacgtgttcctgatctgggactgctgtgatgcctggctgaaggtgaagcacctggtgaacctgattgtgatggacccctttgtggacctggccatcaccatctgcatcgtgctgaacaccctcttcatggccatggagcactaccccatgacagagcagttcagctctgtgctgactgtgggcaacctggtgttcaccggcatcttcaccgctgagatggtgctgaagatcatcgccatggacccctactactacttccaggagggctggaacatctttgatggcatcatcgtgtccctgagcctgatggagctgggcctgagcaatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccagaccatgtgcctgattgtgttcatgctggtgatggtgattggcaacctggtggtgctgaacctcttcctggccctgctgctgagcagcttcagcagtgacaacctggccgccacagatgatgacaatgagatgaacaacctgcagattgctgtgggccgcatgcagaagggcatcgactatgtgaagaacaagatgagggagtgcttccagaaggccttcttcaggaagcccaaggtgattgagatccacgagggcaacaagattgacagctgcatgagcaacaacacaggcatcgagatcagcaaggagctgaactacctgagagatggaaatggcaccaccagcggcgtgggcaccggcagctctgtggagaagtatgtgattgatgaaaatgactacatgtccttcatcaacaaccccagcctgactgtgacagtgcccatcgctgtgggggagagtgactttgagaacctgaacacagaggagttcagcagcgagagcgagctggaggagagcaaggagaagctgaatgccaccagcagcagcgagggcagcacagtggatgtggtgctgccccgggagggggagcaggccgagacagagcctgaggaggacctgaagccagaggcctgcttcacagagggctgcatcaagaagttccccttctgccaggtgtccacagaggagggcaagggcaagatctggtggaacctgaggaagacctgctacagcatcgtggagcacaactggtttgagaccttcatcgtgttcatgatcctgctgagcagcggggccctggcctttgaggacatctacatcgagcagaggaagaccatcaagaccatgctggagtatgctgacaaggtgttcacctacatcttcatcctggagatgctgctgaagtgggtggcctacggcttccagacctacttcaccaatgcctggtgctggctggacttcctgattgtggatgtgtccctggtgtccctggtggccaatgccctgggctacagcgagctgggcgccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagttctaccactgtgtgaacatgaccaccggcaacatgtttgacatcagtgatgtgaacaacctgagtgactgccaggccctgggcaagcaggcccgctggaagaatgtgaaggtgaactttgacaacgtgggcgccggctacctggccctgctgcaggtggccaccttcaagggctggatggacatcatgtatgctgctgtggacagcagagatgtgaagctgcagcctgtgtatgaagaaaatctctacatgtacctgtactttgtgatcttcatcatcttcggcagcttcttcaccctgaacctcttcatcggggtcatcatcgacaacttcaaccagcagaagaagaagtttggaggccaggacatcttcatgacagaggagcagaagaagtactacaatgccatgaagaagctgggcagcaagaagccccagaagcccatccccaggcctgccaacaagttccagggcatggtgtttgattttgtgacccggcaggtgtttgacatcagcatcatgatcctgatctgcctgaacatggtgaccatgatggtggagacagatgaccagggcaagtacatgaccctggtgctgagccgcatcaacctggtgttcatcgtgctcttcaccggggagtttgtgctgaagctggtgtccctgcggcactactacttcaccatcggctggaacatctttgattttgtggtggtgatcctgagcatcgtgggcatgttcctggccgagatgattgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggccggcattgatgacatgttcaactttgagaccttcggcaacagcatgatctgcctcttccagatcaccaccagcgctggctgggatggcctgctggcccccatcctgaacagcgcccccccagactgtgaccctgacaccatccaccctggcagctctgtgaagggggactgtggcaaccccagcgtgggcatcttcttctttgtgtcctacatcatcatctccttcctggtggtggtgaacatgtacatcgctgtgatcctggagaacttctctgtggccacagaggagagcgctgagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggatgccctgcgcatccagatggaggaccgcttcatggccagcaaccccagcaaggtgtcctatgagcccatcaccaccaccctgaagaggaagcaggaggaggtgtctgctgccatcatccagaggaacttccgctgctacctgctgaagcagaggctgaagaacatcagcagcaactacaacaaggaggccatcaagggcagaattgacctgcccatcaagcaggacatgatcatcgacaagctgaatggaaacagcaccccagagaagacagatggcagcagcagcaccaccagcccccccagctatgattctgtgaccaagccagacaaggagaagtttgagaaggacaagccagagaaggagagcaagggcaaggaggtgcgggagaaccagaagtag

SEQ ID NO: 170092 - DNA, 4095 bp, Artificial Sequence
  Description of Artificial Sequence: Synthetic coding sequence
atggcccaggccctgctggtgcccccaggccctgagagcttccgcctcttcacccgggagagcctggccgccatcgagaagagagctgctgaggagaaggccaagaagcccaagaaggagcaggacaatgatgatgagaacaagcccaagcccaacagcgacctggaggccggcaagaacctgcccttcatctatggagacatccccccagagatggtgtctgagcccctggaggacctggacccctactacatcaacaagaagaccttcatcgtgatgaacaagggcaaggccatcttccgcttcagcgccaccagcgccctgtacatcctgacccccctgaaccctgtgaggaagatcgccatcaagatcctggtgcacagcctcttctccatgctgatcatgtgcaccatcctgaccaactgtgtgttcatgaccctgagcaaccccccagactggaccaagaatgtggagtacaccttcaccggcatctacacctttgagagcctcatcaagatcctggcccggggcttctgcctggaggacttcaccttcctgcgggacccctggaactggctggacttcagcgtcatcgtgatggcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaggaacaagtgcctgcagtggcccccaagtgacagcgcctttgagaccaacaccaccagctacttcaacggcaccatggacagcaatggcacctttgtgaatgtgaccatgagcaccttcaactggaaggactacatcggagatgacagccacttctacgtgctggatggccagaaggaccccctgctgtgtggaaatggaagtgatgctggccagtgcccagagggctacatctgtgtgaaggccggcaggaaccccaactacggctacaccagctttgacaccttctcctgggccttcctgagcctcttccggctgatgacccaggactactgggagaacctgtaccagctgaccctgcgggccgccggcaagacctacatgatcttctttgtgctggtgatcttcctgggcagcttctacctggtgaacctgatcctggccgtggtggccatggcctatgaggagcagaaccaggccaccctggaggaggccgagcagaaggaggccgagttccagcagatgctggagcagctgaagaagcagcaggaggaggcccaggccgtggccgccgccagcgctgccagccgggacttctctggaattggaggcctgggggagctgctggagagcagcagcgaggccagcaagctgagcagcaagagcgccaaggagtggaggaacagaaggaagaagaggcggcagcgggagcacctggagggcaacaacaagggggagcgggacagcttccccaagtctgagagtgaagattctgtgaagaggagcagcttcctgttctccatggatggcaaccggctgaccagtgacaagaagttctgcagcccccaccagagcctgctgagcatccggggcagcctcttcagccccaggaggaacagcaagaccagcatcttctccttccggggccgggccaaggatgtgggctctgaaaatgactttgctgatgatgagcacagcacctttgaggacagcgagagcagaagagacagcctgtttgtgccccacagacatggagagaggaggaacagcaatggcaccaccacagaaacagaggtgaggaagaggcggctgagcagctaccagatctccatggagatgctggaggacagcagcggccggcagagagctgtgtccatcgccagcatcctgaccaacaccatggaggagctggaggagagccggcagaagtgccccccctgctggtacagatttgccaacgtgttcctgatctgggactgctgtgatgcctggctgaaggtgaagcacctggtgaacctgattgtgatggacccctttgtggacctggccatcaccatctgcatcgtgctgaacaccctcttcatggccatggagcactaccccatgacagagcagttcagctctgtgctgactgtgggcaacctggtgttcaccggcatcttcaccgctgagatggtgctgaagatcatcgccatggacccctactactacttccaggagggctggaacatctttgatggcatcatcgtgtccctgagcctgatggagctgggcctgagcaatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccagaccatgtgcctgattgtgttcatgctggtgatggtgattggcaacctggtggtgctgaacctcttcctggccctgctgctgagcagcttcagcagtgacaacctggccgccacagatgatgacaatgagatgaacaacctgcagattgctgtgggccgcatgcagaagggcatcgactatgtgaagaacaagatgagggagtgcttccagaaggccttcttcaggaagcccaaggtgattgagatccacgagggcaacaagattgacagctgcatgagcaacaacacaggcatcgagatcagcaaggagctgaactacctgagagatggaaatggcaccaccagcggcgtgggcaccggcagctctgtggagaagtatgtgattgatgaaaatgactacatgtccttcatcaacaaccccagcctgactgtgacagtgcccatcgctgtgggggagagtgactttgagaacctgaacacagaggagttcagcagcgagagcgagctggaggagagcaaggagaagctgaatgccaccagcagcagcgagggcagcacagtggatgtggtgctgccccgggagggggagcaggccgagacagagcctgaggaggacctgaagccagaggcctgcttcacagagggctgcatcaagaagttccccttctgccaggtgtccacagaggagggcaagggcaagatctggtggaacctgaggaagacctgctacagcatcgtggagcacaactggtttgagaccttcatcgtgttcatgatcctgctgagcagcggggccctggcctttgaggacatctacatcgagcagaggaagaccatcaagaccatgctggagtatgctgacaaggtgttcacctacatcttcatcctggagatgctgctgaagtgggtggcctacggcttccagacctacttcaccaatgcctggtgctggctggacttcctgattgtggatgtgtccctggtgtccctggtggccaatgccctgggctacagcgagctgggcgccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagttctaccactgtgtgaacatgaccaccggcaacatgtttgacatcagtgatgtgaacaacctgagtgactgccaggccctgggcaagcaggcccgctggaagaatgtgaaggtgaactttgacaacgtgggcgccggctacctggccctgctgcaggtgtag

SEQ ID NO: 170093 - DNA, 603 bp, Artificial Sequence
  Description of Artificial Sequence: Synthetic coding sequence
atggcccaggccctgctggtgcccccaggccctgagagcttccgcctcttcacccgggagagcctggccgccatcgagaagagagctgctgaggagaaggccaagaagcccaagaaggagcaggacaatgatgatgagaacaagcccaagcccaacagcgacctggaggccggcaagaacctgcccttcatctatggagacatccccccagagatggtgtctgagcccctggaggacctggacccctactacatcaacaagaagaccttcatcgtgatgaacaagggcaaggccatcttccgcttcagcgccaccagcgccctgtacatcctgacccccctgaaccctgtgaggaagatcgccatcaagatcctggtgcacagcctcttctccatgctgatcatgtgcaccatcctgaccaactgtgtgttcatgaccctgagcaaccccccagactggaccaagaatgtggagtacaccttcaccggcatctacacctttgagagcctcatcaagatcctggcccggggcttctgcctggaggacttcaccttcctgcgggacccctggaactggctggacttcagcgtcatcgtgatgtag

SEQ ID NO: 170094 - DNA, 1452 bp, Artificial Sequence
  Description of Artificial Sequence: Synthetic coding sequence
atggtgtttgattttgtgacccggcaggtgtttgacatcagcatcatgatcctgatctgcctgaacatggtgaccatgatggtggagacagatgaccagggcaagtacatgaccctggtgctgagccgcatcaacctggtgttcatcgtgctcttcaccggggagtttgtgctgaagctggtgtccctgcggcactactacttcaccatcggctggaacatctttgattttgtggtggtgatcctgagcatcgtgggcatgttcctggccgagatgattgagaagtactttgtgagccccaccctcttccgggtcatccggctggccagaattggccgcatcctgcggctcatcaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggccggcattgatgacatgttcaactttgagaccttcggcaacagcatgatctgcctcttccagatcaccaccagcgctggctgggatggcctgctggcccccatcctgaacagcgcccccccagactgtgaccctgacaccatccaccctggcagctctgtgaagggggactgtggcaaccccagcgtgggcatcttcttctttgtgtcctacatcatcatctccttcctggtggtggtgaacatgtacatcgctgtgatcctggagaacttctctgtggccacagaggagagcgctgagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggatgccctgcgcatccagatggaggaccgcttcatggccagcaaccccagcaaggtgtcctatgagcccatcaccaccaccctgaagaggaagcaggaggaggtgtctgctgccatcatccagaggaacttccgctgctacctgctgaagcagaggctgaagaacatcagcagcaactacaacaaggaggccatcaagggcagaattgacctgcccatcaagcaggacatgatcatcgacaagctgaatggaaacagcaccccagagaagacagatggcagcagcagcaccaccagcccccccagctatgattctgtgaccaagccagacaaggagaagtttgagaaggacaagccagagaaggagagcaagggcaaggaggtgcgggagaaccagaagtag

SEQ ID NO: 170095 - DNA, 648 bp, Artificial Sequence
  Description of Artificial Sequence: Synthetic coding sequence
atgcctgccttcaacagactcttccccctggccagcctggtgctgatctactgggtgtctgtgtgcttccctgtgtgtgtggaggtgcccagcgagacagaagctgtgcagggcaaccccatgaagctgcgctgcatcagctgcatgaagcgggaggaggtggaggccaccaccgtggtggagtggttctacagacctgagggcggcaaggacttcctgatctatgagtacagaaatggccaccaggaggtggagagccccttccagggccgcctgcagtggaatggcagcaaggacctgcaggatgtgtccatcaccgtgctgaatgtgaccctgaatgattctggcctgtacacctgcaatgtgtcccgggagtttgaatttgaggcccaccggccctttgtgaagaccaccaggctcatccccctgcgggtgacagaggaggccggggaggacttcacctctgtggtgtctgagatcatgatgtacatcctgctggtgttcctgaccctgtggctgctgattgagatgatctactgctacaggaaggtgtccaaggccgaggaggccgcccaggagaatgccagtgactacctggccatccccagcgagaacaaggaaaattctgctgtgcctgtggaggagtag

SEQ ID NO: 170096 - DNA, 648 bp, Artificial Sequence; identical to SEQ ID NO: 170095
  Description of Artificial Sequence: Synthetic coding sequence

SEQ ID NO: 170097 - DNA, 426 bp, Artificial Sequence
  Description of Artificial Sequence: Synthetic coding sequence
atgcctgccttcaacagactcttccccctggccagcctggtgctgatctactgggtgtctgtgtgcttccctgtgtgtgtggaggtgcccagcgagacagaagctgtgcagggcaaccccatgaagctgcgctgcatcagctgcatgaagcgggaggaggtggaggccaccaccgtggtggagtggttctacagacctgagggcggcaaggacttcctgatctatgagtacagaaatggccaccaggaggtggagagccccttccagggccgcctgcagtggaatggcagcaaggacctgcaggatgtgtccatcaccgtgctgaatgtgaccctgaatgattctggcctgtacacctgcaatgtgtcccgggagtttgaatttgaggcccaccggccctttgtgaagaccaccaggctcatctag

SEQ ID NO: 170098 - DNA, 648 bp, Artificial Sequence; identical to SEQ ID NO: 170095
  Description of Artificial Sequence: Synthetic coding sequence

SEQ ID NO: 170099 - DNA, 5511 bp, Artificial Sequence
  Description of Artificial Sequence: Synthetic coding sequence
atggcccggcccagcctgtgcaccctggtgcccctgggcccagaatgtctgcggcccttcacccgggagagcctggccgccatcgagcagagagctgtggaggaggaggcccggctgcagaggaacaagcagatggagattgaggagcctgagaggaagcccaggagtgacctggaggccggcaagaacctgcccatgatctacggggaccccccacctgaggtgattggcatccccctggaggacctggacccctactacagcaacaagaagaccttcatcgtgctgaacaagggcaaggccatcttccgcttcagcgccaccccagccctgtacctgctgagccccttctctgtggtgagaagaggagccatcaaggtgctgatccacgccctcttctccatgttcatcatgatcaccatcctgaccaactgtgtgttcatgaccatgtctgaccccccaccctggagcaagaatgtggagtacaccttcaccggcatctacacctttgagagcctcatcaagatcctggcccggggcttctgtgtggatgacttcaccttcctgcgggacccctggaactggctggacttcagcgtcatcatgatggcctacctgacagaatttgtggacctgggcaacatcagcgccctgcggaccttccgggtgctgcgggccctgaagaccatcaccgtcatccctggcctgaagaccatcgtgggcgccctgatccagagcgtgaagaagctgagtgatgtgatgatcctgactgtgttctgcctgtctgtgtttgccctggtgggcctgcagctgttcatgggcaacctgcggcagaagtgtgtgcgctggcccccacccttcaatgacaccaacaccacctggtacagcaatgacacctggtatggaaatgacacctggtatggaaatgagatgtggtatggaaatgacagctggtacgccaatgacacctggaacagccacgcctcctgggccaccaatgacacctttgactgggatgcctacatcagtgatgagggcaacttctacttcctggagggcagcaatgatgccctgctgtgtggcaacagcagtgatgctggccactgcccagagggctatgagtgcatcaagacaggcaggaaccccaactacggctacaccagctatgacaccttctcctgggccttcctggccctcttccggctgatgacccaggactactgggagaacctcttccagctgaccctgcgggctgctgggaagacctacatgatcttctttgtggtgatcatcttcctgggcagcttctacctgatcaacctgatcctggccgtggtggccatggcctatgcagagcagaatgaggccaccctggccgaggacaaggagaaggaggaggagttccagcagatgctggagaagttcaagaagcaccaggaggagctggagaaggccaaggccgcccaggccctggagggcggggaggctgatggagaccctgcccacggcaaggactgcaatggcagcctggacaccagccagggcgagaagggggccccccggcagagcagcagcggggacagcggcatcagtgatgccatggaggagctggaggaggcccaccagaagtgccccccctggtggtacaagtgtgcccacaaggtgctgatctggaactgctgtgccccctggctgaagttcaagaacatcatccacctgattgtgatggacccctttgtggacctgggcatcaccatctgcatcgtgctgaacaccctcttcatggccatggagcactaccccatgacagagcactttgacaacgtgctgactgtgggcaacctggtgttcaccggcatcttcaccgctgagatggtgctgaagctgattgccatggacccctatgagtacttccagcagggctggaacatctttgacagcatcatcgtgaccctgagcctggtggagctgggcctggccaacgtgcagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcgccctggactgcaacctgccccgctggcacatgcatgacttcttccacagcttcctgattgtgttccgcatcctgtgtggggagtggattgagaccatgtgggactgcatggaggtggccggccaggccatgtgcctgaccgtcttcctgatggtgatggtgattggcaacctggtggtgctgaacctcttcctggccctgctgctgagcagcttctctgctgacagcctggccgccagtgatgaagatggagagatgaacaacctgcagatcgccatcggccgcatcaagctgggcattggatttgccaaggccttcctgctgggcctgctgcacggcaagatcctgagccccaaggacatcatgctgagcctgggggaggctgatggagctggggaggccggggaggccggggagacagccccagaagatgagaagaaggagcccccagaggaggacctgaagaaggacaaccacatcctgaaccacatgggcctggctgatggcccccccagcagcctggagctggaccacctgaacttcatcaacaacccctacctgaccatccaggtgcccatcgccagcgaggagagtgacctggagatgcccacagaggaggagacagacaccttcagcgagcctgaggacagcaagaagccaccccagcccctgtatgatggcaacagctctgtgtgcagcacagctgactacaagcccccagaagaagatcctgaggagcaggccgaggagaaccctgagggggagcagcctgaggagtgcttcacagaggcctgtgtgcagcgctggccctgcctgtatgtggacatcagccagggccggggcaagaagtggtggaccctgcggcgggcctgcttcaagatcgtggagcacaactggtttgagaccttcatcgtgttcatgatcctgctgagcagcggggccctggcctttgaggacatctacatcgagcagaggagggtcatccgcaccatcctggagtatgctgacaaggtgttcacctacatcttcatcatggagatgctgctgaagtgggtggcctacggcttcaaggtgtacttcaccaatgcctggtgctggctggacttcctgattgtggatgtgtccatcatcagcctggtggccaactggctgggctacagcgagctgggccccatcaagagcctgcggaccctgcgggccctgcggcccctgcgggccctgagcagatttgagggcatgagggtggtggtgaatgccctgctgggcgccatccccagcatcatgaatgtgctgctggtgtgcctgatcttctggctgatcttcagcatcatgggcgtgaacctgtttgctgggaagttctactactgcatcaacaccaccaccagcgagagatttgacatcagcgaggtgaacaacaagtcagaatgtgagagcctgatgcacacaggccaggtgcgctggctgaatgtgaaggtgaactatgacaacgtgggcctgggctacctgagcctgctgcaggtggccaccttcaagggctggatggacatcatgtatgctgctgtggacagccgggagaaggaggagcagccccagtatgaggtgaacctgtacatgtacctgtactttgtgatcttcatcatcttcggcagcttcttcaccctgaacctcttcatcggggtcatcatcgacaacttcaaccagcagaagaagaagctgggcggcaaggacatcttcatgacagaggagcagaagaagtactacaatgccatgaagaagctgggcagcaagaagccccagaagcccatcccccggccccagaacaagatccagggcatggtgtatgacctggtgaccaagcaggcctttgacatcaccatcatgatcctgatctgcctgaacatggtgaccatgatggtggagacagacaaccagagccagctgaaggtggacatcctgtacaacatcaacatgatcttcatcatcatcttcaccggagaatgtgtgctgaagatgctggccctgcggcagtactacttcaccgtgggctggaacatctttgattttgtggtggtgatcctgagcatcgtgggcctggccctgagtgacctgatccagaagtactttgtgagccccaccctcttccgggtcatccggctggccagaattggccgggtgctgcggctcatccggggggccaagggcatccgcaccctgctgtttgccctgatgatgagcctgcctgccctcttcaacatcggcctgctgctcttcctggtgatgttcatctacagcatcttcggcatgagcaactttgcctacgtgaagaaggagagcggcattgatgacatgttcaactttgagaccttcggcaacagcatcatctgcctgtttgagatcaccaccagcgctggctgggatggcctgctgaaccccatcctgaacagcggccccccagactgtgaccccaacctggagaaccctggcacctctgtgaagggggactgtggcaaccccagcatcggcatctgcttcttctgcagctacatcatcatctccttcctgattgtggtgaacatgtacatcgccatcatcctggagaacttcaacgtggccacagaggagagcagcgagcccctgggggaggatgactttgagatgttttatgagacctgggagaagtttgatcctgatgccacccagttcatcgcctacagccggctgagtgactttgtggacaccctgcaggagcccctgagaattgccaagcccaacaagatcaagctgatcaccctggacctgcccatggtgcctggggacaagatccactgcctggacatcctgtttgccctgaccaaggaggtgctgggggacagcggggagatggatgccctgaagcagaccatggaggagaagttcatggccgccaaccccagcaaggtgtcctatgagcccatcaccaccaccctgaagaggaagcatgaggaggtgtgtgccatcaagatccagagggcctacagaagacacctgctgcagaggtccatgaagcaggccagctacatgtaccgccacagccatgatggcagcggagatgatgcccctgagaaggagggcctgctggccaacaccatgagcaagatgtatggccatgaaaatggaaacagcagcagccccagccctgaggagaagggggaggccggagatgctggccccaccatgggcctgatgcccatcagccccagcgacacagcctggcccccagcccctcctcctggccagacagtgcggcctggggtgaaggagagcctggtgtag

SEQ ID NO: 170100 - DNA, 687 bp, Artificial Sequence
  Description of Artificial Sequence: Synthetic coding sequence
atgcctggagctggagatggcggcaaggccccagcccgctggctgggcaccggcctgctgggcctcttcctgctgcctgtgaccctgagcctggaggtgtctgtgggcaaggccacagacatctatgctgtgaatggaacagagatcctgctgccctgcaccttcagcagctgctttggatttgaggacctgcacttccgctggacctacaacagcagtgatgccttcaagatcctgattgagggcaccgtgaagaatgagaagagtgaccccaaggtgaccctgaaggatgatgaccgcatcaccctggtgggcagcaccaaggagaagatgaacaacatcagcatcgtgctgcgggacctggagttcagtgacaccgggaagtacacctgccacgtgaagaaccccaaggagaacaacctgcagcaccacgccaccatcttcctgcaggtggtggaccggctggaggaggtggacaacacagtgaccctcatcatcctggccgtggtgggcggcgtcatcggcctgctgatcctgatcctgctgatcaagaagctgatcatcttcatcctgaagaagacccgggagaagaagaaggagtgcctggtgagcagcagtggaaatgacaacacagaaaatggcctgcccggcagcaaggccgaggagaagccacccagcaaggtgtag

SEQ ID NO: 170101 - DNA, 285 bp, Artificial Sequence
  Description of Artificial Sequence: Synthetic coding sequence
atgcctggagctggagatggcggcaaggccccagcccgctggctgggcaccggcctgctggtggaggaggtggacaacacagtgaccctcatcatcctggccgtggtgggcggcgtcatcggcctgctgatcctgatcctgctgatcaagaagctgatcatcttcatcctgaagaagacccgggagaagaagaaggagtgcctggtgagcagcagtggaaatgacaacacagaaaatggcctgcccggcagcaaggccgaggagaagccacccagcaaggtgtag

SEQ ID NO: 170102 - DNA, 5970 bp, Artificial Sequence
  Description of Artificial Sequence: Synthetic coding sequence
atggccatgctgcccccacctggcccccagagctttgtgcacttcaccaagcagagcctggccctgattgagcagagaattgctgagaggaagagcaaggagcccaaggaggagaagaaggatgatgatgaggaggcccccaagcccagcagtgacctggaggccggcaagcagctgcccttcatctatggagacatccccccaggcatggtgtctgagcccctggaggacctggacccctactatgctgacaagaagaccttcatcgtgctgaacaagggcaagaccatcttccgcttcaatgccaccccagccctgtacatgctgagccccttcagccccctgcggcgcatcagcatcaagatcctggtgcacagcaccctcttctccatgctgatcatgtgcaccatcctgaccaactgcatcttcatgaccatgaacaaccccccagactggaccaagaatgtggagtacaccttcaccggcatctacacctttgagagcctggtgaagatcctggcccggggcttctgtgtgggggagttcaccttcctgcgggacccctggaactggctggactttgtggtgattgtgtttgcctacctgacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgaagcacaagtgcttcaggaacagcctggagaacaatgagaccctggagagcatcatgaacaccctggagagcgaggaggacttcaggaagtacttctactacctggagggcagcaaggatgccctgctgtgtggcttcagcacagacagcggccagtgcccagagggctacacctgtgtgaagattggaagaaatccagactatggctacaccagctttgacaccttctcctgggccttcctggccctcttccggctgatgacccaggactactgggagaacctgtaccagcagaccctgcgggctgctgggaagacctacatgatcttctttgtggtggtgatcttcctgggcagcttctacctgatcaacctgatcctggccgtggtggccatggcctatgaggagcagaaccaggccaacatcgaggaggccaagcagaaggagctggagttccagcagatgctggaccggctgaagaaggagcaggaggaggccgaggccatcgctgctgctgctgctgagtacaccagcatccgccgcagccgcatcatgggcctgtctgagagcagcagcgagaccagcaagctgagcagcaagagcgccaaggagaggaggaacagaaggaagaagaagaaccagaagaagctgagcagtggagaggagaagggagatgctgagaagctgagcaagtctgagagtgaagattccatccggaggaagagcttccacctgggcgtggagggccacagaagagcccacgagaagaggctgagcacccccaaccagagccccctgagcatccggggcagcctcttcagcgcccggcgcagcagcaggaccagcctcttctccttcaagggccggggccgggacatcggcagcgagacagaatttgctgatgatgagcacagcatctttggagacaatgaaagcagaagaggcagcctgtttgtgccccaccggccccaggagcggcgcagcagcaacatcagccaggccagccgcagcccccccatgctgcctgtgaatggcaagatgcacagcgctgtggactgcaatggagtggtgtccctggtggatggccgcagcgccctgatgctgcccaacggccagctgctgcctgaggtgatcatcgacaaggccaccagtgatgattctggcaccaccaaccagatccacaagaagaggcgctgcagcagctacctgctgtctgaggacatgctgaatgaccccaacctgcggcagagggccatgagccgggccagcatcctgaccaacacagtggaggagctggaggagagccggcagaagtgccccccctggtggtacagatttgcccacaagttcctgatctggaactgcagcccctactggatcaagttcaagaagtgcatctacttcatcgtgatggacccctttgtggacctggccatcaccatctgcatcgtgctgaacaccctcttcatggccatggagcaccaccccatgacagaggagttcaagaatgtgctggccatcggcaacctggtgttcaccggcatctttgctgctgagatggtgctgaagctgattgccatggacccctatgagtacttccaggtgggctggaacatctttgacagcctcatcgtgaccctgagcctggtggagctgttcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccaggccatgtgcctgattgtgtacatgatggtgatggtgattggcaacctggtggtgctgaacctcttcctggccctgctgctgagcagcttcagcagtgacaacctgacagccatcgaggaggaccctgatgccaacaacctgcagattgctgtgacccgcatcaagaagggcatcaactacgtgaagcagaccctgcgggagttcatcctgaaggccttcagcaagaagcccaagatcagccgggagatccggcaggccgaggacctgaacaccaagaaggagaactacatcagcaaccacaccctggccgagatgagcaagggccacaacttcctgaaggagaaggacaagatcagcggcttcggcagctctgtggacaagcacctgatggaggacagtgatggccagagcttcatccacaaccccagcctgactgtgacagtgcccatcgcccctggagagagtgacctggagaacatgaatgctgaggagctgagcagtgacagcgacagcgagtacagcaaggtgcggctgaacagaagcagcagcagtgaatgttccacagtggacaaccccctgcccggggagggggaggaggccgaggccgagcccatgaacagtgatgagcctgaggcctgcttcacagatggctgtgtgtggaggttcagctgctgccaggtgaacattgaaagtggcaagggcaagatctggtggaacatcaggaagacctgctacaagatcgtggagcacagctggtttgagagcttcatcgtgctgatgatcctgctgagcagcggggccctggcctttgaggacatctacattgaaaggaagaagaccatcaagatcatcctggagtatgctgacaagatcttcacctacatcttcatcctggagatgctgctgaagtggatcgcctacggctacaagacctacttcaccaatgcctggtgctggctggacttcctgattgtggatgtgtccctggtgaccctggtggccaacaccctgggctacagcgacctgggccccatcaagagcctgcggaccctgcgggccctgcggcccctgcgggccctgagcagatttgagggcatgagggtggtggtgaatgccctgattggagccatccccagcatcatgaatgtgctgctggtgtgcctgatcttctggctgatcttcagcatcatgggcgtgaacctgtttgctgggaagttctatgagtgcatcaacaccacagatggcagccgcttccctgccagccaggtgcccaacagaagtgagtgctttgccctgatgaatgtgtcccagaatgtgcgctggaagaacctgaaggtgaactttgacaacgtgggcctgggctacctgagcctgctgcaggtggccaccttcaagggctggaccatcatcatgtatgctgctgtggacagcgtgaatgtggacaagcagcccaagtatgagtacagcctgtacatgtacatctactttgtggtgttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatccccaggcctggcaacaagatccagggctgcatctttgacctggtgaccaaccaggcctttgacatcagcatcatggtgctgatctgcctgaacatggtgaccatgatggtggagaaggagggccagagccagcacatgacagaggtgctgtactggatcaacgtggtgttcatcatcctcttcaccggggagtgtgtgctgaagctgatcagcctgcggcactactacttcaccgtgggctggaacatctttgattttgtggtggtgatcatcagcatcgtgggcatgttcctggccgacctgattgagacctactttgtgagccccaccctcttccgggtcatccggctggcccgcatcggccgcatcctgcggctggtgaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggatggcatcaatgacatgttcaactttgagacctttggaaacagcatgatctgcctcttccagatcaccaccagcgctggctgggatggcctgctggcccccatcctgaacagcaagcccccagactgtgaccccaagaaggtgcaccctggcagctctgtggagggggactgtggcaaccccagcgtgggcatcttctactttgtgtcctacatcatcatctccttcctggtggtggtgaacatgtacatcgccgtcatcctggagaacttctctgtggccacagaggagagcacagagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggacagcctgcggagccagatggaggagcgcttcatgtctgccaaccccagcaaggtgtcctatgagcccatcaccaccaccctgaagaggaagcaggaggatgtgtctgccaccgtcatccagagggcctaccgccgctaccgcctgcggcagaatgtgaagaacatcagcagcatctacatcaaggatggagacagagatgatgacctgctgaacaagaaggacatggcctttgacaacgtgaatgaaaacagcagccctgagaagacagatgccaccagcagcaccaccagcccccccagctatgattctgtgaccaagccagacaaggagaagtatgagcaggacagaacagagaaggaggacaagggcaaggacagcaaggagagcaagaagtag

SEQ ID NO: 170103 - DNA, 5970 bp, Artificial Sequence
  Description of Artificial Sequence: Synthetic coding sequence
atggccatgctgcccccacctggcccccagagctttgtgcacttcaccaagcagagcctggccctgattgagcagagaattgctgagaggaagagcaaggagcccaaggaggagaagaaggatgatgatgaggaggcccccaagcccagcagtgacctggaggccggcaagcagctgcccttcatctatggagacatccccccaggcatggtgtctgagcccctggaggacctggacccctactatgctgacaagaagaccttcatcgtgctgaacaagggcaagaccatcttccgcttcaatgccaccccagccctgtacatgctgagccccttcagccccctgcggcgcatcagcatcaagatcctggtgcacagcaccctcttctccatgctgatcatgtgcaccatcctgaccaactgcatcttcatgaccatgaacaaccccccagactggaccaagaatgtggagtacaccttcaccggcatctacacctttgagagcctggtgaagatcctggcccggggcttctgtgtgggggagttcaccttcctgcgggacccctggaactggctggactttgtggtgattgtgtttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgaagcacaagtgcttcaggaacagcctggagaacaatgagaccctggagagcatcatgaacaccctggagagcgaggaggacttcaggaagtacttctactacctggagggcagcaaggatgccctgctgtgtggcttcagcacagacagcggccagtgcccagagggctacacctgtgtgaagattggaagaaatccagactatggctacaccagctttgacaccttctcctgggccttcctggccctcttccggctgatgacccaggactactgggagaacctgtaccagcagaccctgcgggctgctgggaagacctacatgatcttctttgtggtggtgatcttcctgggcagcttctacctgatcaacctgatcctggccgtggtggccatggcctatgaggagcagaaccaggccaacatcgaggaggccaagcagaaggagctggagttccagcagatgctggaccggctgaagaaggagcaggaggaggccgaggccatcgctgctgctgctgctgagtacaccagcatccgccgcagccgcatcatgggcctgtctgagagcagcagcgagaccagcaagctgagcagcaagagcgccaaggagaggaggaacagaaggaagaagaagaaccagaagaagctgagcagtggagaggagaagggagatgctgagaagctgagcaagtctgagagtgaagattccatccggaggaagagcttccacctgggcgtggagggccacagaagagcccacgagaagaggctgagcacccccaaccagagccccctgagcatccggggcagcctcttcagcgcccggcgcagcagcaggaccagcctcttctccttcaagggccggggccgggacatcggcagcgagacagaatttgctgatgatgagcacagcatctttggagacaatgaaagcagaagaggcagcctgtttgtgccccaccggccccaggagcggcgcagcagcaacatcagccaggccagccgcagcccccccatgctgcctgtgaatggcaagatgcacagcgctgtggactgcaatggagtggtgtccctggtggatggccgcagcgccctgatgctgcccaacggccagctgctgcctgaggtgatcatcgacaaggccaccagtgatgattctggcaccaccaaccagatccacaagaagaggcgctgcagcagctacctgctgtctgaggacatgctgaatgaccccaacctgcggcagagggccatgagccgggccagcatcctgaccaacacagtggaggagctggaggagagccggcagaagtgccccccctggtggtacagatttgcccacaagttcctgatctggaactgcagcccctactggatcaagttcaagaagtgcatctacttcatcgtgatggacccctttgtggacctggccatcaccatctgcatcgtgctgaacaccctcttcatggccatggagcaccaccccatgacagaggagttcaagaatgtgctggccatcggcaacctggtgttcaccggcatctttgctgctgagatggtgctgaagctgattgccatggacccctatgagtacttccaggtgggctggaacatctttgacagcctcatcgtgaccctgagcctggtggagctgttcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccaggccatgtgcctgattgtgtacatgatggtgatggtgattggcaacctggtggtgctgaacctcttcctggccctgctgctgagcagcttcagcagtgacaacctgacagccatcgaggaggaccctgatgccaacaacctgcagattgctgtgacccgcatcaagaagggcatcaactacgtgaagcagaccctgcgggagttcatcctgaaggccttcagcaagaagcccaagatcagccgggagatccggcaggccgaggacctgaacaccaagaaggagaactacatcagcaaccacaccctggccgagatgagcaagggccacaacttcctgaaggagaaggacaagatcagcggcttcggcagctctgtggacaagcacctgatggaggacagtgatggccagagcttcatccacaaccccagcctgactgtgacagtgcccatcgcccctggagagagtgacctggagaacatgaatgctgaggagctgagcagtgacagcgacagcgagtacagcaaggtgcggctgaacagaagcagcagcagtgaatgttccacagtggacaaccccctgcccggggagggggaggaggccgaggccgagcccatgaacagtgatgagcctgaggcctgcttcacagatggctgtgtgtggaggttcagctgctgccaggtgaacattgaaagtggcaagggcaagatctggtggaacatcaggaagacctgctacaagatcgtggagcacagctggtttgagagcttcatcgtgctgatgatcctgctgagcagcggggccctggcctttgaggacatctacattgaaaggaagaagaccatcaagatcatcctggagtatgctgacaagatcttcacctacatcttcatcctggagatgctgctgaagtggatcgcctacggctacaagacctacttcaccaatgcctggtgctggctggacttcctgattgtggatgtgtccctggtgaccctggtggccaacaccctgggctacagcgacctgggccccatcaagagcctgcggaccctgcgggccctgcggcccctgcgggccctgagcagatttgagggcatgagggtggtggtgaatgccctgattggagccatccccagcatcatgaatgtgctgctggtgtgcctgatcttctggctgatcttcagcatcatgggcgtgaacctgtttgctgggaagttctatgagtgcatcaacaccacagatggcagccgcttccctgccagccaggtgcccaacagaagtgagtgctttgccctgatgaatgtgtcccagaatgtgcgctggaagaacctgaaggtgaactttgacaacgtgggcctgggctacctgagcctgctgcaggtggccaccttcaagggctggaccatcatcatgtatgctgctgtggacagcgtgaatgtggacaagcagcccaagtatgagtacagcctgtacatgtacatctactttgtggtgttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatccccaggcctggcaacaagatccagggctgcatctttgacctggtgaccaaccaggcctttgacatcagcatcatggtgctgatctgcctgaacatggtgaccatgatggtggagaaggagggccagagccagcacatgacagaggtgctgtactggatcaacgtggtgttcatcatcctcttcaccggggagtgtgtgctgaagctgatcagcctgcggcactactacttcaccgtgggctggaacatctttgattttgtggtggtgatcatcagcatcgtgggcatgttcctggccgacctgattgagacctactttgtgagccccaccctcttccgggtcatccggctggcccgcatcggccgcatcctgcggctggtgaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggatggcatcaatgacatgttcaactttgagacctttggaaacagcatgatctgcctcttccagatcaccaccagcgctggctgggatggcctgctggcccccatcctgaacagcaagcccccagactgtgaccccaagaaggtgcaccctggcagctctgtggagggggactgtggcaaccccagcgtgggcatcttctactttgtgtcctacatcatcatctccttcctggtggtggtgaacatgtacatcgccgtcatcctggagaacttctctgtggccacagaggagagcacagagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggacagcctgcggagccagatggaggagcgcttcatgtctgccaaccccagcaaggtgtcctatgagcccatcaccaccaccctgaagaggaagcaggaggatgtgtctgccaccgtcatccagagggcctaccgccgctaccgcctgcggcagaatgtgaagaacatcagcagcatctacatcaaggatggagacagagatgatgacctgctgaacaagaaggacatggcctttgacaacgtgaatgaaaacagcagccctgagaagacagatgccaccagcagcaccaccagcccccccagctatgattctgtgaccaagccagacaaggagaagtatgagcaggacagaacagagaaggaggacaagggcaaggacagcaaggagagcaagaagtag

SEQ ID NO: 170104 - DNA, 5967 bp, Artificial Sequence
  Description of Artificial Sequence: Synthetic coding sequence
atggccatgctgcccccacctggcccccagagctttgtgcacttcaccaagcagagcctggccctgattgagcagagaattgctgagaggaagagcaaggagcccaaggaggagaagaaggatgatgatgaggaggcccccaagcccagcagtgacctggaggccggcaagcagctgcccttcatctatggagacatccccccaggcatggtgtctgagcccctggaggacctggacccctactatgctgacaagaagaccttcatcgtgctgaacaagggcaagaccatcttccgcttcaatgccaccccagccctgtacatgctgagccccttcagccccctgcggcgcatcagcatcaagatcctggtgcacagcctcttctccatgctgatcatgtgcaccatcctgaccaactgcatcttcatgaccatgaacaaccccccagactggaccaagaatgtggagtacaccttcaccggcatctacacctttgagagcctggtgaagatcctggcccggggcttctgtgtgggggagttcaccttcctgcgggacccctggaactggctggactttgtggtgattgtgtttgcctacctgacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaagcacaagtgcttcaggaacagcctggagaacaatgagaccctggagagcatcatgaacaccctggagagcgaggaggacttcaggaagtacttctactacctggagggcagcaaggatgccctgctgtgtggcttcagcacagattctggccagtgcccagagggctacacctgtgtgaagattggaagaaatccagactatggctacaccagctttgacaccttctcctgggccttcctggccctcttccggctgatgacccaggactactgggagaacctgtaccagcagaccctgcgggccgccggcaagacctacatgatcttctttgtggtggtgatcttcctgggcagcttctacctgatcaacctgatcctggccgtggtggccatggcctatgaggagcagaaccaggccaacatcgaggaggccaagcagaaggagctggagttccagcagatgctggaccggctgaagaaggagcaggaggaggccgaggccatcgctgctgctgctgctgagtacaccagcatcagaagaagccgcatcatgggcctgtctgagagcagcagcgagaccagcaagctgagcagcaagagcgccaaggagaggaggaacagaaggaagaagaagaaccagaagaagctgagcagcggggaggagaagggagatgctgagaagctgagcaagtctgagagcgaggacagcatccggaggaagagcttccacctgggcgtggagggccaccggcgggcccacgagaagaggctgagcacccccaaccagagccccctgagcatccggggcagcctcttcagcgcccggcgcagcagcaggaccagcctcttctccttcaagggccggggccgggacatcggcagcgagacagaatttgctgatgatgagcacagcatctttggagacaatgaaagccggcggggcagcctgtttgtgccccaccggccccaggagaggaggagcagcaacatcagccaggccagccgcagcccccccatgctgcctgtgaatggcaagatgcacagcgctgtggactgcaatggagtggtgtccctggtggatggccgcagcgccctgatgctgcccaacggccagctgctgcctgaggtgatcatcgacaaggccaccagtgatgacagcggcaccaccaaccagatccacaagaagaggcgctgcagcagctacctgctgtctgaggacatgctgaatgaccccaacctgcggcagagggccatgagccgggccagcatcctgaccaacacagtggaggagctggaggagagccggcagaagtgccccccctggtggtacagatttgcccacaagttcctgatctggaactgcagcccctactggatcaagttcaagaagtgcatctacttcatcgtgatggacccctttgtggacctggccatcaccatctgcatcgtgctgaacaccctcttcatggccatggagcaccaccccatgacagaggagttcaagaatgtgctggccatcggcaacctggtgttcaccggcatctttgctgctgagatggtgctgaagctgattgccatggacccctatgagtacttccaggtgggctggaacatctttgacagcctgattgtgaccctgagcctggtggagctgttcctggctgatgtggagggcctgtctgtgctgcggagcttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccaggccatgtgcctgattgtgtacatgatggtgatggtgattggcaacctggtggtgctgaacctcttcctggccctgctgctgagcagcttcagcagtgacaacctgacagccattgaagaagatcctgatgccaacaacctgcagattgctgtgacccgcatcaagaagggcatcaactacgtgaagcagaccctgcgggagttcatcctgaaggccttcagcaagaagcccaagatcagccgggagatccggcaggccgaggacctgaacaccaagaaggagaactacatcagcaaccacaccctggccgagatgagcaagggccacaacttcctgaaggagaaggacaagatcagcggcttcggcagctctgtggacaagcacctgatggaggacagtgatggccagagcttcatccacaaccccagcctgactgtgacagtgcccatcgcccctggagagagtgacctggagaacatgaatgctgaggagctgagcagtgacagcgacagcgagtacagcaaggtgcggctgaacagaagcagcagcagcgagtgcagcacagtggacaaccccctgcctggagagggggaggaggccgaggccgagcccatgaacagtgatgagcctgaggcctgcttcacagatggctgtgtgtggaggttcagctgctgccaggtgaacatcgagagcggcaagggcaagatctggtggaacatcaggaagacctgctacaagatcgtggagcacagctggtttgagagcttcatcgtgctgatgatcctgctgagcagcggggccctggcctttgaggacatctacatcgagaggaagaagaccatcaagatcatcctggagtatgctgacaagatcttcacctacatcttcatcctggagatgctgctgaagtggatcgcctacggctacaagacctacttcaccaatgcctggtgctggctggacttcctgattgtggatgtgtccctggtgaccctggtggccaacaccctgggctacagcgacctgggccccatcaagagcctgcggaccctgcgggccctgcggcccctgcgggccctgagcagatttgagggcatgagggtggtggtgaatgccctgattggagccatccccagcatcatgaatgtgctgctggtgtgcctgatcttctggctgatcttcagcatcatgggcgtgaacctgtttgctgggaagttctatgagtgcatcaacaccacagatggcagccgcttccctgccagccaggtgcccaacagaagtgaatgttttgccctgatgaatgtgtcccagaatgtgcgctggaagaacctgaaggtgaactttgacaacgtgggcctgggctacctgagcctgctgcaggtggccaccttcaagggctggaccatcatcatgtatgctgctgtggacagcgtgaatgtggacaagcagcccaagtatgagtacagcctgtacatgtacatctactttgtggtgttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccggcaacaagatccagggctgcatctttgacctggtgaccaaccaggcctttgacatcagcatcatggtgctgatctgcctgaacatggtgaccatgatggtggagaaggagggccagagccagcacatgacagaggtgctgtactggatcaacgtggtgttcatcatcctcttcaccggagaatgtgtgctgaagctgatcagcctgcggcactactacttcaccgtgggctggaacatctttgattttgtggtggtgatcatcagcatcgtgggcatgttcctggccgacctgattgagacctactttgtgagccccaccctcttccgggtcatccggctggccagaattggccgcatcctgcggctggtgaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggatggcatcaatgacatgttcaactttgagaccttcggcaacagcatgatctgcctcttccagatcaccaccagcgctggctgggatggcctgctggcccccatcctgaacagcaagcccccagactgtgaccccaagaaggtgcaccctggcagctctgtggagggggactgtggcaaccccagcgtgggcatcttctactttgtgtcctacatcatcatctccttcctggtggtggtgaacatgtacatcgctgtgatcctggagaacttctctgtggccacagaggagagcacagagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggacagcctgcggagccagatggaggagcgcttcatgtctgccaaccccagcaaggtgtcctatgagcccatcaccaccaccctgaagaggaagcaggaggatgtgtctgccaccgtcatccagagggcctaccgccgctaccgcctgcggcagaatgtgaagaacatcagcagcatctacatcaaggatggagacagagatgatgacctgctgaacaagaaggacatggcctttgacaacgtgaatgaaaacagcagccctgagaagacagatgccaccagcagcaccaccagccccccatcctatgacagcgtgaccaagccagacaaggagaagtatgagcaggacagaacagagaaggaggacaagggcaaggacagcaaggagagcaagaagtag

SEQ ID NO: 170105 - DNA, 5934 bp, Artificial Sequence
  Description of Artificial Sequence: Synthetic coding sequence
atggccatgctgcccccacctggcccccagagctttgtgcacttcaccaagcagagcctggccctgattgagcagagaattgctgagaggaagagcaaggagcccaaggaggagaagaaggatgatgatgaggaggcccccaagcccagcagtgacctggaggccggcaagcagctgcccttcatctatggagacatccccccaggcatggtgtctgagcccctggaggacctggacccctactatgctgacaagaagaccttcatcgtgctgaacaagggcaagaccatcttccgcttcaatgccaccccagccctgtacatgctgagccccttcagccccctgcggcgcatcagcatcaagatcctggtgcacagcctcttctccatgctgatcatgtgcaccatcctgaccaactgcatcttcatgaccatgaacaaccccccagactggaccaagaatgtggagtacaccttcaccggcatctacacctttgagagcctggtgaagatcctggcccggggcttctgtgtgggggagttcaccttcctgcgggacccctggaactggctggactttgtggtgattgtgtttgcctacctgacagaatttgtgaacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgaccgtcttctgcctgtctgtgtttgccctgattggcctgcagctgttcatgggcaacctgaagcacaagtgcttcaggaacagcctggagaacaatgagaccctggagagcatcatgaacaccctggagagcgaggaggacttcaggaagtacttctactacctggagggcagcaaggatgccctgctgtgtggcttcagcacagattctggccagtgcccagagggctacacctgtgtgaagattggaagaaatccagactatggctacaccagctttgacaccttctcctgggccttcctggccctcttccggctgatgacccaggactactgggagaacctgtaccagcagaccctgcgggccgccggcaagacctacatgatcttctttgtggtggtgatcttcctgggcagcttctacctgatcaacctgatcctggccgtggtggccatggcctatgaggagcagaaccaggccaacatcgaggaggccaagcagaaggagctggagttccagcagatgctggaccggctgaagaaggagcaggaggaggccgaggccatcgctgctgctgctgctgagtacaccagcatcagaagaagccgcatcatgggcctgtctgagagcagcagcgagaccagcaagctgagcagcaagagcgccaaggagaggaggaacagaaggaagaagaagaaccagaagaagctgagcagcggggaggagaagggagatgctgagaagctgagcaagtctgagagcgaggacagcatccggaggaagagcttccacctgggcgtggagggccaccggcgggcccacgagaagaggctgagcacccccaaccagagccccctgagcatccggggcagcctcttcagcgcccggcgcagcagcaggaccagcctcttctccttcaagggccggggccgggacatcggcagcgagacagaatttgctgatgatgagcacagcatctttggagacaatgaaagccggcggggcagcctgtttgtgccccaccggccccaggagaggaggagcagcaacatcagccaggccagccgcagcccccccatgctgcctgtgaatggcaagatgcacagcgctgtggactgcaatggagtggtgtccctggtggatggccgcagcgccctgatgctgcccaacggccagctgctgcctgagggcaccaccaaccagatccacaagaagaggcgctgcagcagctacctgctgtctgaggacatgctgaatgaccccaacctgcggcagagggccatgagccgggccagcatcctgaccaacacagtggaggagctggaggagagccggcagaagtgccccccctggtggtacagatttgcccacaagttcctgatctggaactgcagcccctactggatcaagttcaagaagtgcatctacttcatcgtgatggacccctttgtggacctggccatcaccatctgcatcgtgctgaacaccctcttcatggccatggagcaccaccccatgacagaggagttcaagaatgtgctggccatcggcaacctggtgttcaccggcatctttgctgctgagatggtgctgaagctgattgccatggacccctatgagtacttccaggtgggctggaacatctttgacagcctcatcgtgaccctgagcctggtggagctgttcctggctgatgtggagggcctgtctgtgctgcgctccttccggctgctgcgggtcttcaagctggccaagtcctggcccaccctgaacatgctgatcaagatcatcggcaacagcgtgggcgccctgggcaacctgaccctggtgctggccatcatcgtgttcatctttgctgtggtgggcatgcagctgtttgggaagagctacaaggaatgtgtgtgcaagatcaatgatgactgcaccctgccccgctggcacatgaatgacttcttccacagcttcctgattgtgttccgggtgctgtgtggggagtggattgagaccatgtgggactgcatggaggtggccggccaggccatgtgcctgattgtgtacatgatggtgatggtgattggcaacctggtggtgctgaacctcttcctggccctgctgctgagcagcttcagcagtgacaacctgacagccatcgaggaggaccctgatgccaacaacctgcagattgctgtgacccgcatcaagaagggcatcaactacgtgaagcagaccctgcgggagttcatcctgaaggccttcagcaagaagcccaagatcagccgggagatccggcaggccgaggacctgaacaccaagaaggagaactacatcagcaaccacaccctggccgagatgagcaagggccacaacttcctgaaggagaaggacaagatcagcggcttcggcagctctgtggacaagcacctgatggaggacagtgatggccagagcttcatccacaaccccagcctgactgtgacagtgcccatcgcccctggagagagtgacctggagaacatgaatgctgaggagctgagcagtgacagcgacagcgagtacagcaaggtgcggctgaacagaagcagcagcagtgaatgttccacagtggacaaccccctgcccggggagggggaggaggccgaggccgagcccatgaacagtgatgagcctgaggcctgcttcacagatggctgtgtgtggaggttcagctgctgccaggtgaacattgaaagtggcaagggcaagatctggtggaacatcaggaagacctgctacaagatcgtggagcacagctggtttgagagcttcatcgtgctgatgatcctgctgagcagcggggccctggcctttgaggacatctacattgaaaggaagaagaccatcaagatcatcctggagtatgctgacaagatcttcacctacatcttcatcctggagatgctgctgaagtggatcgcctacggctacaagacctacttcaccaatgcctggtgctggctggacttcctgattgtggatgtgtccctggtgaccctggtggccaacaccctgggctacagcgacctgggccccatcaagagcctgcggaccctgcgggccctgcggcccctgcgggccctgagcagatttgagggcatgagggtggtggtgaatgccctgattggagccatccccagcatcatgaatgtgctgctggtgtgcctgatcttctggctgatcttcagcatcatgggcgtgaacctgtttgctgggaagttctatgagtgcatcaacaccacagatggcagccgcttccctgccagccaggtgcccaacagaagtgagtgctttgccctgatgaatgtgtcccagaatgtgcgctggaagaacctgaaggtgaactttgacaacgtgggcctgggctacctgagcctgctgcaggtggccaccttcaagggctggaccatcatcatgtatgctgctgtggacagcgtgaatgtggacaagcagcccaagtatgagtacagcctgtacatgtacatctactttgtggtgttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatccccaggcctggcaacaagatccagggctgcatctttgacctggtgaccaaccaggcctttgacatcagcatcatggtgctgatctgcctgaacatggtgaccatgatggtggagaaggagggccagagccagcacatgacagaggtgctgtactggatcaacgtggtgttcatcatcctcttcaccggggagtgtgtgctgaagctgatcagcctgcggcactactacttcaccgtgggctggaacatctttgattttgtggtggtgatcatcagcatcgtgggcatgttcctggccgacctgattgagacctactttgtgagccccaccctcttccgggtcatccggctggcccgcatcggccgcatcctgcggctggtgaagggggccaagggcatccgcaccctgctgtttgccctgatgatgagcctgcctgccctcttcaacatcggcctgctgctcttcctggtgatgttcatctatgccatcttcggcatgagcaactttgcctacgtgaagaaggaggatggcatcaatgacatgttcaactttgagacctttggaaacagcatgatctgcctcttccagatcaccaccagcgctggctgggatggcctgctggcccccatcctgaacagcaagcccccagactgtgaccccaagaaggtgcaccctggcagctctgtggagggggactgtggcaaccccagcgtgggcatcttctactttgtgtcctacatcatcatctccttcctggtggtggtgaacatgtacatcgccgtcatcctggagaacttctctgtggccacagaggagagcacagagcccctgtctgaagatgactttgagatgttttatgaggtgtgggagaagtttgatcctgatgccacccagttcatcgagttcagcaagctgagtgactttgctgctgccctggacccccccctgctgattgccaagcccaacaaggtgcagctgattgccatggacctgcccatggtgtctggggaccgcatccactgcctggacatcctgtttgccttcaccaagagggtgctgggggagagcggggagatggacagcctgcggagccagatggaggagcgcttcatgtctgccaaccccagcaaggtgtcctatgagcccatcaccaccaccctgaagaggaagcaggaggatgtgtctgccaccgtcatccagagggcctaccgccgctaccgcctgcggcagaatgtgaagaacatcagcagcatctacatcaaggatggagacagagatgatgacctgctgaacaagaaggacatggcctttgacaacgtgaatgaaaacagcagccctgagaagacagatgccaccagcagcaccaccagcccccccagctatgattctgtgaccaagccagacaaggagaagtatgagcaggacagaacagagaaggaggacaagggcaaggacagcaaggagagcaagaagtag

SEQ ID NO: 170106 - DNA, 1620 bp, Artificial Sequence
  Description of Artificial Sequence: Synthetic coding sequence
atcctgaccaactgcatcttcatgaccatgaacaaccccccagactggaccaagaatgtggagtacaccttcaccggcatctacacctttgagagcctggtgaagatcctggcccggggcttctgtgtgggggagttcaccttcctgcgggacccctggaactggctggactttgtggtgattgtgtttgcctacgtgacagaatttgtggacctgggcaatgtgtctgccctgcggaccttccgggtgctgcgggccctgaagaccatcagcgtcatccctggcctgaagaccatcgtgggcgccctgatccagagcgtgaagaagctgagtgatgtgatgatcctgactgtgttctgcctgtctgtgtttgccctgattggcctgcagctgttcatgggcaacctgaagcacaagtgcttcaggaacagcctggagaacaatgagaccctggagagcatcatgaacaccctggagagcgaggaggacttcaggaagtacttctactacctggagggcagcaaggatgccctgctgtgtggcttcagcacagacagcggccagtgcccagagggctacacctgtgtgaagattggaagaaatccagactatggctacaccagctttgacaccttctcctgggccttcctggccctcttccggctgatgacccaggactactgggagaacctgtaccagcagaccctgcgggctgctgggaagacctacatgatcttctttgtggtggtgatcttcctgggcagcttctacctgatcaacctgatcctggccgtggtggccatggcctatgaggagcagaaccaggccaacatcgaggaggccaagcagaaggagctggagttccagcagatgctggaccggctgaagaaggagcaggaggaggccgaggccatcgctgctgctgctgctgagtacaccagcatccgccgcagccgcatcatgggcctgtctgagagcagcagcgagaccagcaagctgagcagcaagagcgccaaggagaggaggaacagaaggaagaagaagaaccagaagaagctgagcagtggagaggagaagggagatgctgagaagctgagcaagtctgagagtgaagattccatccggaggaagagcttccacctgggcgtggagggccacagaagagcccacgagaagaggctgagcacccccaaccagagccccctgagcatccggggcagcctcttcagcgcccggcgcagcagcaggaccagcctcttctccttcaagggccggggccgggacatcggcagcgagacagaatttgctgatgatgagcacagcatctttggagacaatgaaagcagaagaggcagcctgtttgtgccccaccggccccaggagcggcgcagcagcaacatcagccaggccagccgcagcccccccatgctgcctgtgaatggcaagatgcacagcgctgtggactgcaatggagtggtgtccctggtggatggccgcagcgccctgatgctgcccaacggccagctgctgcctgaggtgatcatcgacaaggccaccagtgatgattctggcaccaccaaccagatccacaagaagaggcgctgcagcagctacctgtag

SEQ ID NO: 170107 - DNA, 198 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgccctag

SEQ ID NO: 170108 - DNA, 6051 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacaccacagaatttgtggacctgggcaatgtgtctgccctgcggaccttccgggtgctgcgggccctgaagaccatcagcgtcatcagcggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcagcaggagagccagcctgtgtctgggggccctgaggcccccccagacagcaggacctggagccaggtgtctgccacagccagcagcgaggccgaggccagcgccagccaggccgactggaggcagcagtggaaggccgagccccaggcccctggctgtggggagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgaccggggagctgtactggaccaaggtgaaggtgaactttgacaacgtgggcgccggctacctggccctgctgcaggtggccaccttcaagggctggatggacatcatgtatgctgctgtggacagccggggctatgaggagcagccccagtgggagtacaacctgtacatgtacatctacttcgtcatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgacatcgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggggagtgcatcgtgaagctggccgccctgcggcactactacttcaccaacagctggaacatctttgattttgtggtggtgatcctgagcatcgtgggcaccgtgctgagtgacatcatccagaagtacttcttcagccccaccctcttccgggtcatccggctggcccgcatcggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgagaattgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttcagaagacacctgctgcagaggagcctgaagcacgccagcttcctgttccggcagcaggccggcagcggcctgtctgaagaagatgcccctgagcgggagggcctcatcgcctacgtgatgtctgagaacttcagccggcccctgggcccccccagcagcagcagcatcagcagcaccagcttcccccccagctatgattctgtgacccgggccaccagtgacaacctgcaggtgcggggcagtgactacagccacagcgaggacctggccgacttcccccccagcccagaccgggaccgggagagcatcgtgtag

SEQ ID NO: 170109 - DNA, 342 bp, Artificial Sequence
  Description of Artificial Sequence: Synthetic coding sequence
atggcccagcacgaccccccaccctggaccaagtatgtggagtatgtgtctgagaacatcaagctgggcaacctgagcgccctgcggaccttccgggtgctgcgggccctgaagaccatcagcgtcatccctggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagctag

SEQ ID NO: 170110 - DNA, 6051 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacgtgtctgagaacatcaagctgggcaacctgagcgccctgcggaccttccgggtgctgcgggccctgaagaccatcagcgtcatccctggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcagcaggagagccagcctgtgtctgggggccctgaggcccccccagacagcaggacctggagccaggtgtctgccacagccagcagcgaggccgaggccagcgccagccaggccgactggaggcagcagtggaaggccgagccccaggcccctggctgtggggagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgaccggggagctgtactggaccaaggtgaaggtgaactttgacaacgtgggcgccggctacctggccctgctgcaggtggccaccttcaagggctggatggacatcatgtatgctgctgtggacagccggggctatgaggagcagccccagtgggagtacaacctgtacatgtacatctacttcgtcatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgacatcgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggggagtgcatcgtgaagctggccgccctgcggcactactacttcaccaacagctggaacatctttgattttgtggtggtgatcctgagcatcgtgggcaccgtgctgagtgacatcatccagaagtacttcttcagccccaccctcttccgggtcatccggctggcccgcatcggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgagaattgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttcagaagacacctgctgcagaggagcctgaagcacgccagcttcctgttccggcagcaggccggcagcggcctgtctgaagaagatgcccctgagcgggagggcctcatcgcctacgtgatgtctgagaacttcagccggcccctgggcccccccagcagcagcagcatcagcagcaccagcttcccccccagctatgattctgtgacccgggccaccagtgacaacctgcaggtgcggggcagtgactacagccacagcgaggacctggccgacttcccccccagcccagaccgggaccgggagagcatcgtgtag

SEQ ID NO: 170111 - DNA, 5997 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacgtgtctgagaacatcaagctgggcaacctgagcgccctgcggaccttccgggtgctgcgggccctgaagaccatcagcgtcatccctggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcagcaggagagccagcctgtgtctgggggccctgaggcccccccagacagcaggacctggagccaggtgtctgccacagccagcagcgaggccgaggccagcgccagccaggccgactggaggcagcagtggaaggccgagccccaggcccctggctgtggggagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgaccggggagctgtactggaccaaggtgaaggtgaactttgacaacgtgggcgccggctacctggccctgctgcaggtgtatgaggagcagccccagtgggagtacaacctgtacatgtacatctacttcgtcatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgacatcgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggggagtgcatcgtgaagctggccgccctgcggcactactacttcaccaacagctggaacatctttgattttgtggtggtgatcctgagcatcgtgggcaccgtgctgagtgacatcatccagaagtacttcttcagccccaccctcttccgggtcatccggctggcccgcatcggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgagaattgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttcagaagacacctgctgcagaggagcctgaagcacgccagcttcctgttccggcagcaggccggcagcggcctgtctgaagaagatgcccctgagcgggagggcctcatcgcctacgtgatgtctgagaacttcagccggcccctgggcccccccagcagcagcagcatcagcagcaccagcttcccccccagctatgattctgtgacccgggccaccagtgacaacctgcaggtgcggggcagtgactacagccacagcgaggacctggccgacttcccccccagcccagaccgggaccgggagagcatcgtgtag

SEQ ID NO: 170112 - DNA, 6048 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacaccacagaatttgtggacctgggcaatgtgtctgccctgcggaccttccgggtgctgcgggccctgaagaccatcagcgtcatcagcggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcaggagagccagcctgtgtctgggggccctgaggcccccccagacagcaggacctggagccaggtgtctgccacagccagcagcgaggccgaggccagcgccagccaggccgactggaggcagcagtggaaggccgagccccaggcccctggctgtggggagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgactggagagctgtactggaccaaggtgaaggtgaactttgacaacgtgggcgccggctacctggccctgctgcaggtggccaccttcaagggctggatggacatcatgtatgctgctgtggacagccggggctatgaggagcagccccagtgggagtacaacctgtacatgtacatctactttgtgatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgatattgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggagaatgtattgtgaagctggccgccctgcggcactactacttcaccaacagctggaacatctttgattttgtggtggtgatcctgagcatcgtgggcaccgtgctgagtgacatcatccagaagtacttcttcagccccaccctcttccgggtcatccggctggccagaattggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgcgcatcgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttccgccgccacctgctgcagaggagcctgaagcacgccagcttcctgttccggcagcaggccggcagcggcctgtctgaggaggatgcccctgagcgggagggcctgattgcctacgtgatgtctgagaacttcagccggcccctgggcccccccagcagcagcagcatcagcagcaccagcttccccccatcctatgacagcgtgacccgggccaccagtgacaacctgcaggtgcggggcagtgactacagccacagcgaggacctggccgacttcccccccagcccagaccgggaccgggagagcatcgtgtag

SEQ ID NO: 170113 - DNA, 5997 bp, Artificial Sequence; identical to SEQ ID NO: 170111
  Description of Artificial Sequence: Synthetic coding sequence

SEQ ID NO: 170114 - DNA, 6048 bp, Artificial Sequence; identical to SEQ ID NO: 170112
  Description of Artificial Sequence: Synthetic coding sequence

SEQ ID NO: 170115 - DNA, 5889 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacaccacagaatttgtggacctgggcaatgtgtctgccctgcggaccttccgggtgctgcgggccctgaagaccatcagcgtcatcagcggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgaccggggagctgtactggaccaaggtgaaggtgaactttgacaacgtgggcgccggctacctggccctgctgcaggtggccaccttcaagggctggatggacatcatgtatgctgctgtggacagccggggctatgaggagcagccccagtgggagtacaacctgtacatgtacatctacttcgtcatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgacatcgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggggagtgcatcgtgaagctggccgccctgcggcactactacttcaccaacagctggaacatctttgattttgtggtggtgatcctgagcatcgtgggcaccgtgctgagtgacatcatccagaagtacttcttcagccccaccctcttccgggtcatccggctggcccgcatcggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgagaattgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttcagaagacacctgctgcagaggagcctgaagcacgccagcttcctgttccggcagcaggccggcagcggcctgtctgaagaagatgcccctgagcgggagggcctcatcgcctacgtgatgtctgagaacttcagccggcccctgggcccccccagcagcagcagcatcagcagcaccagcttcccccccagctatgattctgtgacccgggccaccagtgacaacctgcaggtgcggggcagtgactacagccacagcgaggacctggccgacttcccccccagcccagaccgggaccgggagagcatcgtgtag

SEQ ID NO: 170116 - DNA, 5889 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacgtgtctgagaacatcaagctgggcaacctgagcgccctgcggaccttccgggtgctgcgggccctgaagaccatcagcgtcatccctggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgaccggggagctgtactggaccaaggtgaaggtgaactttgacaacgtgggcgccggctacctggccctgctgcaggtggccaccttcaagggctggatggacatcatgtatgctgctgtggacagccggggctatgaggagcagccccagtgggagtacaacctgtacatgtacatctacttcgtcatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgacatcgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggggagtgcatcgtgaagctggccgccctgcggcactactacttcaccaacagctggaacatctttgattttgtggtggtgatcctgagcatcgtgggcaccgtgctgagtgacatcatccagaagtacttcttcagccccaccctcttccgggtcatccggctggcccgcatcggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgagaattgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttcagaagacacctgctgcagaggagcctgaagcacgccagcttcctgttccggcagcaggccggcagcggcctgtctgaagaagatgcccctgagcgggagggcctcatcgcctacgtgatgtctgagaacttcagccggcccctgggcccccccagcagcagcagcatcagcagcaccagcttcccccccagctatgattctgtgacccgggccaccagtgacaacctgcaggtgcggggcagtgactacagccacagcgaggacctggccgacttcccccccagcccagaccgggaccgggagagcatcgtgtag

SEQ ID NO: 170117 - DNA, 5889 bp, Artificial Sequence; identical to SEQ ID NO: 170116
  Description of Artificial Sequence: Synthetic coding sequence

SEQ ID NO: 170118 - DNA, 5952 bp, Artificial Sequence
  Description of Artificial Sequence: Synthetic coding sequence
atggccaacttcctgctgccccggggcaccagcagcttccgccgcttcacccgggagagcctggccgccatcgagaagaggatggccgagaagcaggcccggggcagcaccaccctgcaggagagccgggagggcctgcctgaggaggaggccccccggccccagctggacctgcaggccagcaagaagctgcctgacctgtatggcaaccccccccaggagctgattggagagcccctggaggacctggaccccttctacagcacccagaagaccttcatcgtgctgaacaagggcaagaccatcttccgcttcagcgccaccaatgccctgtatgtgctgagccccttccaccccatcagaagagctgctgtgaagatcctggtgcacagcctcttcaacatgctgatcatgtgcaccatcctgaccaactgtgtgttcatggcccagcacgaccccccaccctggaccaagtatgtggagtacaccttcaccgccatctacacctttgagagcctggtgaagatcctggcccggggcttctgcctgcacgccttcaccttcctgcgggacccctggaactggctggacttcagcgtcatcatcatggcctacgtgtctgagaacatcaagctgggcaacctgagcgccctgcggaccttccgggtgctgcgggccctgaagaccatcagcgtcatccctggcctgaagaccatcgtgggcgccctgatccagagcgtgaagaagctggctgatgtgatggtgctgactgtgttctgcctgtctgtgtttgccctgattggcctgcagctgttcatgggcaacctgcggcacaagtgtgtgaggaacttcaccgccctgaatggcaccaatggatctgtggaggctgatggcctggtgtgggagagcctggacctgtacctgagtgaccctgagaactacctgctgaagaatggcaccagtgatgtgctgctgtgtggcaacagcagtgatgctggcacctgcccagagggctaccgctgcctgaaggccggggagaacccagaccacggctacaccagctttgacagctttgcctgggccttcctggccctcttccggctgatgacccaggactgctgggagcggctgtaccagcagaccctgcggtctgctgggaagatctacatgatcttcttcatgctggtgatcttcctgggcagcttctacctggtgaacctgatcctggccgtggtggccatggcctatgaggagcagaaccaggccaccatcgccgagacagaggagaaggagaagcgcttccaggaggccatggagatgctgaagaaggagcacgaggccctgaccatccggggcgtggacacagtgagccgcagcagcctggagatgagccccctggcccctgtgaacagccatgagcggcgcagcaagaggaggaagaggatgagcagcggcacagaggagtgtggagaagatcggctgcccaagagtgacagtgaagatggcccccgggccatgaaccacctgagcctgacccggggcctgagcaggacctccatgaagcccaggagcagccggggcagcatcttcaccttcagaagaagagacctgggcagcgaggccgactttgctgatgatgagaacagcacagctggggagagcgagagccaccacaccagcctgctggtgccctggcccctgcggaggaccagcgcccagggccagcccagccctggcaccagcgcccctggccacgccctgcacggcaagaagaacagcacagtggactgcaatggagtggtgtccctgctgggcgctggggaccctgaggccaccagccctggcagccacctgctgcggcctgtgatgctggagcaccccccagacaccaccacccccagcgaggagcccggcggcccccagatgctgaccagccaggccccctgtgtggatggctttgaggagcccggggcccggcagagggccctgtctgctgtgtctgtgctgaccagcgccctggaggagctggaggagagccgccacaagtgccccccctgctggaaccggctggcccagcgctacctgatctgggagtgctgccccctgtggatgagcatcaagcagggcgtgaagctggtggtgatggaccccttcacagacctgaccatcaccatgtgcatcgtgctgaacaccctcttcatggccctggagcactacaacatgaccagcgagtttgaggagatgctgcaggtgggcaacctggtgttcaccggcatcttcaccgctgagatgaccttcaagatcatcgccctggacccctactactacttccagcagggctggaacatctttgacagcatcatcgtcatcctgagcctgatggagctgggcctgagcaggatgagcaacctgtctgtgctgcgctccttccggctgctgcgggtcttcaagctggccaagtcctggcccaccctgaacaccctcatcaagatcatcggcaacagcgtgggcgccctgggcaacctgaccctggtgctggccatcatcgtgttcatctttgctgtggtgggcatgcagctgtttgggaagaactacagcgagctgcgggacagcgacagcggcctgctgccccgctggcacatgatggacttcttccacgccttcctgatcatcttccgcatcctgtgtggggagtggattgagaccatgtgggactgcatggaggtgtctggccagagcctgtgcctgctggtgttcctgctggtgatggtgattggcaacctggtggtgctgaacctcttcctggccctgctgctgagcagcttctctgctgacaacctgacagccccagatgaggaccgggagatgaacaacctgcagctggccctggcccgcatccagaggggcctgcgctttgtgaagaggaccacctgggacttctgctgcggcctgctgcggcagaggccccagaagccagctgccctggccgcccagggccagctgcccagctgcatcgccaccccctacagccccccacctcctgagacagagaaggtgccccccaccaggaaggagaccaggtttgaggagggggagcagcccggccagggcacccctggggaccctgagcctgtgtgtgtgcccatcgctgtggccgagagtgacacagatgaccaggaggaggatgaggagaacagcctgggcacagaggaggagagcagcaagcaggagagccagcctgtgtctgggggccctgaggcccccccagacagcaggacctggagccaggtgtctgccacagccagcagcgaggccgaggccagcgccagccaggccgactggaggcagcagtggaaggccgagccccaggcccctggctgtggggagaccccagaggacagctgcagcgagggcagcacagctgacatgaccaacacagctgagctgctggagcagatcccagacctgggccaggatgtgaaggaccctgaggactgcttcacagagggctgtgtgcggcgctgcccctgctgtgctgtggacaccacccaggcccctgggaaggtgtggtggaggctgaggaagacctgctaccacatcgtggagcacagctggtttgagaccttcatcatcttcatgatcctgctgagcagcggggccctggcctttgaggacatctacctggaggagaggaagaccatcaaggtgctgctggagtatgctgacaagatgttcacctacgtgtttgtgctggagatgctgctgaagtgggtggcctacggcttcaagaagtacttcaccaatgcctggtgctggctggacttcctgattgtggatgtgtccctggtgtccctggtggccaacaccctgggctttgctgagatgggccccatcaagagcctgcggaccctgcgggccctgcggcccctgcgggccctgagcagatttgagggcatgagggtggtggtgaatgccctggtgggcgccatccccagcatcatgaatgtgctgctggtgtgcctgatcttctggctgatcttcagcatcatgggcgtgaacctgtttgctgggaagtttggccgctgcatcaaccagacagaaggagacctgcccctgaactacaccatcgtgaacaacaagagccagtgtgagagcctgaacctgactggagagctgtactggaccaaggtgaaggtgaactttgacaacgtgggcgccggctacctggccctgctgcaggtggccaccttcaagggctggatggacatcatgtatgctgctgtggacagccggggctatgaggagcagccccagtgggagtacaacctgtacatgtacatctactttgtgatcttcatcatcttcggcagcttcttcaccctgaacctcttcatcggggtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagtaccagggcttcatctttgatattgtgaccaagcaggcctttgatgtgaccatcatgttcctgatctgcctgaacatggtgaccatgatggtggagacagatgaccagagccctgagaagatcaacatcctggccaagatcaacctgctgtttgtggccatcttcaccggcaccgtgctgagtgacatcatccagaagtacttcttcagccccaccctcttccgggtcatccggctggccagaattggccgcatcctgcggctcatccggggggccaagggcatccgcaccctgctgtttgccctgatgatgagcctgcctgccctcttcaacatcggcctgctgctcttcctggtgatgttcatctacagcatcttcggcatggccaactttgcctacgtgaagtgggaggccggcattgatgacatgttcaacttccagacctttgccaacagcatgctgtgcctcttccagatcaccaccagcgctggctgggatggcctgctgagccccatcctgaacacaggccccccctactgtgaccccaccctgcccaacagcaatggcagcagaggagactgtggcagccctgctgtgggcatcctcttcttcaccacctacatcatcatctccttcctgattgtggtgaacatgtacatcgccatcatcctggagaacttctctgtggccacagaggagagcacagagcccctgtctgaagatgactttgacatgttttatgagatctgggagaagtttgatcctgaggccacccagttcatcgagtacagcgtgctgagtgactttgctgatgccctgtctgagcccctgcgcatcgccaagcccaaccagatcagcctcatcaacatggacctgcccatggtgtctggggaccgcatccactgcatggacatcctgtttgccttcaccaagagggtgctgggggagagcggggagatggatgccctgaagatccagatggaggagaagttcatggccgccaaccccagcaagatctcctatgagcccatcaccaccaccctgcggaggaagcatgaggaggtgtctgccatggtgatccagagggccttccgccgccacctgctgcagaggagcctgaagcacgccagcttcctgttccggcagcaggccggcagcggcctgtctgaggaggatgcccctgagcgggagggcctgattgcctacgtgatgtctgagaacttcagccggcccctgggcccccccagcagcagcagcatcagcagcaccagcttccccccatcctatgacagcgtgacccgggccaccagtgacaacctgcaggtgcggggcagtgactacagccacagcgaggacctggccgacttcccccccagcccagaccgggaccgggagagcatcgtgtag

SEQ ID NO: 170119 - DNA, 5049 bp, Artificial Sequence
  Description of Artificial Sequence: Synthetic coding sequence
atgctggccagccctgagcccaagggcctggtgcccttcaccaaggagagctttgagctgatcaagcagcacatcgccaagacccacaatgaagatcatgaggaggaggacctgaagcccaccccagacctggaggtgggcaagaagctgcccttcatctacggcaacctgagccagggcatggtgtctgagcccctggaggatgtggacccctactactacaagaagaagaacaccttcatcgtgctgaacaagaacagaaccatcttccgcttcaatgctgccagcatcctgtgcaccctgagccccttcaactgcatccggaggaccaccatcaaggtgctggtgcaccccttcttccagctgttcatcctgatctctgtgctgattgactgtgtgttcatgagcctgaccaacctgcccaagtggaggcctgtgctggagaacaccctgctgggcatctacacctttgagatcctggtgaagctgtttgcccggggcgtgtgggccggcagcttctccttcctgggggacccctggaactggctggacttctctgtgacagtgtttgaggtgatcatccgctacagccccctggacttcatccccaccctgcagacagcccggaccctgcgcatcctgaagatcatccccctgaaccagggcctgaagagcctggtgggcgtgctgatccactgcctgaagcagctgattggagtcatcatcctgaccctcttcttcctgagcatcttcagcctcatcggcatgggcctcttcatgggcaacctgaagcacaagtgcttccgctggccccaggagaatgaaaatgagaccctgcacaacagaactggaaacccctactacatccgggagacagagaacttctactacctggagggggagagatatgccctgctgtgtggcaacagaacagatgctggccagtgcccagagggctacgtgtgtgtgaaggccggcatcaacccagaccagggcttcaccaactttgacagctttggctgggccctgtttgccctcttccggctgatggcccaggactacccagaggtgctgtaccaccagatcctgtatgccagcggcaaggtgtacatgatcttctttgtggtggtgtccttcctgttctccttctacatggccagcctcttcctgggcatcctggccatggcctatgaggaggagaagcagagggtgggggagatcagcaagaagattgagcccaagttccagcagacaggcaaggagctgcaggagggcaatgaaacagatgaggccaagaccatccagatcgagatgaagaagaggagccccatcagcacagacaccagcctggatgtgctggaggatgccaccctgcggcacaaggaggagctggagaagagcaagaagatctgccccctgtactggtacaagtttgccaagaccttcctgatctggaactgcagcccctgctggctgaagctgaaggagtttgtgcaccgcatcatcatggcccccttcacagacctcttcctgatcatctgcatcatcctgaatgtgtgcttcctgaccctggagcactaccccatgagcaagcagaccaacaccctgctgaacatcggcaacctggtgttcatcggcatcttcaccgctgagatgatcttcaagatcatcgccatgcacccctacggctacttccaggtgggctggaacatctttgacagcatgattgtgttccacggcctcatcgagctgtgcctggccaacgtggccggcatggccctgctgcggctcttcaggatgctgcgcatcttcaagctgggcaagtactggcccaccttccagatcctgatgtggagcctgagcaacagctgggtggccctgaaggacctggtgctgctgctcttcaccttcatcttcttctctgctgccttcggcatgaagctgtttgggaagaactatgaggagtttgtgtgccacatcgacaaggactgccagctgccccgctggcacatgcatgacttcttccacagcttcctgaatgtgttccgcatcctgtgtggggagtgggtggagaccctgtgggactgcatggaggtggccggccagagctggtgcatccccttctacctgatggtgatcctgattggcaacctgctggtgctgtacctgttcctggccctggtgagcagcttcagcagctgcaaggatgtgacagcagaagaaaataatgaggccaagaacctgcagctggccgtggcccgcatcaagaagggcatcaactacgtgctgctgaagatcctgtgcaagacccagaatgtgcccaaggacaccatggaccacgtgaatgaggtgtatgtgaaggaggacatcagtgaccacaccctgtctgagctgagcaacacccaggacttcctgaaggacaaggagaagagcagcggcacagagaagaatgccacagaaaatgaaagccagagcctcatccccagccccagcgtgtctgaaacagtgcccatcgccagcggggagagtgacatcgagaacctggacaacaaggagatccagagcaagtctggagatggcggcagcaaggagaagatcaagcagagcagcagcagtgaatgttccacagtggacatcgccatcagcgaggaggaggagatgttttatggaggagagaggagcaagcacctgaagaatggctgccggcggggcagcagcctgggccagatcagcggggccagcaagaagggcaagatctggcagaacatcaggaagacctgctgcaagatcgtggagaacaactggttcaagtgcttcatcggcctggtgaccctgctgagcacaggcaccctggcctttgaggacatctacatggaccagaggaagaccatcaagatcctgctggagtatgctgacatgatcttcacctacatcttcatcctggagatgctgctgaagtggatggcctacggcttcaaggcctacttcagcaatggctggtaccgcctggactttgtggtggtgattgtgttctgcctgagcctcatcggcaagacccgggaggagctgaagcccctcatctccatgaagttcctgcggcccctgcgggtgctgagccagtttgagaggatgaaggtggtggtgcgggccctgatcaagaccaccctgcccaccctgaatgtgttcctggtgtgcctgatgatctggctgatcttcagcatcatgggcgtggacctgtttgctggccgcttctatgagtgcatcgaccccaccagcggggagcgcttccccagcagcgaggtgatgaacaagagccgctgtgagagcctgctcttcaatgaatccatgctgtgggagaatgccaagatgaactttgacaacgtgggcaatggcttcctgagcctgctgcaggtggccaccttcaacggctggatcaccatcatgaacagcgccatcgacagcgtggccgtgaacatccagccccactttgaggtgaacatctacatgtactgctacttcatcaacttcatcatctttggagtcttcctgcccctgtccatgctgatcaccgtcatcatcgacaacttcaacaagcacaagatcaagctgggcggcagcaacatcttcatcaccgtgaagcagaggaagcagtacagaaggctgaagaagctgatgtatgaggacagccagaggcctgtgccccggcccctgaacaagctgcagggcttcatctttgatgtggtgaccagccaggccttcaacgtcatcgtgatggtgctgatctgcttccaggccatcgccatgatgattgacacagatgtgcagagcctgcagatgagcatcgccctgtactggatcaacagcatctttgtgatgctgtacaccatggagtgcatcctgaagctgattgccttccgctgcttctacttcaccatcgcctggaacatctttgacttcatggtggtgatcttcagcatcaccggcctgtgcctgcccatgacagtgggcagctacctggtgccccccagcctggtgcagctgatcctgctgagccgcatcatccacatgctgcggctgggcaagggccccaaggtgttccacaacctgatgctgcccctgatgctgagcctgcctgccctgctgaacatcatcctgctgatcttcctggtgatgttcatctatgctgtgtttggcatgtacaactttgcctacgtgaagaaggaggccggcatcaatgatgtgagcaactttgagaccttcggcaacagcatgctgtgcctcttccaggtggccatctttgctggctgggatggcatgctggatgccatcttcaacagcaagtggagcgactgtgaccctgacaagatcaaccctggcacccaggtgcggggggactgtggcaaccccagcgtgggcatcttctactttgtgtcctacatcctgatctcctggctgatcatcgtgaacatgtacatcgtggtggtgatggagttcctgaacatcgccagcaagaagaagaacaagaccctgtctgaagatgacttcaggaagttcttccaggtgtggaagagatttgatcctgacaggacccagtacatcgacagcagcaagctgagtgactttgctgctgccctggaccccccactcttcatggccaagcccaacaagggccagctgattgccctggacctgcccatggctgtgggggaccgcatccactgcctggacatcctgctggccttcaccaagagggtgatgggccaggatgtgaggatggagaaggtggtgtctgaaattgaaagtggcttcctgctggccaaccccttcaagatcacctgtgagcccatcaccaccaccctgaagaggaagcaggaggccgtgtctgccaccatcatccagagggcctacaagaactaccgcctgcggagaaatgacaagaacaccagtgacatccacatgattgatggagacagagatgtgcacgccaccaaggagggcgcctactttgacaaggccaaggagaagagccccatccagagccagatctag

SEQ ID NO: 170120 - DNA, 5049 bp, Artificial Sequence; identical to SEQ ID NO: 170119
  Description of Artificial Sequence: Synthetic coding sequence

SEQ ID NO: 170121 - DNA, 2592 bp, Artificial Sequence
  Description of Artificial Sequence: Synthetic coding sequence
atgctggccagccctgagcccaagggcctggtgcccttcaccaaggagagctttgagctgatcaagcagcacatcgccaagacccacaatgaagatcatgaggaggaggacctgaagcccaccccagacctggaggtgggcaagaagctgcccttcatctacggcaacctgagccagggcatggtgtctgagcccctggaggatgtggacccctactactacaagaagaagaacaccttcatcgtgctgaacaagaacagaaccatcttccgcttcaatgctgccagcatcctgtgcaccctgagccccttcaactgcatccggaggaccaccatcaaggtgctggtgcaccccttcttccagctgttcatcctgatctctgtgctgattgactgtgtgttcatgagcctgaccaacctgcccaagtggaggcctgtgctggagaacaccctgctgggcatctacacctttgagatcctggtgaagctgtttgcccggggcgtgtgggccggcagcttctccttcctgggggacccctggaactggctggacttctctgtgacagtgtttgaggtgatcatccgctacagccccctggacttcatccccaccctgcagacagcccggaccctgcgcatcctgaagatcatccccctgaaccagggcctgaagagcctggtgggcgtgctgatccactgcctgaagcagctgattggagtcatcatcctgaccctcttcttcctgagcatcttcagcctcatcggcatgggcctcttcatgggcaacctgaagcacaagtgcttccgctggccccaggagaatgaaaatgagaccctgcacaacagaactggaaacccctactacatccgggagacagagaacttctactacctggagggggagagatatgccctgctgtgtggcaacagaacagatgctggccagtgcccagagggctacgtgtgtgtgaaggccggcatcaacccagaccagggcttcaccaactttgacagctttggctgggccctgtttgccctcttccggctgatggcccaggactacccagaggtgctgtaccaccagatcctgtatgccagcggcaaggtgtacatgatcttctttgtggtggtgtccttcctgttctccttctacatggccagcctcttcctgggcatcctggccatggcctatgaggaggagaagcagagggtgggggagatcagcaagaagattgagcccaagttccagcagacaggcaaggagctgcaggagggcaatgaaacagatgaggccaagaccatccagatcgagatgaagaagaggagccccatcagcacagacaccagcctggatgtgctggaggatgccaccctgcggcacaaggaggagctggagaagagcaagaagatctgccccctgtactggtacaagtttgccaagaccttcctgatctggaactgcagcccctgctggctgaagctgaaggagtttgtgcaccgcatcatcatggcccccttcacagacctcttcctgatcatctgcatcatcctgaatgtgtgcttcctgaccctggagcactaccccatgagcaagcagaccaacaccctgctgaacatcggcaacctggtgttcatcggcatcttcaccgctgagatgatcttcaagatcatcgccatgcacccctacggctacttccaggtgggctggaacatctttgacagcatgattgtgttccacggcctcatcgagctgtgcctggccaacgtggccggcatggccctgctgcggctcttcaggatgctgcgcatcttcaagctgggcaagtactggcccaccttccagatcctgatgtggagcctgagcaacagctgggtggccctgaaggacctggtgctgctgctcttcaccttcatcttcttctctgctgccttcggcatgaagctgtttgggaagaactatgaggagtttgtgtgccacatcgacaaggactgccagctgccccgctggcacatgcatgacttcttccacagcttcctgaatgtgttccgcatcctgtgtggggagtgggtggagaccctgtgggactgcatggaggtggccggccagagctggtgcatccccttctacctgatggtgatcctgattggcaacctgctggtgctgtacctgttcctggccctggtgagcagcttcagcagctgcaaggatgtgacagcagaagaaaataatgaggccaagaacctgcagctggccgtggcccgcatcaagaagggcatcaactacgtgctgctgaagatcctgtgcaagacccagaatgtgcccaaggacaccatggaccacgtgaatgaggtgtatgtgaaggaggacatcagtgaccacaccctgtctgagctgagcaacacccaggacttcctgaaggacaaggagaagagcagcggcacagagaagaatgccacagaaaatgaaagccagagcctcatccccagccccagcgtgtctgaaacagtgcccatcgccagcggggagagtgacatcgagaacctggacaacaaggagatccagagcaagtctggagatggcggcagcaagtag

SEQ ID NO: 170122 - DNA, 1209 bp, Artificial Sequence
  Description of Artificial Sequence: Synthetic coding sequence
atgctggccagccctgagcccaagggcctggtgcccttcaccaaggagagctttgagctgatcaagcagcacatcgccaagacccacaatgaagatcatgaggaggaggacctgaagcccaccccagacctggaggtgggcaagaagctgcccttcatctacggcaacctgagccagggcatggtgtctgagcccctggaggatgtggacccctactactacaagaagaagaacaccttcatcgtgctgaacaagaacagaaccatcttccgcttcaatgctgccagcatcctgtgcaccctgagccccttcaactgcatccggaggaccaccatcaaggtgctggtgcaccccttcttccagctgttcatcctgatctctgtgctgattgactgtgtgttcatgagcctgaccaacctgcccaagtggaggcctgtgctggagaacaccctgctgggcatctacacctttgagatcctggtgaagctgtttgcccggggcgtgtgggccggcagcttctccttcctgggggacccctggaactggctggacttctctgtgacagtgtttgaggtgatcatccgctacagccccctggacttcatccccaccctgcagacagcccggaccctgcgcatcctgaagatcatccccctgaaccagggcctgaagagcctggtgggcgtgctgatccactgcctgaagcagctgattggagtcatcatcctgaccctcttcttcctgagcatcttcagcctcatcggcatgggcctcttcatgggcaacctgaagcacaagtgcttccgctggccccaggagaatgaaaatgagaccctgcacaacagaactggaaacccctactacatccgggagacagagaacttctactacctggagggggagagatatgccctgctgtgtggcaacagaacagatgctggccagtgcccagagggctacgtgtgtgtgaaggccggcatcaacccagaccagggcttcaccaactttgacagctttggctgggccctgtttgccctcttccggctgatggcccaggactacccagaggtgctgtaccaccagatcctgtatgccagcggcaaggtgtacatgatcttctttgtggtggtgtccttcctgttctccttctacatggccagcctcttcctgggcatcctggccatggcctatgaggaggagaagcagtag

SEQ ID NO: 170123 - DNA, 5871 bp, Artificial Sequence
  Description of Artificial Sequence: Synthetic coding sequence
atggagttccccatcggcagcctggagaccaacaacttccgccgcttcaccccagagagcctggtggagattgagaagcagattgctgccaagcagggcaccaagaaggcccgggagaagcaccgggagcagaaggaccaggaggagaagccccggccccagctggacctgaaggcctgcaaccagctgcccaagttctatggagagctgcctgctgagctgattggagagcccctggaggacctggaccccttctacagcacccacaggaccttcatggtgctgaacaagggccgcaccatcagccgcttcagcgccacccgggccctgtggctgttcagccccttcaacctgatccggaggacagccatcaaggtgtctgtgcacagctggttcagcctcttcatcaccgtgaccatcctggtgaactgtgtgtgcatgaccaggacagacctgcctgagaagattgaatatgtgttcaccgtcatctacacctttgaggccctgatcaagatcctggcccggggcttctgcctgaatgagttcacctacctgcgggacccctggaactggctggacttcagcgtcatcaccctggcctacgtgggcacagccatcgacctgcggggcatcagcggcctgcggaccttccgggtgctgcgggccctgaagacagtgtctgtcatccctggcctgaaggtgattgtgggcgccctgatccacagcgtgaagaagctggctgatgtgaccatcctgaccatcttctgcctgtctgtgtttgccctggtgggcctgcagctgttcaagggcaacctgaagaacaagtgtgtgaagaatgacatggctgtgaatgagaccaccaactacagcagccacaggaagccagacatctacatcaacaagaggggcaccagtgaccccctgctgtgtggaaatggaagtgacagcggccactgcccagatggctacatctgcctgaagaccagtgacaacccagacttcaactacaccagctttgacagctttgcctgggccttcctgagcctcttccggctgatgacccaggacagctgggagcggctgtaccagcagaccctgcggaccagcggcaagatctacatgatcttctttgtgctggtgatcttcctgggcagcttctacctggtgaacctgatcctggccgtggtgaccatggcctatgaggagcagaaccaggccaccacagatgaaattgaggccaaggagaagaagttccaggaggccctggagatgctgaggaaggagcaggaggtgctggccgccctgggcatcgacaccaccagcctgcacagccacaacggcagccccctgaccagcaagaatgccagcgagcggcggcaccgcatcaagccccgggtgtctgagggcagcacagaggacaacaagagccccaggagtgacccctacaaccagaggaggatgtccttcctgggcctggccagcggcaagagaagagccagccacggctctgtgttccacttccgcagccctggccgggacatcagcctgcctgagggcgtgacagatgatggagtcttccctggggaccacgagagccaccggggcagcctgctgctgggcggcggggccggccagcagggccccctgcccaggagccccctgccccagcccagcaacccagacagccgccacggggaggatgagcaccagcccccacccaccagcgagctggcccctggagctgtggatgtgtctgcctttgatgctggccagaagaagaccttcctgtctgctgagtacctggatgagcccttccgggcccagagggccatgtctgtggtgtccatcatcacctctgtgctggaggagctggaggagagcgagcagaagtgccccccctgcctgaccagcctgagccagaagtacctgatctgggactgctgccccatgtgggtgaagctgaagaccatcctgtttggcctggtgacagacccctttgctgagctgaccatcaccctgtgcatcgtggtgaacaccatcttcatggccatggagcaccacggcatgagccccacctttgaggccatgctgcagatcggcaacatcgtgttcaccatcttcttcaccgctgagatggtgttcaagatcatcgcctttgacccctactactacttccagaagaagtggaacatctttgactgcatcatcgtgacagtgtccctgctggagctgggcgtggccaagaagggcagcctgtctgtgctgcgctccttccggctgctgcgggtcttcaagctggccaagtcctggcccaccctgaacaccctcatcaagatcatcggcaacagcgtgggcgccctgggcaacctgaccatcatcctggccatcatcgtgtttgtgtttgccctggtgggcaagcagctgctgggggagaactacagaaacaacaggaagaacatcagcgcccctcatgaggactggccccgctggcacatgcatgacttcttccacagcttcctgattgtgttccgcatcctgtgtggggagtggattgagaacatgtgggcctgcatggaggtgggccagaagagcatctgcctgatcctcttcctgactgtgatggtgctgggcaacctggtggtgctgaacctcttcatcgccctgctgctgaacagcttctctgctgacaacctgacagccccagaagatgatggagaggtgaacaacctgcaggtggccctggcccgcatccaggtgtttggccacaggaccaagcaggccctgtgcagcttcttcagccgcagctgccccttcccccagcccaaggccgagcctgagctggtggtgaagctgcccctgagcagcagcaaggccgagaaccacatcgccgccaacacagcccggggcagcagcggcggcctgcaggccccccggggccccagagatgagcacagcgacttcatcgccaaccccaccgtgtgggtgtctgtgcccatcgccgagggggagagtgacctggatgacctggaggatgatggaggagaagatgcccagagcttccagcaggaggtgatccccaagggccagcaggagcagctgcagcaggtggagcgctgtggggaccacctgacccccaggagccctggcaccggcaccagcagcgaggacctggcccccagcctgggggagacctggaaggatgaatctgtgccccaggtgcctgctgagggcgtggatgacaccagcagcagcgagggcagcacagtggactgcctggaccctgaggagatcctgaggaagatccctgagctggctgatgacctggaggagccagatgactgcttcacagagggctgcatccgccactgcccctgctgcaagctggacaccaccaagagcccctgggatgtgggctggcaggtgaggaagacctgctaccgcatcgtggagcacagctggtttgagagcttcatcatcttcatgatcctgctgagcagcggcagcctggcctttgaggactactacctggaccagaagcccaccgtgaaggccctgctggagtacacagacagagtcttcaccttcatctttgtgtttgagatgctgctgaagtgggtggcctacggcttcaagaagtacttcaccaatgcctggtgctggctggacttcctgattgtgaacatcagcctcatcagcctgacagccaagatcctggagtacagcgaggtggcccccatcaaggccctgcggaccctgcgggccctgcggcccctgcgggccctgagcagatttgagggcatgagggtggtggtggatgccctggtgggcgccatccccagcatcatgaatgtgctgctggtgtgcctgatcttctggctgatcttcagcatcatgggcgtgaacctgtttgctgggaagttctggcgctgcatcaactacacagatggagagttcagcctggtgcccctgagcatcgtgaacaacaagagtgactgcaagatccagaacagcacaggcagcttcttctgggtgaatgtgaaggtgaactttgacaacgtggccatgggctacctggccctgctgcaggtggccaccttcaagggctggatggacatcatgtatgctgctgtggacagccgggaggtgaacatgcagcccaagtgggaggacaacgtgtacatgtacctgtacttcgtcatcttcatcatctttggaggcttcttcaccctgaacctgtttgtgggcgtcatcatcgacaacttcaaccagcagaagaagaagctgggcggccaggacatcttcatgacagaggagcagaagaagtactacaatgccatgaagaagctgggcagcaagaagccccagaagcccatcccccggcccctgaacaagttccagggctttgtgtttgacatcgtgacccggcaggcctttgacatcaccatcatggtgctgatctgcctgaacatgatcaccatgatggtggagacagatgaccagagcgaggagaagaccaagatcctgggcaagatcaaccagttctttgtggccgtgttcaccggggagtgtgtgatgaagatgtttgccctgcggcagtactacttcaccaacggctggaatgtgtttgacttcatcgtggtggtgctgagcatcgccagcctcatcttcagcgccatcctgaagagcctgcagagctacttcagccccaccctcttccgggtcatccggctggcccgcatcggccgcatcctgcggctcatccgggccgccaagggcatccgcaccctgctgtttgccctgatgatgagcctgcctgccctcttcaacatcggcctgctgctcttcctggtgatgttcatctacagcatcttcggcatgagcagcttcccccacgtgcgctgggaggccggcattgatgacatgttcaacttccagacctttgccaacagcatgctgtgcctcttccagatcaccaccagcgctggctgggatggcctgctgagccccatcctgaacacaggccccccctactgtgaccccaacctgcccaacagcaatggcaccaggggggactgtggcagccctgctgtgggcatcatcttcttcaccacctacatcatcatctccttcctgatcatggtgaacatgtacatcgctgtgatcctggagaacttcaacgtggccacagaggagagcacagagcccctgtctgaagatgactttgacatgttttatgagacctgggagaagtttgatcctgaggccacccagttcatcaccttcagcgccctgagtgactttgctgacaccctgagcggccccctgcgcatccccaagcccaacagaaacatcctgatccagatggacctgcccctggtgcctggggacaagatccactgcctggacatcctgtttgccttcaccaagaatgtgctgggggagagcggggagctggacagcctgaaggccaacatggaggagaagttcatggccaccaacctgagcaagagcagctatgagcccatcgccaccaccctgcgctggaagcaggaggacatcagcgccaccgtcatccagaaggcctaccgctcctatgtgctgcaccgctccatggccctgagcaacaccccctgtgtgcccagggctgaggaggaggccgccagcctgcctgatgagggctttgtggccttcaccgccaatgaaaactgtgtgctgcctgacaagtcagaaacagccagcgccaccagcttcccccccagctatgaatctgtgacccggggcctgagtgacagagtgaacatgaggaccagcagcagcatccagaatgaagatgaggccacctccatggagctgattgcccctggcccctag

SEQ ID NO: 170124 - DNA, 5376 bp, Artificial Sequence
  Description of Artificial Sequence: Synthetic coding sequence
atggatgaccgctgctaccctgtgatcttcccagatgagaggaacttccggcccttcaccagtgacagcctggccgccatcgagaagagaattgccatccagaaggagaagaagaagagcaaggaccagacaggagaggtgccccagccccggccccagctggacctgaaggccagcaggaagctgcccaagctgtatggagacatcccccgggagctgattggcaagcccctggaggacctggaccccttctacagaaaccacaagaccttcatggtgctgaacaggaagaggaccatctaccgcttcagcgccaagcacgccctcttcatcttcggccccttcaacagcatccgcagcctggccatccgggtgtctgtgcacagcctcttctccatgttcatcatcggcaccgtcatcatcaactgtgtgttcatggccaccggccctgccaagaacagcaacagcaacaacacagacattgctgaatgtgtgttcaccggcatctacatctttgaggccctgatcaagatcctggcccggggcttcatcctggatgagttctccttcctgcgggacccctggaactggctggacagcatcgtgattggaattgccatcgtgtcctacatccctggcatcaccatcaagctgctgcccctgcggaccttccgggtcttccgggccctgaaggccatctctgtggtgtcccggctgaaggtgattgtgggcgccctgctgcggtctgtgaagaagctggtgaatgtcatcatcctgaccttcttctgcctgagcatctttgccctggtgggccagcagctgttcatgggcagcctgaacctgaagtgcatcagccgggactgcaagaacatcagcaaccctgaggcctatgaccactgctttgagaagaaggagaacagccctgagttcaagatgtgtggcatctggatgggcaacagcgcctgcagcatccagtatgagtgcaagcacaccaagatcaacccagactacaactacaccaactttgacaactttggctggagcttcctggccatgttccggctgatgacccaggacagctgggagaagctgtaccagcagaccctgcggaccaccggcctgtacagcgtcttcttcttcatcgtggtgatcttcctgggcagcttctacctgatcaacctgaccctggccgtggtgaccatggcctatgaggagcagaacaagaatgtggccgctgagattgaggccaaggagaagatgttccaggaggcccagcagctgctgaaggaggagaaggaggccctggtggccatgggcatcgacaggagcagcctgaccagcctggagaccagctacttcacccccaagaagaggaagctgtttggaaacaagaagaggaagagcttcttcctgcgggagagcggcaaggaccagcccccaggcagtgacagtgatgaggactgccagaagaagccccagctgctggagcagaccaagaggctgagccagaacctgagcctggaccactttgatgaacatggagaccccctgcagaggcagagggccctgtctgctgtgtccatcctgaccatcaccatgaaggagcaggagaagagccaggagccctgcctgccctgtggggagaacctggccagcaagtacctggtgtggaactgctgcccccagtggctgtgtgtgaagaaggtgctgaggacagtgatgacagaccccttcacagagctggccatcaccatctgcatcatcatcaacacagtgttcctggccatggagcaccacaagatggaggccagctttgagaagatgctgaacatcggcaacctggtgttcaccagcatcttcatcgccgagatgtgcctgaagatcatcgccctggacccctaccactacttccggcggggctggaacatctttgacagcatcgtggccctgctgagctttgctgatgtgatgaactgtgtgctgcagaagaggtcctggcccttcctgcgctccttccgggtgctgcgggtcttcaagctggccaagtcctggcccaccctgaacaccctcatcaagatcatcggcaacagcgtgggcgccctgggcagcctgactgtggtgctggtgattgtcatcttcatcttctctgtggtgggcatgcagctgtttggccgctccttcaacagccagaagagccccaagctgtgcaaccccaccggccccaccgtgtcctgcctgcggcactggcacatgggagacttctggcacagcttcctggtggtgttccgcatcctgtgtggggagtggattgagaacatgtgggagtgcatgcaggaggccaatgccagcagcagcctgtgtgtgattgtgttcatcctgatcaccgtgattggcaagctggtggtgctgaacctcttcatcgccctgctgctgaacagcttcagcaatgaggagagaaatggaaacctggagggggaggccaggaagaccaaggtgcagctggccctggaccgcttccggcgggccttctgctttgtgcgccacaccctggagcacttctgccacaagtggtgcaggaagcagaacctgccccagcagaaggaggtggccggcggctgtgccgcccagagcaaggacatcatccccctggtgatggagatgaagaggggcagcgagacccaggaggagctgggcatcctgacctctgtgcccaagaccctgggcgtgagacatgactggacctggctggcccccctggccgaggaggaggatgatgtggagttctctggagaagataatgcccagaggatcacccagcctgagcctgagcagcaggcctatgagctgcaccaggagaacaagaagcccaccagccagagggtgcagagcgtggagattgacatgttttctgaagatgagccccacctgaccatccaggaccccaggaagaagagtgatgtgaccagcatcctgtctgaatgttccaccatcgacctgcaggacggcttcggctggctgcctgagatggtgcccaagaagcagcctgagcgctgcctgcccaagggcttcggctgctgcttcccctgctgcagcgtggacaagaggaagccaccctgggtgatctggtggaacctgaggaagacctgctaccagatcgtgaagcacagctggtttgagagcttcatcatcttcgtcatcctgctgagcagcggggccctgatctttgaagatgtgcacctggagaaccagcccaagatccaggagctgctgaactgcacagacatcatcttcacccacatcttcatcctggagatggtgctgaagtgggtggccttcggctttgggaagtacttcaccagcgcctggtgctgcctggacttcatcatcgtgattgtgtctgtgaccaccctcatcaacctgatggagctgaagagcttccgcaccctgcgggccctgcggcccctgcgggccctgagccagtttgagggcatgaaggtggtggtgaatgccctgattggagccatcccagccatcctgaatgtgctgctggtgtgcctgatcttctggctggtgttctgcatcctgggcgtgtacttcttcagcggcaagtttgggaagtgcatcaatggaacagattctgtcatcaactacaccatcatcaccaacaagagccagtgtgagagcggcaacttctcctggatcaaccagaaggtgaactttgacaacgtgggcaatgcctacctggccctgctgcaggtggccaccttcaagggctggatggacatcatctatgctgctgtggacagcacagagaaggagcagcagcctgagtttgagagcaacagcctgggctacatctactttgtggtgttcatcatcttcggcagcttcttcaccctgaacctcttcatcggggtcatcatcgacaacttcaaccagcagcagaagaagctgggcggccaggacatcttcatgacagaggagcagaagaagtactacaatgccatgaagaagctgggcagcaagaagccccagaagcccatcccccggcccctgaacaagtgccagggcctggtgtttgacatcgtgaccagccagatctttgacatcatcatcatcagcctcatcatcctgaacatgatctccatgatggccgagagctacaaccagcccaaggccatgaagagcatcctggaccacctgaactgggtgtttgtggtgatcttcaccctggagtgcctgatcaagatctttgccctgcggcagtactacttcaccaacggctggaacctgtttgactgtgtggtggtgctgctgagcatcgtgtccaccatgatcagcaccctggagaaccaggagcacatccccttcccccccaccctcttccgcatcgtgcggctggcccgcatcggccgcatcctgcggctggtgcgggccgcccggggcatccgcaccctgctgtttgccctgatgatgagcctgcccagcctcttcaacatcggcctgctgctcttcctgatcatgttcatctatgccatcctgggcatgaactggttcagcaaggtgaaccctgagagcggcattgatgacatcttcaacttcaagacctttgccagctccatgctgtgcctcttccagatcagcaccagcgctggctgggacagcctgctgagccccatgctgcggagcaaggagagctgcaacagcagcagcgagaactgccacctgcccggcatcgccaccagctactttgtgtcctacatcatcatctccttcctgattgtggtgaacatgtacatcgctgtgatcctggagaacttcaacacagccacagaggagagcgaggaccccctgggggaggatgactttgacatcttctatgaggtgtgggagaagtttgatcctgaggccacccagttcatcaagtacagcgccctgagtgactttgctgatgccctgcctgagcccctgcgggtggccaagcccaacaagtaccagttcctggtgatggacctgcccatggtgtctgaagatcggctgcactgcatggacatcctgtttgccttcaccgcccgggtgctgggcggcagtgatggcctggacagcatgaaggccatgatggaggagaagttcatggaggccaaccccctgaagaagctgtatgagcccatcgtgaccaccaccaagaggaaggaggaggagagaggagctgccatcatccagaaggccttcaggaagtacatgatgaaggtgaccaagggggaccagggcgaccagaatgacctggagaatggcccccacagccccctgcagaccctgtgcaatggagacctgagcagctttggagtggccaagggcaaggtgcactgtgactag

SEQ ID NO: 170125 - DNA, 4335 bp, Artificial Sequence
  Description of Artificial Sequence: Synthetic coding sequence
atggatgaccgctgctaccctgtgatcttcccagatgagaggaacttccggcccttcaccagtgacagcctggccgccatcgagaagagaattgccatccagaaggagaagaagaagagcaaggaccagacaggagaggtgccccagccccggccccagctggacctgaaggccagcaggaagctgcccaagctgtatggagacatcccccgggagctgattggcaagcccctggaggacctggaccccttctacagaaaccacaagaccttcatggtgctgaacaggaagaggaccatctaccgcttcagcgccaagcacgccctcttcatcttcggccccttcaacagcatccgcagcctggccatccgggtgtctgtgcacagcctcttctccatgttcatcatcggcaccgtcatcatcaactgtgtgttcatggccaccggccctgccaagaacagcaacagcaacaacacagacattgctgaatgtgtgttcaccggcatctacatctttgaggccctgatcaagatcctggcccggggcttcatcctggatgagttctccttcctgcgggacccctggaactggctggacagcatcgtgattggaattgccatcgtgtcctacatccctggcatcaccatcaagctgctgcccctgcggaccttccgggtcttccgggccctgaaggccatctctgtggtgtcccggctgaaggtgattgtgggcgccctgctgcggtctgtgaagaagctggtgaatgtcatcatcctgaccttcttctgcctgagcatctttgccctggtgggccagcagctgttcatgggcagcctgaacctgaagtgcatcagccgggactgcaagaacatcagcaaccctgaggcctatgaccactgctttgagaagaaggagaacagccctgagttcaagatgtgtggcatctggatgggcaacagcgcctgcagcatccagtatgagtgcaagcacaccaagatcaacccagactacaactacaccaactttgacaactttggctggagcttcctggccatgttccggctgatgacccaggacagctgggagaagctgtaccagcagaccctgcggaccaccggcctgtacagcgtcttcttcttcatcgtggtgatcttcctgggcagcttctacctgatcaacctgaccctggccgtggtgaccatggcctatgaggagcagaacaagaatgtggccgctgagattgaggccaaggagaagatgttccaggaggcccagcagctgctgaaggaggagaaggaggccctggtggccatgggcatcgacaggagcagcctgaccagcctggagaccagctacttcacccccaagaagaggaagctgtttggaaacaagaagaggaagagcttcttcctgcgggagagcggcaaggaccagcccccaggcagtgacagtgatgaggactgccagaagaagccccagctgctggagcagaccaagaggctgagccagaacctgagcctggaccactttgatgaacatggagaccccctgcagaggcagagggccctgtctgctgtgtccatcctgaccatcaccatgaaggagcaggagaagagccaggagccctgcctgccctgtggggagaacctggccagcaagtacctggtgtggaactgctgcccccagtggctgtgtgtgaagaaggtgctgaggacagtgatgacagaccccttcacagagctggccatcaccatctgcatcatcatcaacacagtgttcctggccatggagcaccacaagatggaggccagctttgagaagatgctgaacatcggcaacctggtgttcaccagcatcttcatcgccgagatgtgcctgaagatcatcgccctggacccctaccactacttccggcggggctggaacatctttgacagcatcgtggccctgctgagctttgctgatgtgatgaactgtgtgctgcagaagaggtcctggcccttcctgcgctccttccgggtgctgcgggtcttcaagctggccaagtcctggcccaccctgaacaccctcatcaagatcatcggcaacagcgtgggcgccctgggcagcctgactgtggtgctggtgattgtcatcttcatcttctctgtggtgggcatgcagctgtttggccgctccttcaacagccagaagagccccaagctgtgcaaccccaccggccccaccgtgtcctgcctgcggcactggcacatgggagacttctggcacagcttcctggtggtgttccgcatcctgtgtggggagtggattgagaacatgtgggagtgcatgcaggaggccaatgccagcagcagcctgtgtgtgattgtgttcatcctgatcaccgtgattggcaagctggtggtgctgaacctcttcatcgccctgctgctgaacagcttcagcaatgaggagagaaatggaaacctggagggggaggccaggaagaccaaggtgcagctggccctggaccgcttccggcgggccttctgctttgtgcgccacaccctggagcacttctgccacaagtggtgcaggaagcagaacctgccccagcagaaggaggtggccggcggctgtgccgcccagagcaaggacatcatccccctggtgatggagatgaagaggggcagcgagacccaggaggagctgggcatcctgacctctgtgcccaagaccctgggcgtgagacatgactggacctggctggcccccctggccgaggaggaggatgatgtggagttctctggagaagataatgcccagaggatcacccagcctgagcctgagcagcaggcctatgagctgcaccaggagaacaagaagcccaccagccagagggtgcagagcgtggagattgacatgttttctgaagatgagccccacctgaccatccaggaccccaggaagaagagtgatgtgaccagcatcctgtctgaatgttccaccatcgacctgcaggacggcttcggctggctgcctgagatggtgcccaagaagcagcctgagcgctgcctgcccaagggcttcggctgctgcttcccctgctgcagcgtggacaagaggaagccaccctgggtgatctggtggaacctgaggaagacctgctaccagatcgtgaagcacagctggtttgagagcttcatcatcttcgtcatcctgctgagcagcggggccctgatctttgaagatgtgcacctggagaaccagcccaagatccaggagctgctgaactgcacagacatcatcttcacccacatcttcatcctggagatggtgctgaagtgggtggccttcggctttgggaagtacttcaccagcgcctggtgctgcctggacttcatcatcgtgattgtgtctgtgaccaccctcatcaacctgatggagctgaagagcttccgcaccctgcgggccctgcggcccctgcgggccctgagccagtttgagggcatgaaggtggtggtgaatgccctgattggagccatcccagccatcctgaatgtgctgctggtgtgcctgatcttctggctggtgttctgcatcctgggcgtgtacttcttcagcggcaagtttgggaagtgcatcaatggaacagattctgtcatcaactacaccatcatcaccaacaagagccagtgtgagagcggcaacttctcctggatcaaccagaaggtgaactttgacaacgtgggcaatgcctacctggccctgctgcaggtggccaccttcaagggctggatggacatcatctatgctgctgtggacagcacagagaaggagcagcagcctgagtttgagagcaacagcctgggctacatctactttgtggtgttcatcatcttcggcagcttcttcaccctgaacctcttcatcggggtcatcatcgacaacttcaaccagcagcagaagaagctgggcggccaggacatcttcatgacagaggagcagaagaagtactacaatgccatgaagaagctgggcagcaagaagccccagaagcccatcccccggcccctgaacaagtgccagggcctggtgtttgacatcgtgaccagccagatctttgacatcatcatcatcagcctcatcatcctgaacatgatctccatgatggccgagagctacaaccagcccaaggccatgaagagcatcctggaccacctgaactgggtgtttgtggtgatcttcaccctggagtgcctgatcaagatctttgccctgcggcagtactacttcaccaacggctggaacctgtttgactgtgtggtggtgctgctgagcatcgtgtccaagtag

SEQ ID NO: 170126 - DNA, 5376 bp, Artificial Sequence; identical to SEQ ID NO: 170124
  Description of Artificial Sequence: Synthetic coding sequence

SEQ ID NO: 170127 - DNA, 5217 bp, Artificial Sequence
  Description of Artificial Sequence: Synthetic coding sequence
atgctgaagaggaagcagagcagccgggtggaggcccagcctgtgacagactttggaccagatgagagcctgagtgacaatgctgacatcctgtggatcaacaagccctgggtgcacagcctgctgcgcatctgtgccatcatcagcgtcatctctgtgtgcatgaacacccccatgacctttgagcactacccacccctgcagtatgtgaccttcaccctggacaccctgctgatgttcctgtacacagctgagatgattgccaagatgcacatccggggcatcgtgaagggggacagcagctatgtgaaggaccgctggtgtgtgtttgatggcttcatggtgttctgcctgtgggtgtccctggtgctgcaggtgtttgaaattgctgacatcgtggaccagatgagcccctggggcatgctgcgcatcccccggcccctcatcatgatccgggccttccgcatctacttccgctttgagctgcccaggacccgcatcaccaacatcctgaagaggtctggagagcagatctggagcgtgtccatcttcctgctcttcttcctgctgctgtatggcatcctgggcgtgcagatgtttggcaccttcacctaccactgtgtggtgaatgacaccaagccaggaaatgtgacctggaacagcctggccatcccagacacccactgcagccctgagctggaggagggctaccagtgccccccaggcttcaagtgcatggacctggaggacctgggcctgagccggcaggagctgggctacagcggcttcaatgagatcggcaccagcatcttcaccgtgtatgaggccgccagccaggagggctgggtgttcctgatgtaccgggccatcgacagcttcccccgctggaggagctacttctacttcatcaccctcatcttcttcctggcctggctggtgaagaatgtgttcatcgctgtgatcatcgagacctttgctgagatccgggtgcagttccagcagatgtggggcagccgcagcagcaccaccagcacagccaccacccagatgtttcatgaagatgctgctgggggctggcagctggtggccgtggatgtgaacaagccccagggccgggccccagcctgcctgcagaagatgatgaggagcagcgtcttccacatgttcatcctgtccatggtgacagtggatgtgattgtggccgccagcaactactacaagggggagaacttccggcggcagtatgatgagttctacctggccgaggtggccttcaccgtgctgtttgacctggaggccctgctgaagatctggtgcctgggcttcaccggctacatcagcagcagcctgcacaagtttgagctgctgctggtgattggcaccaccctgcacgtgtacccagacctgtaccacagccagttcacctacttccaggtgctgcgggtggtgcggctcatcaagatcagccctgccctggaggactttgtgtacaagatcttcggccctgggaagaagctgggcagcctggtggtgttcaccgccagcctgctgattgtgatgtctgccatcagcctgcagatgttctgctttgtggaggagctggaccgcttcaccaccttcccccgggccttcatgtccatgttccagatcctgacccaggagggctgggtggatgtgatggaccagaccctgaatgctgtgggccacatgtgggcccctgtggtggccatctacttcatcctgtaccacctgtttgccaccctcatcctgctgagcctgtttgtggccgtcatcctggacaacctggagctggatgaggacctgaagaagctgaagcagctgaagcagagcgaggccaatgctgacaccaaggagaagctgcccctgcggctgcgcatctttgagaagttccccaaccggccccagatggtgaagatcagcaagctgcccagcgacttcaccgtgcccaagatccgggagagcttcatgaagcagttcatcgaccggcagcagcaggacacctgctgcctgctgcggagcctgcccaccaccagcagcagcagctgtgaccacagcaagaggtctgccatcgaggacaacaagtacatcgaccagaagctgaggaagagcgtcttcagcatccgggccaggaacctgctggagaaggagacagctgtgaccaagatcctgcgggcctgcacccggcagaggatgctgagcggcagctttgagggccagcctgccaaggagaggagcatcctgtctgtgcagcaccacatccggcaggagcggcgcagcctgcggcacggcagcaacagccagaggatcagccggggcaagagcctggagaccctgacccaggaccacagcaacacagtgcgctacagaaatgcccagagagaagattctgagatcaagatgatccaggagaagaaggagcaggccgagatgaagaggaaggtgcaggaggaggagctgcgggagaaccacccctactttgacaagcccctcttcatcgtgggccgggagcaccgcttcaggaacttctgccgggtggtggtgcgggcccgcttcaatgccagcaagacagatcctgtgactggagctgtgaagaacaccaagtaccaccagctgtatgacctgctgggcctggtgacctacctggactgggtgatgatcatcgtgaccatctgcagctgcatctccatgatgtttgagagccccttccggcgggtgatgcacgcccccaccctgcagattgctgaatatgtgtttgtgatcttcatgagcattgagctgaacctgaagatcatggctgatggcctcttcttcacccccacagctgtgatccgggactttggaggagtgatggacatcttcatctacctggtgtccctcatcttcctgtgctggatgccccagaatgtgcctgctgagagcggggcccagctgctgatggtgctgcgctgcctgcggcccctgcgcatcttcaagctggtgccccagatgaggaaggtggtgcgggagctgttcagcggcttcaaggagatcttcctggtgtccatcctgctgctgaccctgatgctggtgtttgccagctttggagtgcagctgtttgctgggaagctggccaagtgcaatgaccccaacatcatcagaagagaggactgcaatggcatcttccgcatcaacgtgtctgtgtccaagaacctgaacctgaagctgcggcctggagagaagaagccaggcttctgggtgccccgggtgtgggccaaccccaggaacttcaactttgacaacgtgggcaatgccatgctggccctgtttgaggtgctgagcctgaagggctgggtggaggtgagagatgtgatcatccaccgggtgggccccatccacggcatctacatccacgtgtttgtgttcctgggctgcatgattggcctgaccctgtttgtgggcgtggtgattgccaacttcaatgaaaataaaggaacagccctgctgactgtggaccagaggcgctgggaggacctgaagagccggctgaagatcgcccagcccctgcacctgccccccaggccagacaatgatggcttccgggccaagatgtatgacatcacccagcaccccttcttcaagaggaccatcgccctgctggtgctggcccagagcgtgctgctgtctgtgaagtgggatgtggaggaccctgtgacagtgcccctggccaccatgtctgtggtgttcaccttcatctttgtgctggaggtgaccatgaagatcatcgccatgagccctgctggcttctggcagagcagaagaaacagatatgacctgctggtgaccagcctgggcgtggtgtgggtggtgctgcactttgccctgctgaatgcctacacctacatgatgggcgcctgtgtgattgtgttccgcttcttcagcatctgtgggaagcacgtgaccctgaagatgctgctgctgactgtggtggtgtccatgtacaagagcttcttcatcatcgtgggcatgttcctgctgctgctgtgctacgcctttgctggggtggtgctgtttggaacagtgaagtacggggagaacatcaacagacatgccaacttcagcagcgctgggaaggccatcaccgtgctcttcagaattgtgactggagaggactggaacaagatcatgcatgactgcatggtgcagccccccttctgcaccccagatgagttcacctactgggccacagactgtggcaactatgctggggccctgatgtacttctgcagcttctacgtgatcatcgcctacatcatgctgaacctgctggtggccatcatcgtggagaacttcagcctcttctacagcacagaggaggaccagctgctgagctacaatgacctgcggcacttccagatcatctggaacatggtggatgacaagcgggagggcgtcatccccaccttccgggtgaagttcctgctgcggctgctgcggggccgcctggaggtggacctggacaaggacaagctgctcttcaagcacatgtgctatgagatggagcggctgcacaatggaggagatgtgaccttccatgatgtgctgtccatgctgagctacagatctgtggacatcaggaagagcctgcagctggaggagctgctggcccgggagcagctggagtacaccatcgaggaggaggtggccaagcagaccatccgcatgtggctgaagaagtgcctgaagaggatccgggccaagcagcagcagagctgcagcatcatccacagcctgcgggagagccagcagcaggagctgagccgcttcctgaaccccccatccattgagaccacccagcccagcgaggacaccaatgccaacagccaggacaacagcatgcagcctgagaccagcagccagcagcagctgctgagccccaccctgagtgacagaggaggcagccggcaggatgctgctgatgctgggaagccccagaggaagtttggccagtggaggctgcccagcgcccccaagcccatcagccacagcgtgtcctctgtgaacctgcgctttggaggccgcaccaccatgaagtctgtggtgtgcaagatgaaccccatgacagatgctgccagctgtggcagcgaggtgaagaagtggtggacccggcagctgactgtggagagtgatgaaagtggagatgacctgctggacatctag

SEQ ID NO: 170128 - DNA, 2007 bp, Artificial Sequence
  Description of Artificial Sequence: Synthetic coding sequence
atgctgaagaggaagcagagcagccgggtggaggcccagcctgtgacagactttggaccagatgagagcctgagtgacaatgctgacatcctgtggatcaacaagccctgggtgcacagcctgctgcgcatctgtgccatcatcagcgtcatctctgtgtgcatgaacacccccatgacctttgagcactacccacccctgcagtatgtgaccttcaccctggacaccctgctgatgttcctgtacacagctgagatgattgccaagatgcacatccggggcatcgtgaagggggacagcagctatgtgaaggaccgctggtgtgtgtttgatggcttcatggtgttctgcctgtgggtgtccctggtgctgcaggtgtttgaaattgctgacatcgtggaccagatgagcccctggggcatgctgcgcatcccccggcccctcatcatgatccgggccttccgcatctacttccgctttgagctgcccaggacccgcatcaccaacatcctgaagaggtctggagagcagatctggagcgtgtccatcttcctgctcttcttcctgctgctgtatggcatcctgggcgtgcagatgtttggcaccttcacctaccactgtgtggtgaatgacaccaagccaggaaatgtgacctggaacagcctggccatcccagacacccactgcagccctgagctggaggagggctaccagtgccccccaggcttcaagtgcatggacctggaggacctgggcctgagccggcaggagctgggctacagcggcttcaatgagatcggcaccagcatcttcaccgtgtatgaggccgccagccaggagggctgggtgttcctgatgtaccgggccatcgacagcttcccccgctggaggagctacttctacttcatcaccctcatcttcttcctggcctggctggtgaagaatgtgttcatcgctgtgatcatcgagacctttgctgagatccgggtgcagttccagcagatgtggggcagccgcagcagcaccaccagcacagccaccacccagatgtttcatgaagatgctgctgggggctggcagctggtggccgtggatgtgaacaagccccagggccgggccccagcctgcctgcagaagatgatgaggagcagcgtcttccacatgttcatcctgtccatggtgacagtggatgtgattgtggccgccagcaactactacaagggggagaacttccggcggcagtatgatgagttctacctggccgaggtggccttcaccgtgctgtttgacctggaggccctgctgaagatctggtgcctgggcttcaccggctacatcagcagcagcctgcacaagtttgagctgctgctggtgattggcaccaccctgcacgtgtacccagacctgtaccacagccagttcacctacttccaggtgctgcgggtggtgcggctcatcaagatcagccctgccctggaggactttgtgtacaagatcttcggccctgggaagaagctgggcagcctggtggtgttcaccgccagcctgctgattgtgatgtctgccatcagcctgcagatgttctgctttgtggaggagctggaccgcttcaccaccttcccccgggccttcatgtccatgttccagatcctgacccaggagggctgggtggatgtgatggaccagaccctgaatgctgtgggccacatgtgggcccctgtggtggccatctacttcatcctgtaccacctgtttgccaccctgccccccagcctcatccgggacctgtgtggcacccaggatgcctgccccagctgcctgcccctgcagccccccaaccccctgcccggcagccagaccctggcccggctgacccaccaggccctgaccaccccacctggcatgaggagcagccagctgttcagcaagatcagcctgctgctgggcatctgtgtggcctgggagagcatcctgggcagcctgagcctgagccacaacctgaggtag

SEQ ID NO: 170129 - DNA, 657 bp, Artificial Sequence
  Description of Artificial Sequence: Synthetic coding sequence
atgctgaagaggaagcagagcagccgggtggaggcccagcctgtgacagactttggaccagatgagagcctgagtgacaatgctgacatcctgtggatcaacaagccctgggtgcacagcctgctgcgcatctgtgccatcatcagcgtcatctctgtgtgcatgaacacccccatgacctttgagcactacccacccctgcagtatgtgaccttcaccctggacaccctgctgatgttcctgtacacagctgagatgattgccaagatgcacatccggggcatcgtgaagggggacagcagctatgtgaaggaccgctggtgtgtgtttgatggcttcatggtgttctgcctgtgggtgtccctggtgctgcaggtgtttgaaattgctgacatcgtggaccagatgagcccctggggcatgctgcgcatcccccggcccctcatcatgatccgggccttccgcatctacttccgctttgagctgcccaggacccgcatcaccaacatcctgaagaggtctggagagcagatctggagcgtgtccatcttcctgctcttcttcctgctgctgtatggcatcctgggcgtgcagatgtttggcaccttcacctaccactgtgtggtgaatgacaccaagccaggcctgagcctgtag

SEQ ID NO: 170130 - DNA, 657 bp, Artificial Sequence
  Description of Artificial Sequence: Synthetic coding sequence
atgctgaagaggaagcagagcagccgggtggaggcccagcctgtgacagactttggaccagatgagagcctgagtgacaatgctgacatcctgtggatcaacaagccctgggtgcacagcctgctgcgcatctgtgccatcatcagcgtcatctctgtgtgcatgaacacccccatgacctttgagcactacccacccctgcagtatgtgaccttcaccctggacaccctgctgatgttcctgtacacagctgagatgattgccaagatgcacatccggggcatcgtgaagggggacagcagctatgtgaaggaccgctggtgtgtgtttgatggcttcatggtgttctgcctgtgggtgtccctggtgctgcaggtgtttgaaattgctgacatcgtggaccagatgagcccctggggcatgctgcgcatcccccggcccctcatcatgatccgggccttccgcatctacttccgctttgagctgcccaggacccgcatcaccaacatcctgaagaggtctggagagcagatctggagcgtgtccatcttcctgctcttcttcctgctgctgtatggcatcctgggcgtgcagatgtttggcaccttcacctaccactgtgtggtgaatgacaccaagccaggcctgagcatctag

SEQ ID NO: 170131 - DNA, 1725 bp, Artificial Sequence
  Description of Artificial Sequence: Synthetic coding sequence
atggccagcacagagggcgccaacaacatgcccaagcaggtggaggtgaggatgcatgacagccacctgggcagcgaggagcccaagcaccgccacctgggcctgcggctgtgtgacaagctgggcaagaacctgctgctgaccctgactgtgtttggagtcatcctgggcgctgtgtgtggcggcctgctgcggctggccagccccatccacccagatgtggtgatgctgattgccttccctggggacatcctgatgaggatgctgaagatgctgatcctgcccctcatcatcagcagcctcatcaccggcctgagcggcctggatgccaaggccagcggccgcctgggcacccgggccatggtgtactacatgagcaccaccatcatcgctgctgtgctgggcgtcatcctggtgctggccatccaccctggcaaccccaagctgaagaagcagctgggccctgggaagaagaatgatgaggtgagcagcctggatgccttcctggacctgatccggaacctcttccctgagaacctggtgcaggcctgcttccagcagatccagacagtgaccaagaaggtgctggtggcccctcctccagatgaggaggccaatgccaccagcgctgtggtgtccctgctgaatgagaccgtgacagaggtgcctgaggagaccaagatggtgatcaagaagggcctggagttcaaggatggcatgaatgtgctgggcctcatcggcttcttcatcgccttcggcatcgccatgggcaagatgggagaccaggccaagctgatggtggacttcttcaacatcctgaatgagatcgtgatgaagctggtgatcatgatcatgtggtacagccccctgggcatcgcctgcctgatctgtgggaagatcatcgccatcaaggacctggaggtggtggcccggcagctgggcatgtacatggtgaccgtcatcatcggcctcatcatccatggaggcatcttcctgcccctcatctactttgtggtgaccaggaagaaccccttctccttctttgctggcatcttccaggcctggatcacagccctgggcacagccagcagcgctggcaccctgcctgtgaccttccgctgcctggaggagaacctgggcatcgacaagagggtgaccaggtttgtgctgcctgtgggcgccaccatcaacatggatggaacagccctgtatgaggccgtggccgccatcttcatcgcccagatgaatggagtggtgctggatggcggccagatcgtgacagtgtccctgacagccaccctggcctctgtgggcgccgccagcatccccagcgctggcctggtgaccatgctgctgatcctgacagctgtgggcctgcccacagaggacatcagcctgctggtggccgtggactggctgctggacaggatgaggacctctgtgaatgtggtgggggacagctttggagctggcatcgtgtaccacctgagcaagtctgagctggacaccatcgacagccagcaccgggtgcatgaggacatcgagatgaccaagacccagagcatctatgatgacatgaagaaccaccgggagagcaacagcaaccagtgtgtgtatgctgcccacaacagcgtcatcgtggatgagtgcaaggtgaccctggccgccaacgggaagtctgctgactgcagcgtggaggaggagccctggaagcgggagaagtag

SEQ ID NO: 170132 - DNA, 1698 bp, Artificial Sequence
  Description of Artificial Sequence: Synthetic coding sequence
atgcccaagcaggtggaggtgaggatgcatgacagccacctgggcagcgaggagcccaagcaccgccacctgggcctgcggctgtgtgacaagctgggcaagaacctgctgctgaccctgactgtgtttggagtcatcctgggcgctgtgtgtggcggcctgctgcggctggccagccccatccacccagatgtggtgatgctgattgccttccctggggacatcctgatgaggatgctgaagatgctgatcctgcccctcatcatcagcagcctcatcaccggcctgagcggcctggatgccaaggccagcggccgcctgggcacccgggccatggtgtactacatgagcaccaccatcatcgctgctgtgctgggcgtcatcctggtgctggccatccaccctggcaaccccaagctgaagaagcagctgggccctgggaagaagaatgatgaggtgagcagcctggatgccttcctggacctgatccggaacctcttccctgagaacctggtgcaggcctgcttccagcagatccagacagtgaccaagaaggtgctggtggcccctcctccagatgaggaggccaatgccaccagcgctgtggtgtccctgctgaatgaaacagtgacagaggtgcctgaggagaccaagatggtgatcaagaagggcctggagttcaaggatggcatgaatgtgctgggcctgattggcttcttcatcgcctttggaattgccatgggcaagatgggagaccaggccaagctgatggtggacttcttcaacatcctgaatgaaattgtgatgaagctggtgatcatgatcatgtggtacagccccctgggcatcgcctgcctgatctgtgggaagatcatcgccatcaaggacctggaggtggtggcccggcagctgggcatgtacatggtgaccgtcatcatcggcctcatcatccacggcggcatcttcctgcccctcatctactttgtggtgaccaggaagaaccccttctccttctttgctggcatcttccaggcctggatcacagccctgggcacagccagcagcgctggcaccctgcctgtgaccttccgctgcctggaggagaacctgggcatcgacaagagggtgaccaggtttgtgctgcctgtgggcgccaccatcaacatggatggaacagccctgtatgaagctgtggccgccatcttcatcgcccagatgaatggagtggtgctggatggcggccagatcgtgacagtgtccctgacagccaccctggcctctgtgggcgccgccagcatccccagcgctggcctggtgaccatgctgctgatcctgacagctgtgggcctgcccacagaggacatcagcctgctggtggccgtggactggctgctggacaggatgaggacctctgtgaatgtggtgggggacagctttggagctggcatcgtgtaccacctgagcaagtctgagctggacaccatcgacagccagcaccgggtgcatgaagatattgagatgaccaagacccagagcatctatgatgacatgaagaaccaccgggagagcaacagcaaccagtgtgtgtatgctgcccacaacagcgtgattgtggatgagtgcaaggtgaccctggccgccaacgggaagtctgctgactgcagcgtggaggaggagccctggaagcgggagaagtag

SEQ ID NO: 170133 - DNA, 1698 bp, Artificial Sequence; identical to SEQ ID NO: 170132
  Description of Artificial Sequence: Synthetic coding sequence

SEQ ID NO: 170134 - DNA, 1629 bp, Artificial Sequence
  Description of Artificial Sequence: Synthetic coding sequence
atgaccaagagcaatggagaggagcccaagatgggcggccgcatggagcgcttccagcagggcgtgaggaagaggaccctgctggccaagaagaaggtgcagaacatcaccaaggaggatgtgaagagctacctgttcagaaatgcctttgtgctgctgactgtgacagctgtgattgtgggcaccatcctgggcttcaccctgcggccctacaggatgagctaccgggaggtgaagtacttctccttccctggagagctgctgatgaggatgctgcagatgctggtgctgcccctcatcatcagcagcctggtgacaggcatggccgccctggacagcaaggccagcggcaagatgggcatgagagctgtggtgtactacatgaccaccaccatcatcgctgtggtgattggcatcatcatcgtcatcatcatccaccctgggaagggcaccaaggagaacatgcaccgggagggcaagatcgtgcgggtgacagctgctgatgccttcctggacctgatccggaacatgtttcctcccaacctggtggaggcctgcttcaagcagttcaagaccaactatgagaagaggagcttcaaggtgcccatccaggccaatgagaccctggtgggcgccgtcatcaacaacgtgtctgaggccatggagaccctgacccgcatcacagaggagctggtgcctgtgcccggctctgtgaatggagtgaatgccctgggcctggtggtgttctccatgtgctttggatttgtgattggcaacatgaaggagcagggccaggccctgcgggagttctttgacagcctgaatgaggccatcatgaggctggtggccgtcatcatgtggtacgcccctgtgggcatcctcttcctgattgctgggaagatcgtggagatggaggacatgggcgtcatcggcggccagctggccatgtacacagtgaccgtcatcgtgggcctgctgattcatgctgtgattgtgctgcccctgctgtacttcctggtgaccaggaagaacccctgggtgttcatcggcggcctgctgcaggccctgatcacagccctgggcaccagcagcagcagcgccaccctgcccatcaccttcaagtgcctggaggagaacaacggggtggacaagagggtgaccaggtttgtgctgcctgtgggcgccaccatcaacatggatggaacagccctgtatgaggccctggccgccatcttcatcgcccaggtgaacaactttgagctgaactttggccagatcatcaccatcagcatcacagccacagctgccagcatcggggctgctggcatcccccaggccggcctggtgaccatggtgattgtgctgacctctgtgggcctgcccacagatgacatcaccctcatcatcgctgtggactggttcctggaccggctgcggaccaccaccaacgtgctgggggacagcctgggcgccggcatcgtggagcacctgagcagacatgagctgaagaacagagatgtggagatgggcaacagcgtcatcgaggagaatgagatgaagaagccctaccagctgattgcccaggacaatgaaacagagaagcccatcgacagcgagaccaagatgtag

SEQ ID NO: 170135 - DNA, 1494 bp, Artificial Sequence
  Description of Artificial Sequence: Synthetic coding sequence
atgaccaagagcaatggagaggagcccaagatgggcggccgcatggagcgcttccagcagggcgtgaggaagaggaccctgctggccaagaagaaggtgcagaacatcaccaaggaggatgtgaagagctacctgttcagaaatgcctttgtgctgctgactgtgacagctgtgattgtgggcaccatcctgggcttcaccctgcggccctacaggatgagctaccgggaggtgaagtacttctccttccctggagagctgctgatgaggatgctgcagatgctggtgctgcccctcatcatcagcagcctggtgacaggcatggccgccctggacagcaaggccagcggcaagatgggcatgagagctgtggtgtactacatgaccaccaccatcatcgctgtggtgattggcatcatcatcgtcatcatcatccaccctgggaagggcaccaaggagaacatgcaccgggagggcaagatcgtgcgggtgacagctgctgatgccttcctggacctgatccggaacatgtttcctcccaacctggtggaggcctgcttcaagcagttcaagaccaactatgagaagaggagcttcaaggtgcccatccaggccaatgagaccctggtgggcgccgtcatcaacaacgtgtctgaggccatggagaccctgacccgcatcacagaggagctggtgcctgtgcccggctctgtgaatggagtgaatgccctgggcctggtggtgttctccatgtgctttggatttgtgattggcaacatgaaggagcagggccaggccctgcgggagttctttgacagcctgaatgaggccatcatgaggctggtggccgtcatcatgtggtacgcccctgtgggcatcctcttcctgattgctgggaagatcgtggagatggaggacatgggcgtcatcggcggccagctggccatgtacacagtgaccgtcatcgtgggcctgctgattcatgctgtgattgtgctgcccctgctgtacttcctggtgaccaggaagaacccctgggtgttcatcggcggcctgctgcaggccctgatcacagccctgggcaccagcagcagcagcgccaccctgcccatcaccttcaagtgcctggaggagaacaacggggtggacaagagggtgaccaggtttgtgctgcctgtgggcgccaccatcaacatggatggaacagccctgtatgaggccctggccgccatcttcatcgcccaggtgaacaactttgagctgaactttggccagatcatcaccatccgggaccggctgcggaccaccaccaacgtgctgggggacagcctgggcgccggcatcgtggagcacctgagcagacatgagctgaagaacagagatgtggagatgggcaacagcgtgattgaagaaaatgagatgaagaagccctaccagctgattgcccaggacaatgaaacagagaagcccattgattctgagaccaagatgtag

SEQ ID NO: 170136 - DNA, 348 bp, Artificial Sequence
  Description of Artificial Sequence: Synthetic coding sequence
atgaccaagagcaatggagaggagcccaagatgggcggccgcatggagcgcttccagcagggcgtgaggaagaggaccctgctggccaagaagaaggtgcagaacatcaccaaggaggatgtgaagagctacctgttcagaaatgcctttgtgctgctgactgtgacagctgtgattgtggatgagaagacagaggcccagatcctgaccacccagctgatgaacacagagtgggacagcaacccccccttccggctgcaggtgctgatccaccacacagtgctgggcgccatcacccccatcctggccctgctgcagcagtttgctgagggcctgcctgaggtgtag

SEQ ID NO: 170137 - DNA, 1473 bp, Artificial Sequence
  Description of Artificial Sequence: Synthetic coding sequence
atgaccaagagcaatggagaggagcccaagatgggcggccgcatggagcgcttccagcagggcgtgaggaagaggaccctgctggccaagaagaaggtgcagaacatcaccaaggaggatgtgaagagctacctgttcagaaatgcctttgtgctgctgaccggcatggccgccctggacagcaaggccagcggcaagatgggcatgagagctgtggtgtactacatgaccaccaccatcatcgctgtggtgattggcatcatcatcgtcatcatcatccaccctgggaagggcaccaaggagaacatgcaccgggagggcaagatcgtgcgggtgacagctgctgatgccttcctggacctgatccggaacatgtttcctcccaacctggtggaggcctgcttcaagcagttcaagaccaactatgagaagaggagcttcaaggtgcccatccaggccaatgagaccctggtgggcgccgtcatcaacaacgtgtctgaggccatggagaccctgacccgcatcacagaggagctggtgcctgtgcccggctctgtgaatggagtgaatgccctgggcctggtggtgttctccatgtgctttggatttgtgattggcaacatgaaggagcagggccaggccctgcgggagttctttgacagcctgaatgaggccatcatgaggctggtggccgtcatcatgtggtacgcccctgtgggcatcctcttcctgattgctgggaagatcgtggagatggaggacatgggcgtcatcggcggccagctggccatgtacacagtgaccgtcatcgtgggcctgctgattcatgctgtgattgtgctgcccctgctgtacttcctggtgaccaggaagaacccctgggtgttcatcggcggcctgctgcaggccctgatcacagccctgggcaccagcagcagcagcgccaccctgcccatcaccttcaagtgcctggaggagaacaacggggtggacaagagggtgaccaggtttgtgctgcctgtgggcgccaccatcaacatggatggaacagccctgtatgaggccctggccgccatcttcatcgcccaggtgaacaactttgagctgaactttggccagatcatcaccatcagcatcacagccacagctgccagcatcggggctgctggcatcccccaggccggcctggtgaccatggtgattgtgctgacctctgtgggcctgcccacagatgacatcaccctcatcatcgctgtggactggttcctggaccggctgcggaccaccaccaacgtgctgggggacagcctgggcgccggcatcgtggagcacctgagcagacatgagctgaagaacagagatgtggagatgggcaacagcgtcatcgaggagaatgagatgaagaagccctaccagctgattgcccaggacaatgaaacagagaagcccatcgacagcgagaccaagatgtag

SEQ ID NO: 170138 - DNA, 324 bp, Artificial Sequence
  Description of Artificial Sequence: Synthetic coding sequence
atgaccaagagcaatggagaggagcccaagatgggcggccgcatggagcgcttccagcagggcgtgaggaagaggaccctgctggccaagaagaaggtgcagaacatcaccaaggaggatgtgaagagctacctgttcagaaatgcctttgtgctgctgactgtgacagctgtgattgtgggcaccatcctgggcttcaccctgcggccctacaggatgagctaccgggaggtgaagtacttctccttccctggagagctgctgatgaggatgctgcagatgctggtgctgcccctcatcatcagcagcctggtgactggatag

SEQ ID NO: 170139 - DNA, 324 bp, Artificial Sequence; identical to SEQ ID NO: 170138
  Description of Artificial Sequence: Synthetic coding sequence

SEQ ID NO: 170140 - DNA, 306 bp, Artificial Sequence
  Description of Artificial Sequence: Synthetic coding sequence
atgaccaagagcaatggagaggagcccaagatgggcggccgcatggagcgcttccagcagggcgtgaggaagaggaccctgctggccaagaagaaggtgcagaacatcaccaaggaggatgtgaagagctacctgttcagaaatgcctttgtgctgctgactgtgacagctgtgattgtgggcaccatcctgggcttcaccctgcggccctacaggatgagctaccgggaggtgaagtacttctccttccctggagagctgctgatgaggatgctgcagatgctggtgctgcccctcatcatctag

SEQ ID NO: 170141 - DNA, 987 bp, Artificial Sequence
  Description of Artificial Sequence: Synthetic coding sequence
atgactggagtgtttgacagcctggtggccgacatgcacagcacccagattgctgccagcagcacctaccaccagcaccagcagcccccatctgggggcggggccggccctgggggcaacagcagcagcagcagcagcctgcacaagccccaggagagccccaccctgcctgtgtccacagccacagacagcagctactacaccaaccagcagcaccctgctgggggcggcggcggcggcggcagcccctatgcccacatgggcagctaccagtaccaggccagcggcctgaacaacgtgccctacagcgccaagagcagctatgacctgggctacacagctgcctacaccagctatgccccctacggcaccagcagcagccctgccaacaatgaacctgagaaggaggacctggagcctgagatccgcatcgtgaatggcaagcccaagaaggtgaggaagcccaggaccatctacagcagcttccagctggccgccctgcagaggcgcttccagaagacccagtacctggccctgcctgagagagctgagctggccgccagcctgggcctgacccagacccaggtgaagatctggttccagaacagaagaagcaagttcaagaagatgtggaagtctggagagatccccagcgagcagcaccctggggccagcgccagccccccctgtgccagcccccctgtgtctgccccagcctcctgggactttggagtgccccagaggatggccggcggcggcggccctggcagcggcggcagcggggccggcagcagcggcagcagccccagcagcgctgccagcgccttcctgggcaactacccctggtaccaccagaccagcggcagcgccagccacctgcaggccacagcccccctgctgcaccccacccagaccccccagccccaccaccaccaccaccaccacggcggcggcggggcccctgtgtctgctggcaccatcttctag

SEQ ID NO: 170142 - DNA, 1359 bp, Artificial Sequence
  Description of Artificial Sequence: Synthetic coding sequence
atgctgctgaggatgctgaggatgatcatcctgcccctggtggtgtgcagcctggtgtctggggccgccagcctggatgccagctgcctgggccgcctgggcggcattgctgtggcctacttcggcctgaccaccctgagcgccagcgccctggccgtggccctggccttcatcatcaagccaggcagcggggcccagaccctgcagagcagtgacctgggcctggaggacagcggccccccacctgtgcccaaggagaccgtggacagcttcctggacctggccaggaacctcttccccagcaacctggtggtggccgccttccgcacctacgccacagactacaaggtggtgacccagaacagcagcagtggaaatgtgacccatgagaagatccccatcggcacagaaattgagggcatgaacatcctgggcctggtgctgtttgccctggtgctgggcgtggccctgaagaagctgggctctgaaggagaagatctcatccgcttcttcaacagcctgaatgaggccaccatggtgctggtgtcctggatcatgtggtacgtgcctgtgggcatcatgttcctggtgggcagcaagatcgtggagatgaaggacatcatcgtgctggtgaccagcctgggcaagtacatctttgccagcatcctgggccacgtgatccacggcggcatcgtgctgcccctcatctactttgtgttcaccaggaagaaccccttccgcttcctgctgggcctgctggccccctttgccacagcctttgccacctgcagcagcagcgccaccctgcccagcatgatgaagtgcatcgaggagaacaacggggtggacaagaggatcagccgcttcatcctgcccatcggggccaccgtgaacatggatggagctgccatcttccagtgtgtggccgctgtgttcatcgcccagctgaacaacgtggagctgaatgccggccagatcttcaccatcctggtgacagccacagccagctctgtgggcgctgctggggtgcctgctggaggagtgctgaccatcgccatcatcctggaggccatcggcctgcccacccatgacctgcccctcatcctggccgtggactggatcgtggacaggaccaccaccgtggtgaatgtggagggagatgccctgggcgccggcatcctgcaccacctgaaccagaaggccaccaagaagggggagcaggagctggccgaggtgaaggtggaggccatccccaactgcaagtctgaggaggagaccagccccctggtgacccaccagaacccagctggccctgtggccagcgcccctgagctggagagcaaggagagcgtgctgtag

SEQ ID NO: 170143 - DNA, 705 bp, Artificial Sequence
  Description of Artificial Sequence: Synthetic coding sequence
atgaacatcctgggcctggtgctgtttgccctggtgctgggcgtggccctgaagaagctgggctctgaaggagaagatctcatccgcttcttcaacagcctgaatgaggccaccatggtgctggtgtcctggatcatgtgcagcgccaccctgcccagcatgatgaagtgcatcgaggagaacaacggggtggacaagaggatcagccgcttcatcctgcccatcggggccaccgtgaacatggatggagctgccatcttccagtgtgtggccgctgtgttcatcgcccagctgaacaacgtggagctgaatgccggccagatcttcaccatcctggtgacagccacagccagctctgtgggcgctgctggggtgcctgctggaggagtgctgaccatcgccatcatcctggaggccatcggcctgcccacccatgacctgcccctcatcctggccgtggactggatcgtggacaggaccaccaccgtggtgaatgtggagggagatgccctgggcgccggcatcctgcaccacctgaaccagaaggccaccaagaagggggagcaggagctggccgaggtgaaggtggaggccatccccaactgcaagtctgaggaggagaccagccccctggtgacccaccagaacccagctggccctgtggccagcgcccctgagctggagagcaaggagagcgtgctgtag

SEQ ID NO: 170144 - DNA, 1575 bp, Artificial Sequence
  Description of Artificial Sequence: Synthetic coding sequence
atgggcaagccagccaggaagggctgtgagtggaagcgcttcctgaagaacaactgggtgctgctgagcacagtggccgctgtggtgctgggcatcaccaccggggtgctggtgcgggagcacagcaacctgagcaccctggagaagttctactttgccttccctggagagatcctgatgaggatgctgaagctgatcatcctgcccctcatcatcagctccatgatcactggagtggccgccctggacagcaatgtgtctgggaagattggcctgcgggctgtggtgtactacttctgcaccaccctgattgctgtgatcctgggcatcgtgctggtggtgtccatcaagccaggagtgacccagaaggtgggggagatcgccaggacaggcagcaccccagaggtgtccacagtggatgccatgctggacctgatccggaacatgtttcctgagaacctggtgcaggcctgcttccagcagtacaagaccaagcgggaggaggtgaagcccccaagtgaccctgagatgaacatgacagaggagagcttcaccgctgtgatgaccacagccatcagcaagaacaagaccaaggagtacaagatcgtgggcatgtacagtgatggcatcaacgtgctgggcctcatcgtgttctgcctggtgtttggcctggtgattggcaagatgggagagaagggccagatcctggtggacttcttcaatgccctgagtgatgccaccatgaagatcgtgcagatcatcatgtgctacatgcccctgggcatcctcttcctgattgctgggaagatcatcgaggtggaggactgggagatcttcaggaagctgggcctgtacatggccaccgtgctgaccggcctggccatccacagcatcgtcatcctgcccctcatctacttcatcgtggtgaggaagaaccccttccgctttgccatgggcatggcccaggccctgctgacagccctgatgatcagcagcagcagcgccaccctgcctgtgaccttccgctgtgccgaggagaacaaccaggtggacaagaggatcaccaggtttgtgctgcctgtgggcgccaccatcaacatggatggaacagccctgtatgaagctgtggccgctgtgttcatcgcccagctgaatgacctggacctgggcatcggccagatcatcaccatcagcatcacagccaccagcgccagcatcggggctgctggggtgccccaggccggcctggtgaccatggtgattgtgctgtctgctgtgggcctgcctgcagaagatgtgaccctcatcatcgctgtggactggctgctggaccgcttccgcaccatggtgaatgtgctgggagatgcctttggaactggaattgtggagaagctgagcaagaaggagctggagcagatggatgtgtcctctgaggtgaacatcgtgaacccctttgccctggagagcaccatcctggacaatgaagattctgacaccaagaagagctatgtgaatggaggctttgctgtggacaagagtgacaccatctccttcacccagaccagccagttctag

SEQ ID NO: 170145 - DNA, 729 bp, Artificial Sequence
  Description of Artificial Sequence: Synthetic coding sequence
tgattcttcaatgccctgagtgatgccaccatgaagatcgtgcagatcatcatgtgctacatgcccctgggcatcctcttcctgattgctgggaagatcatcgaggtggaggactgggagatcttcaggaagctgggcctgtacatggccaccgtgctgaccggcctggccatccacagcatcgtcatcctgcccctcatctacttcatcgtggtgaggaagaaccccttccgctttgccatgggcatggcccaggccctgctgacagccctgatgatcagcagcagcagcgccaccctgcctgtgaccttccgctgtgccgaggagaacaaccaggtggacaagaggatcaccaggtttgtgctgcctgtgggcgccaccatcaacatggatggaacagccctgtatgaggccgtggccgctgtgttcatcgcccagctgaatgacctggacctgggcatcggccagatcatcaccatccgggaccgcttccgcaccatggtgaatgtgctgggagatgcctttggaactggaattgtggagaagctgagcaagaaggagctggagcagatggatgtgtcctctgaggtgaacatcgtgaacccctttgccctggagagcaccatcctggacaatgaagattctgacaccaagaagagctatgtgaatggaggctttgctgtggacaagagtgacaccatctccttcacccagaccagccagttctag

SEQ ID NO: 170146 - DNA, 1647 bp, Artificial Sequence
  Description of Artificial Sequence: Synthetic coding sequence
gagacccctgtgctgcccatcatggtggccgaccccccccgggacagcaagggcctggccgctgctgagcccacagccaatggaggcctggccctggccagcattgaggaccagggcgctgctgctgggggctactgcggcagccgggaccaggtgcggcgctgcctgcgggccaacctgctggtgctgctgactgtggtggccgtggtggccggcgtggccctgggcctgggcgtgtctggggccggcggggccctggccctgggccctgagcggctgagcgcctttgtgtttcctggagagctgctgctgcggctgctgaggatgatcatcctgcccctggtggtgtgcagcctcatcggcggggccgccagcctggaccccggggccctgggccgcctgggcgcctgggccctgctcttcttcctggtgaccaccctgctggccagcgccctgggcgtgggcctggccctggccctgcagcccggggccgccagcgctgccatcaatgcctctgtgggcgccgccggcagcgcagaaaatgcccccagcaaggaggtgctggacagcttcctggacctggccaggaacatcttccccagcaacctggtgtctgctgccttccgcagctacagcaccacctatgaggagaggaacatcaccggcaccagggtgaaggtgcctgtgggccaggaggtggagggcatgaacatcctgggcctggtggtgtttgccatcgtgtttggagtggccctgaggaagctgggccctgagggggagctgctgatccgcttcttcaacagcttcaatgaggccaccatggtgctggtgtcctggatcatgtggtacgcccctgtgggcatcatgttcctggtggccggcaagatcgtggagatggaggatgtgggcctgctgtttgcccggctgggcaagtacatcctgtgctgcctgctgggccacgccatccacggcctgctggtgctgcccctcatctacttcctgttcaccaggaagaacccctaccgcttcctgtggggcatcgtgacccccctggccacagccttcggcaccagcagcagcagcgccaccctgcccctgatgatgaagtgtgtggaggagaacaatggagtggccaagcacatcagccgcttcatcctgcccatcggggccaccgtgaacatggatggagctgccctcttccagtgtgtggccgctgtgttcatcgcccagctgagccagcagagcctggactttgtgaagatcatcaccatcctggtgacagccacagccagctctgtgggcgccgccggcatcccagctgggggcgtgctgaccctggccatcatcctggaggccgtgaacctgcctgtggaccacatcagcctcatcctggccgtggactggctggtggacaggagctgcaccgtgctgaatgtggagggagatgccctgggcgccggcctgctgcagaactacgtggacagaacagagagccgcagcacagagcctgagctgatccaggtgaagtctgagctgcccctggaccccctgcctgtgcccacagaggagggcaaccccctgctgaagcactaccggggccctgctggagatgccaccgtggccagcgagaaggagagcgtgatgtag

SEQ ID NO: 170147 - DNA, 942 bp, Artificial Sequence
  Description of Artificial Sequence: Synthetic coding sequence
atgaacatcctgggcctggtggtgtttgccatcgtgtttggagtggccctgaggaagctgggccctgagggggagctgctgatccgcttcttcaacagcttcaatgaggccaccatggtgctggtgtcctggatcatgtggtacgcccctgtgggcatcatgttcctggtggccggcaagatcgtggagatggaggatgtgggcctgctgtttgcccggctgggcaagtacatcctgtgctgcctgctgggccacgccatccacggcctgctggtgctgcccctcatctacttcctgttcaccaggaagaacccctaccgcttcctgtggggcatcgtgacccccctggccacagccttcggcaccagcagcagcagcgccaccctgcccctgatgatgaagtgtgtggaggagaacaacggggtggccaagcacatcagccgcttcatcctgcccatcggggccaccgtgaacatggatggagctgccctcttccagtgtgtggccgctgtgttcatcgcccagctgagccagcagagcctggactttgtgaagatcatcaccatcctggtgacagccacagccagctctgtgggcgctgctggcatcccagctggaggagtgctgaccctggccatcatcctggaggccgtgaacctgcctgtggaccacatcagcctcatcctggccgtggactggctggtggacaggagctgcaccgtgctgaatgtggagggagatgccctgggcgccggcctgctgcagaactacgtggacagaacagagagccgcagcacagagcctgagctgatccaggtgaagtctgagctgcccctggaccccctgcctgtgcccacagaggagggcaaccccctgctgaagcactaccggggccctgctggagatgccaccgtggccagcgagaaggagagcgtgatgtag

SEQ ID NO: 170148 - DNA, 1020 bp, Artificial Sequence
  Description of Artificial Sequence: Synthetic coding sequence
atgtacagcaccacctatgaggagaggaacatcaccggcaccagggtgaaggtgcctgtgggccaggaggtggagggcatgaacatcctgggcctggtggtgtttgccatcgtgtttggagtggccctgaggaagctgggccctgagggggagctgctgatccgcttcttcaacagcttcaatgaggccaccatggtgctggtgtcctggatcatgtggtacgcccctgtgggcatcatgttcctggtggccggcaagatcgtggagatggaggatgtgggcctgctgtttgcccggctgggcaagtacatcctgtgctgcctgctgggccacgccatccacggcctgctggtgctgcccctcatctacttcctgttcaccaggaagaacccctaccgcttcctgtggggcatcgtgacccccctggccacagccttcggcaccagcagcagcagcgccaccctgcccctgatgatgaagtgtgtggaggagaacaacggggtggccaagcacatcagccgcttcatcctgcccatcggggccaccgtgaacatggatggagctgccctcttccagtgtgtggccgctgtgttcatcgcccagctgagccagcagagcctggactttgtgaagatcatcaccatcctggtgacagccacagccagctctgtgggcgctgctggcatcccagctggaggagtgctgaccctggccatcatcctggaggccgtgaacctgcctgtggaccacatcagcctcatcctggccgtggactggctggtggacaggagctgcaccgtgctgaatgtggagggagatgccctgggcgccggcctgctgcagaactacgtggacagaacagagagccgcagcacagagcctgagctgatccaggtgaagtctgagctgcccctggaccccctgcctgtgcccacagaggagggcaaccccctgctgaagcactaccggggccctgctggagatgccaccgtggccagcgagaaggagagcgtgatgtag

SEQ ID NO: 170149 - DNA, 1626 bp, Artificial Sequence
  Description of Artificial Sequence: Synthetic coding sequence
atggtggccgaccccccccgggacagcaagggcctggccgctgctgagcccacagccaacggcggcctggccctggccagcattgaggaccagggcgctgctgctgggggctactgcggcagccgggaccaggtgcggcgctgcctgcgggccaacctgctggtgctgctgactgtggtggccgtggtggccggcgtggccctgggcctgggcgtgtctggagctggaggagccctggccctgggccctgagcggctgagcgcctttgtgtttcctggagagctgctgctgcggctgctgaggatgatcatcctgcccctggtggtgtgcagcctgattggaggagctgccagcctggaccccggggccctgggccgcctgggcgcctgggccctgctcttcttcctggtgaccaccctgctggccagcgccctgggcgtgggcctggccctggccctgcagcctggagctgccagcgctgccatcaatgcctctgtgggcgctgctggcagcgcagaaaatgcccccagcaaggaggtgctggacagcttcctggacctggccaggaacatcttccccagcaacctggtgtctgctgccttccgcagctacagcaccacctatgaggagaggaacatcaccggcaccagggtgaaggtgcctgtgggccaggaggtggagggcatgaacatcctgggcctggtggtgtttgccatcgtgtttggagtggccctgaggaagctgggccctgagggggagctgctgatccgcttcttcaacagcttcaatgaggccaccatggtgctggtgtcctggatcatgtggtacgcccctgtgggcatcatgttcctggtggccggcaagatcgtggagatggaggatgtgggcctgctgtttgcccggctgggcaagtacatcctgtgctgcctgctgggccacgccatccacggcctgctggtgctgcccctcatctacttcctgttcaccaggaagaacccctaccgcttcctgtggggcatcgtgacccccctggccacagccttcggcaccagcagcagcagcgccaccctgcccctgatgatgaagtgtgtggaggagaacaacggggtggccaagcacatcagccgcttcatcctgcccatcggggccaccgtgaacatggatggagctgccctcttccagtgtgtggccgctgtgttcatcgcccagctgagccagcagagcctggactttgtgaagatcatcaccatcctggtgacagccacagccagctctgtgggcgctgctggcatcccagctggaggagtgctgaccctggccatcatcctggaggccgtgaacctgcctgtggaccacatcagcctcatcctggccgtggactggctggtggacaggagctgcaccgtgctgaatgtggagggagatgccctgggcgccggcctgctgcagaactacgtggacagaacagagagccgcagcacagagcctgagctgatccaggtgaagtctgagctgcccctggaccccctgcctgtgcccacagaggagggcaaccccctgctgaagcactaccggggccctgctggagatgccaccgtggccagcgagaaggagagcgtgatgtag

SEQ ID NO: 170150 - DNA, 1308 bp, Artificial Sequence
  Description of Artificial Sequence: Synthetic coding sequence
atggccgagagcagcagcgagagtgaccacttccgctgccgggaccggctgagcccctgggccgcccggagcacccaccggggcaccaggagcctgcccaccgtggaggtgacagagaaggtgaacaccatcaccagcaccctgcaggacaccagcaggaacctgcggcaggtggaccagatgctgggccgctaccgggagtacagcaatggccaggccggggccatcgagcacctgaaggagagcctggagcagagcattgaccagctgcggagccagaggctgctgagaaattctgggggccgcagcatctctgtgaccagcctgagcgccagtgacctggatggcggcaccggcagcgagctgcaccacttcccccccaccagccccctgaaggactatggagacccccagggcatcaagaggatgaggagcaggactggagtgcgctttgtgcaggagacagatgacatgacccagctgcacggcttccaccagagcctgcgggacctgagcagcgagcagatccggctgggagatgacttcaaccgggagctgagccgccgcagcagaagtgatgctgagaccaagagggccctggaggagctgacagagaagctgaatgaggcccagaagcaggaggtggtgtctgacagagtggagcggcggctgcaggagctggagcgggagatgaggacagagcgggagctggtggagcggcggcaggaccagctgggcctgatgagcctgcagctgcaggaggccctgaagaagcaggaggccaaggcagatgagcacgagggcgccatcaagaacaagctgcggcagacagaaacagagaagaaccagctggagcaggagctggagctgagccggcggctgctgaaccagagcgagggcagccgggagaccctgctgcaccaggtggaggagctgcggacccagctgaccaaggccgagggggacaggaagggcctgcagcaccaggtgtcccagatcagcaagcagcagagcaactaccaggatgagcagggcgaggactggaggttcagaagaggagtggagcgggagaagcaggacctggagaagcagatgtctgacctgcgggtgcagctgaacttcagcgccatggccagcgagctggaggaggtgaagcgctgcatggagaggaaggacaaggagaaggcccacctggccagccaggtggagcacatcaacaggaagtgcctgctgaacctggtgcaggacctggactgcaaggacaatgagatcctgacctacagcctgcagagccccctgcacgtgtag

SEQ ID NO: 170151 - DNA, 1047 bp, Artificial Sequence
  Description of Artificial Sequence: Synthetic coding sequence
atgaatgaccccaacagctgtgtggacaatgccaccgtgtgcagcggggccagctgtgtggtgcctgagagcaacttcaacaacatcctgtctgtggtgctgagcacagtgctgaccatcctgctggccctggtgatgttctccatgggctgcaatgtggagatcaagaagttcctgggccacatcaagaggccctggggcatctgtgtgggcttcctgtgccagtttggcatcatgcccctgaccggcttcatcctgtctgtggcctttgacatcctgcccctgcaggccgtggtggtgctgatcatcggctgctgccctgggggcacagccagcaacatcctggcctactgggtggatggagacatggacctgtctgtgtccatgaccacctgcagcaccctgctggccctgggcatgatgcccctgtgcctgctgatctacaccaagatgtgggtggacagcggcagcatcgtcatcccctatgacaacatcggcaccagcctggtgtccctggtggtgcctgtgtccatcggcatgtttgtgaaccacaagtggccccagaaggccaagatcatcctgaagattggcagcattgctggggccatcctgattgtgctgattgctgtggtgggcggcatcctgtaccagagcgcctggatcatcgcccccaagctgtggatcatcggcaccatcttccctgtggccggctacagcctgggcttcctgctggccagaattgctggcctgccctggtaccgctgcaggacagtggcctttgagaccggcatgcagaacacccagctgtgcagcaccatcgtgcagctgtccttcaccccagaggagctgaatgtggtgttcaccttccccctcatctacagcatcttccagctggcctttgctgccatcttcctgggcttctacgtggcctacaagaagtgccacggcaagaacaaggccgagatccctgagagcaaagaaaatggaacagagcctgagagcagcttctacaaggccaacggcggcttccagccagatgagaagtag

SEQ ID NO: 170152 - DNA, 1434 bp, Artificial Sequence
  Description of Artificial Sequence: Synthetic coding sequence
atggtgctgatgcaggacaagggcagcagccagcagtggccaggcctgggcggggagggcggcggcaccggccccctgtccatgctgcgggccgccctgctgctgatcagcctgccctggggcgcccagggcacagccagcaccagcctgagcacagctgggggccacacagtgcccccaactggaggccgctacctgagcattggagatggctctgtgatggagtttgagttccctgaggacagcgagggcatcatcgtcatcagcagccagtacccaggccaggccaacagaacagcccctggccccatgctgcgggtgaccagcctggacacagaggtgctgaccatcaagaatgtgtctgccatcacctggggcggcggcggcggctttgtggtgtccatccacagcggcctggccggcctggcccccctgcacatccagctggtggatgcccacgaggccccacccaccctcatcgaggagcggcgggacttctgcatcaaggtgtccccagctgaggacaccccagccaccctgtctgctgacctggcccacttcagcgagaaccccatcctgtacctgctgctgcccctcatctttgtgaacaagtgcagctttggctgcaaggtggagctggaggtgctgaagggcctgatgcagagcccccagcccatgctgctgggcctgctgggccagttcctggtgatgcccctgtatgccttcctgatggccaaggtgttcatgctgcccaaggccctggccctgggcctcatcatcacctgcagcagccctgggggcggcggcagctacctgttcagcctgctgctgggcggagatgtgaccctggccatctccatgaccttcctgagcacagtggccgccaccggcttcctgcccctgagcagcgccatctacagccggctgctgagcatccacgagaccctgcacgtgcccatcagcaagatcctgggcaccctgctcttcatcgccatccccatcgctgtgggcgtgctgatcaagagcaagctgcccaagttcagccagctgctgctgcaggtggtgaagcccttctcctttgtgctgctgctgggcggcctcttcctggcctacaggatgggcgtcttcatcctggccggcatccggctgcccatcgtgctggtgggcatcaccgtgcccctggtgggcctgctggtgggctactgcctggccacctgcctgaagctgcctgtggcccagaggagaacagtgtccattgaggtgggcgtgcagaacagcctgctggccctggccatgctgcagctgagcctgcggcggctgcaggccgactatgccagccaggcccccttcatcgtggccctgagcggcaccagcgagatgctggccctggtgattggccacttcatctacagcagcctcttccctgtgccctag

SEQ ID NO: 170153 - DNA, 1347 bp, Artificial Sequence
  Description of Artificial Sequence: Synthetic coding sequence
atggtgctgatgcaggacaagggcagcagccagcagtggccaggcctgggcggggagggcggcggcaccggccccctgtccatgctgcgggccgccctgctgctgatcagcctgccctggggcgcccagggcacagccagcaccagcctgagcacagctgggggccacacagtgcccccaactggaggccgctacctgagcattggagatggctctgtgatggagtttgagttccctgaggacagcgagggcatcatcgtcatcagcagccagtacccaggccaggccaacagaacagcccctggccccatgctgcgggtgaccagcctggacacagaggtgctgaccatcaagaacctggtggatgcccacgaggccccacccaccctgattgaggagcggcgggacttctgcatcaaggtgtccccagctgaggacaccccagccaccctgtctgctgacctggcccacttcagcgagaaccccatcctgtacctgctgctgcccctcatctttgtgaacaagtgcagctttggctgcaaggtggagctggaggtgctgaagggcctgatgcagagcccccagcccatgctgctgggcctgctgggccagttcctggtgatgcccctgtatgccttcctgatggccaaggtgttcatgctgcccaaggccctggccctgggcctcatcatcacctgcagcagccctgggggcggcggcagctacctgttcagcctgctgctgggcggagatgtgaccctggccatctccatgaccttcctgagcacagtggccgccaccggcttcctgcccctgagcagcgccatctacagccggctgctgagcatccacgagaccctgcacgtgcccatcagcaagatcctgggcaccctgctcttcatcgccatccccatcgctgtgggcgtgctgatcaagagcaagctgcccaagttcagccagctgctgctgcaggtggtgaagcccttctcctttgtgctgctgctgggcggcctcttcctggcctacaggatgggcgtcttcatcctggccggcatccggctgcccatcgtgctggtgggcatcaccgtgcccctggtgggcctgctggtgggctactgcctggccacctgcctgaagctgcctgtggcccagaggagaacagtgtccattgaggtgggcgtgcagaacagcctgctggccctggccatgctgcagctgagcctgcggcggctgcaggccgactatgccagccaggcccccttcatcgtggccctgagcggcaccagcgagatgctggccctggtgattggccacttcatctacagcagcctcttccctgtgccctag

SEQ ID NO: 170154 - DNA, 1599 bp, Artificial Sequence
  Description of Artificial Sequence: Synthetic coding sequence
atggccggcccccggcccccaggggacagccctgccatcaaggaggacagcacaggcctgggccccacccatgagcccttcagcggccagcccaacagcaccagcggagatgtgctgctgagccggcggggccctggccacgccatccggcccccaggccgggccatggtgctgatgcaggacaagggcagcagccagcagtggccaggcctgggcggggagggcggcggcaccggccccctgtccatgctgcgggccgccctgctgctgatcagcctgccctggggcgcccagggcacagccagcaccagcctgagcacagctgggggccacacagtgccccccaccggcggccgctacctgagcattggagatggctctgtgatggagtttgagttcccagaagattctgagggcatcatcgtcatcagcagccagtacccaggccaggccaacagaacagcccctggccccatgctgcgggtgaccagcctggacacagaggtgctgaccatcaagaatgtgtctgccatcacctggggcggcggcggcggctttgtggtgtccatccacagcggcctggccggcctggcccccctgcacatccagctggtggatgcccacgaggccccacccaccctgattgaggagcggcgggacttctgcatcaaggtgtccccagctgaggacaccccagccaccctgtctgctgacctggcccacttcagcgagaaccccatcctgtacctgctgctgcccctcatctttgtgaacaagtgcagctttggctgcaaggtggagctggaggtgctgaagggcctgatgcagagcccccagcccatgctgctgggcctgctgggccagttcctggtgatgcccctgtatgccttcctgatggccaaggtgttcatgctgcccaaggccctggccctgggcctcatcatcacctgcagcagccctgggggcggcggcagctacctgttcagcctgctgctgggcggagatgtgaccctggccatctccatgaccttcctgagcacagtggccgccaccggcttcctgcccctgagcagcgccatctacagccggctgctgagcatccacgagaccctgcacgtgcccatcagcaagatcctgggcaccctgctcttcatcgccatccccatcgctgtgggcgtgctgatcaagagcaagctgcccaagttcagccagctgctgctgcaggtggtgaagcccttctcctttgtgctgctgctgggcggcctcttcctggcctacaggatgggcgtcttcatcctggccggcatccggctgcccatcgtgctggtgggcatcaccgtgcccctggtgggcctgctggtgggctactgcctggccacctgcctgaagctgcctgtggcccagaggagaacagtgtccattgaggtgggcgtgcagaacagcctgctggccctggccatgctgcagctgagcctgcggcggctgcaggccgactatgccagccaggcccccttcatcgtggccctgagcggcaccagcgagatgctggccctggtgattggccacttcatctacagcagcctcttccctgtgccctag

SEQ ID NO: 170155 - DNA, 1434 bp, Artificial Sequence; identical to SEQ ID NO: 170152
  Description of Artificial Sequence: Synthetic coding sequence

SEQ ID NO: 170156 - DNA, 657 bp, Artificial Sequence
  Description of Artificial Sequence: Synthetic coding sequence
atggtgctgatgcaggacaagggcagcagccagcagtggccaggcctgggcggggagggcggcggcaccggccccctgtccatgctgcgggccgccctgctgctgatcagcctgccctggggcgcccagggcacagccagcaccagcctgagcacagctgggggccacacagtgcccccaactggaggccgctacctgagcattggagatggctctgtgatggagtttgagttccctgaggacagcgagggcatcatcgtcatcagcagccagtacccaggccaggccaacagaacagcccctggccccatgctgcgggtgaccagcctggacacagaggtgctgaccatcaagaatgtgtctgccatcacctggggcggcggcggcggctttgtggtgtccatccacagcggcctggccggcctggcccccctgcacatccagctggtggatgcccacgaggccccacccaccctcatcgaggagcggcgggacttctgcatcaaggtgtccccagctgaggacaccccagccaccctgtctgctgacctggcccacttcagcgagaaccccatcctgtacctgctgctgcccctcatctttgtgaacaagtgcagctttggctgcaaggtggagctggaggtgctgaagggctag

SEQ ID NO: 170157 - DNA, 1314 bp, Artificial Sequence
  Description of Artificial Sequence: Synthetic coding sequence
atggatggaaatgacaacgtgaccctgctgtttgcccccctgctgcgggacaactacaccctggccccaaatgccagcagcctgggccctggaacagacctggccctggccccagccagcagcgctggccctggccctggcctgagcctgggccctggccccagctttggcttcagccctggccccacccccaccccagagcccaccaccagcggcctggccggcggggccgccagccacggccccagccccttcccccggccctgggccccccacgccctgcccttctgggacacccccctgaaccacggcctgaatgtgtttgtgggcgccgccctgtgcatcaccatgctgggcctgggctgcaccgtggatgtgaaccactttggagcccacgtgcggcggcctgtgggcgccctgctggccgccctgtgccagtttggcctgctgcccctgctggccttcctgctggccctggccttcaagctggatgaggtggccgctgtggccgtgctgctgtgtggctgctgccctgggggcaacctgagcaacctgatgagcctgctggtggatggagacatgaacctgagcatcatcatgaccatcagcagcaccctgctggccctggtgctgatgcccctgtgcctgtggatctacagctgggcctggatcaacacccccatcgtgcagctgctgcccctgggcaccgtgaccctgaccctgtgcagcaccctcatccccatcggcctgggcgtcttcatccgctacaagtacagccgggtggccgactacatcgtgaaggtgtccctgtggagcctgctggtgaccctggtggtgctcttcatcatgacaggcaccatgctgggccctgagctgctggccagcatcccagctgctgtgtatgtgattgccatcttcatgcccctggccggctacgccagcggctacggcctggccaccctcttccacctgccccccaactgcaagaggacagtgtgcctggagaccggcagccagaatgtgcagctgtgcacagccatcctgaagctggccttccccccccagttcatcggctccatgtacatgttccccctgctgtatgccctcttccagagcgctgaggccggcatctttgtgctgatctacaagatgtatggcagcgagatgctgcacaagagggaccccctggatgaagatgaggacacagacatctcctacaagaagctgaaggaggaggagatggctgacaccagctatggaacagtgaaggccgagaacatcatcatgatggagacagcccagaccagcctgtag

SEQ ID NO: 170158 - DNA, 1134 bp, Artificial Sequence
  Description of Artificial Sequence: Synthetic coding sequence
atgagggccaactgcagcagcagcagcgcctgcccagccaacagcagcgaggaggagctgcctgtgggcctggaggtgcacggcaacctggagctggtgttcaccgtggtgtccacagtgatgatgggcctgctgatgttcagcctgggctgcagcgtggagatcaggaagctgtggagccacatcagaagaccctggggcattgctgtgggcctgctgtgccagtttggcctgatgcccttcaccgcctacctgctggccatctccttcagcctgaagcctgtgcaggccatcgctgtgctgatcatgggctgctgccctgggggcaccatcagcaacatcttcaccttctgggtggatggagacatggacctgagcatctccatgaccacctgcagcacagtggccgccctgggcatgatgcccctgtgcatctacctgtacacctggagctggagcctgcagcagaacctgaccatcccctaccagaacatcggcatcaccctggtgtgcctgaccatccctgtggccttcggcgtgtatgtgaactaccgctggcccaagcagagcaagatcatcctgaagatcggggctgtggtgggcggcgtgctgctgctggtggtggccgtggccggcgtggtgctggccaagggctcctggaacagcgacatcaccctgctgaccatctccttcatcttccccctcatcggccacgtgacaggcttcctgctggccctcttcacccaccagagctggcagcgctgcaggaccatcagcctggagaccggggcccagaacatccagatgtgcatcaccatgctgcagctgtccttcaccgctgagcacctggtgcagatgctgtccttccccctggcctacggcctcttccagctgattgatggcttcctgattgtggccgcctaccagacctacaagaggcggctgaagaacaagcacggcaagaagaacagcggctgcacagaggtgtgccacaccaggaagagcaccagcagccgggagaccaatgccttcctggaggtgaatgaggagggcgccatcaccccaggccccccaggccccatggactgccaccgggccctggagcctgtgggccacatcaccagctgtgagtag

SEQ ID NO: 170159 - DNA, 2184 bp, Artificial Sequence; identical to SEQ ID NO: 161162
  Description of Artificial Sequence: Synthetic coding sequence

SEQ ID NO: 170160 - DNA, 492 bp, Artificial Sequence
  Description of Artificial Sequence: Synthetic coding sequence
atgaccggggacaagggcccccagaggctgagcggcagcagctatggcagcatcagcagccccaccagccccaccagccctggcccccagcaggccccaccccgggagacctacctgtctgagaagatccccatcccagacaccaagccaggcaccttcagcctgaggaagctgtgggccttcaccggccctggcttcctgatgagcatcgccttcctggaccccggcaacatcgagagtgacctgcaggccggggctgtggccggcttcaagctgctgtgggtgctgctgtgggccaccgtgctgggcctgctgtgccagaggctggccgcccggctgggcgtggtgacaggcaaggacctgggggaggtgtgccacctgtactaccccaagtctgagagccgctctgtggcccagagcggcgtgcagtggtgtgatgtgagcagcctgcagcccctgcccccacgctgcccagcccccagcagcggctag

SEQ ID NO: 170161 - DNA, 1299 bp, Artificial Sequence
  Description of Artificial Sequence: Synthetic coding sequence
atggtgcgctgccagctgacagccaccagcaccagccaggtgcccaggacagtgctgtggctgaccatcgagctggccatcgtgggcagtgacatgcaggaggtgattggaacagccatcgccttcaacctgctgtctgctggccgcatccccctgtggggcggcgtgctgatcaccatcgtggacaccttcttcttcctgttcctggacaactacggcctgaggaagctggaggccttcttcggcctgctgatcaccatcatggccctgaccttcggctatgaatatgtggtggcccggcctgagcagggcgccctgctgcggggcctcttcctgcccagctgccccggctgcggccaccctgagctgctgcaggccgtgggcatcgtgggcgccatcatcatgccccacaacatctacctgcacagcgccctggtgaagagccgggagattgaccgggccaggagagctgacatccgggaggccaacatgtacttcctgattgaggccaccatcgccctgtctgtgtccttcatcatcaacctgtttgtgatggctgtgtttggccaggccttctaccagaagaccaaccaggccgccttcaacatctgtgccaacagcagcctgcatgactatgccaagatcttccccatgaacaatgccaccgtggccgtggacatctaccagggcggcgtcatcctgggctgcctgtttggacctgctgccctgtacatctgggccatcggcctgctggccgccggccagagcagcaccatgacaggcacctacgccggccagtttgtgatggagggcttcctgcggctgcgctggagcagatttgcccgggtgctgctgaccaggagctgtgccatcctgcccaccgtgctggtggccgtgttccgggacctgcgggacctgagcggcctgaatgacctgctgaatgtgctgcagagcctgctgctgccctttgctgtgctgcccatcctgaccttcacctccatgcccaccctgatgcaggagtttgccaacggcctgctgaacaaggtggtgaccagcagcatcatggtgctggtgtgtgccatcaacctgtactttgtggtgtcctacctgcccagcctgccccacccagcctacttcggcctggccgccctgctggccgccgcctacctgggcctgagcacctacctggtgtggacctgctgcctggcccacggggccaccttcctggcccacagcagccaccaccacttcctgtatggcctgctggaggaggaccagaagggggagaccagcggctag

SEQ ID NO: 170162 - DNA, 3351 bp, Artificial Sequence
  Description of Artificial Sequence: Synthetic coding sequence
atgctgaacaacctgacagactgtgaagatggagatggaggagccaaccctggagatggcaaccccaaggagagcagccccttcatcaacagcacagacacagagaagggcaaggagtatgatggcaagaacatggccctgtttgaggaggagatggacaccagccccatggtgagcagcctgctgagcggcctggccaactacaccaacctgccccagggcagccgggagcacgaggaggccgagaacaatgaaggaggcaagaagaagcctgtgcaggcccccaggatgggcaccttcatgggcgtgtacctgccctgcctgcagaacatctttggagtcatcctcttcctgcggctgacctgggtggtgggcattgctggcatcatggagagcttctgcatggtgttcatctgctgcagctgcaccatgctgacagccatctccatgtctgccatcgccaccaacggggtggtgcctgctgggggcagctactacatgatcagccgcagcctgggccctgagtttggaggagctgtgggcctgtgcttctacctgggcaccacctttgctggggccatgtacatcctgggcaccatcgagatcctgctggcctacctgtttcctgccatggccatcttcaaggcagaagatgccagcggggaggccgccgccatgctgaacaacatgagggtgtatggcacctgtgtgctgacctgcatggccaccgtggtgtttgtgggcgtgaagtatgtgaacaagtttgccctggtgttcctgggctgcgtcatcctgagcatcctggccatctatgctggggtcatcaagagcgcctttgatcctcccaacttccccatctgcctgctgggcaacagaaccctgagcagacatggctttgatgtgtgtgccaagctggcctgggagggcaatgagaccgtgaccacccggctgtggggcctcttctgcagcagccgcttcctgaatgccacctgtgatgagtacttcaccagaaataatgtgacagagatccagggcatccctggagctgccagcggcctcatcaaggagaacctgtggagcagctacctgaccaagggcgtcatcgtggagaggagcggcatgacctctgtgggcctggctgatggcacccccatcgacatggaccacccctacgtgttcagtgacatgaccagctacttcaccctgctggtgggcatctacttccccagcgtgacaggcatcatggccggcagcaacagaagtggggacctgagagatgcccagaagagcatccccaccggcaccatcctggccatcgccaccaccagcgctgtgtacatcagctctgtggtgctgtttggagcctgcattgaaggagtggtgctgcgggacaagtttggagaggccgtgaatggaaacctggtggtgggcaccctggcctggcccagcccctgggtgattgtgattggcagcttcttcagcacctgtggggccggcctgcagagcctgaccggggccccccggctgctgcaggccatcagcagagatggcatcgtgcccttcctgcaggtgtttggacatggcaaggccaatggagagcccacctgggccctgctgctgacagcctgcatctgtgaaattggcatcctgattgccagcctggatgaggtggcccccatcctgtccatgttcttcctgatgtgctacatgtttgtgaacctggcctgtgctgtgcagaccctgctgcggacccccaactggaggccccgcttccgctactaccactggaccctgtccttcctgggcatgagcctgtgcctggccctgatgttcatctgctcctggtactatgccctggtggccatgctgattgctggcctcatctacaagtacatcgagtacagaggagctgagaaggagtggggagatggcatccggggcctgagcctgtctgctgcccgctatgccctgctgcggctggaggagggccccccccacaccaagaactggaggccccagctgctggtgctggtgcgggtggaccaggaccagaatgtggtgcacccccagctgctgagcctgaccagccagctgaaggccggcaagggcctgaccatcgtgggctctgtgctggagggcaccttcctggagaaccacccccaggcccagagagctgaggagagcatccggcggctgatggaggccgagaaggtgaagggcttctgccaggtggtgatcagcagcaacctgagagatggagtgagccacctgatccagagcggcggcctgggcggcctgcagcacaacacagtgctggtgggctggcccaggaactggaggcagaaggaggaccaccagacctggaggaacttcatcgagctggtgcgggagaccacagctggccacctggccctgctggtgaccaagaatgtgtccatgtttcctggcaaccctgagcgcttcagcgagggcagcattgatgtgtggtggatcgtgcatgatggcggcatgctgatgctgctgcccttcctgctgcggcaccacaaggtgtggaggaagtgcaagatgaggatcttcaccgtggcccagatggatgacaacagcatccagatgaagaaggacctgaccaccttcctgtaccacctgcgcatcacagctgaggtggaggtggtggagatgcatgaaagtgacatcagcgcctacacctatgagaagaccctggtgatggagcagaggagccagatcctgaagcagatgcacctgaccaagaatgaaagagagcgggagatccagagcatcacagatgagagccggggcagcatccggaggaagaacccagccaacacccggctgcggctgaatgtgcctgaggagacagctggggacagcgaggagaagccagaggaggaggtgcagctgattcatgaccagagcgcccccagctgccccagcagcagccccagccctggagaggagcctgagggggagggggagacagatcctgagaaggtgcacctgacctggaccaaggacaagtctgtggccgagaagaacaagggccccagccctgtgagcagcgagggcatcaaggacttcttctccatgaagccagagtgggagaacctgaaccagagcaatgtgcggaggatgcacacagctgtgcggctgaatgaagtcatcgtgaagaagagcagagatgccaagctggtgctgctgaacatgcctggccccccaagaaacagaaatggagatgagaactacatggagttcctggaggtgctgacagagcacctggacagagtgatgctggtgcggggcggcggccgggaggtgatcaccatctacagctag

SEQ ID NO: 170163 - DNA, 858 bp, Artificial Sequence
  Description of Artificial Sequence: Synthetic coding sequence
atgctgaacaacctgacagactgtgaagatggagatggaggagccaaccctggagatggcaaccccaaggagagcagccccttcatcaacagcacagacacagagaagggcaaggagtatgatggcaagaacatggccctgtttgaggaggagatggacaccagccccatggtgagcagcctgctgagcggcctggccaactacaccaacctgccccagggcagccgggagcacgaggaggccgagaacaatgaaggaggcaagaagaagcctgtgcaggcccccaggatgggcaccttcatgggcgtgtacctgccctgcctgcagaacatctttggagtcatcctcttcctgcggctgacctgggtggtgggcattgctggcatcatggagagcttctgcatggtgttcatctgctgcagctgcaccatgctgacagccatctccatgtctgccatcgccaccaacggggtggtgcctgctgggggcagctactacatgatcagccgcagcctgggccctgagtttggaggagctgtgggcctgtgcttctacctgggcaccacctttgctggggccatgtacatcctgggcaccatcgagatcctgctggcctacctgtttcctgccatggccatcttcaaggcagaagatgccagcggggaggccgccgccatgctgaacaacatgagggtgtatggcacctgtgtgctgacctgcatggccaccgtggtgtttgtgggcgtgaagtatgtgaacaagtttgccctggtgttcctgggctgcgtcatcctgagcatcctggccatctatgctggggtcatcaagagcgcctttgatcctcccaacttcccctag

SEQ ID NO: 170164 - DNA, 3420 bp, Artificial Sequence
  Description of Artificial Sequence: Synthetic coding sequence
atgagccgccgcttcaccgtgaccagcctgcccccagctggccctgcccggagcccagaccctgagagccgccgccacagcgtggccgaccccaggcacctgcctggagaagatgtgaagggagatggcaaccccaaggagagcagccccttcatcaacagcacagacacagagaagggcaaggagtatgatggcaagaacatggccctgtttgaggaggagatggacaccagccccatggtgagcagcctgctgagcggcctggccaactacaccaacctgccccagggcagccgggagcacgaggaggctgaaaataatgaaggaggcaagaagaagcctgtgcaggcccccaggatgggcaccttcatgggcgtgtacctgccctgcctgcagaacatctttggagtcatcctcttcctgcggctgacctgggtggtgggcattgctggcatcatggagagcttctgcatggtgttcatctgctgcagctgcaccatgctgacagccatctccatgtctgccatcgccaccaatggagtggtgcctgctgggggcagctactacatgatcagccgcagcctgggccctgagtttggaggagctgtgggcctgtgcttctacctgggcaccacctttgctggggccatgtacatcctgggcaccatcgagatcctgctggcctacctgtttcctgccatggccatcttcaaggccgaggatgccagcggggaggccgccgccatgctgaacaacatgagggtgtatggcacctgtgtgctgacctgcatggccaccgtggtgtttgtgggcgtgaagtatgtgaacaagtttgccctggtgttcctgggctgtgtgatcctgagcatcctggccatctatgctggggtcatcaagagcgcctttgacccccccaacttccccatctgcctgctgggcaacagaaccctgagccgccacggctttgatgtgtgtgccaagctggcctgggagggcaatgaaacagtgaccacccggctgtggggcctcttctgcagcagccgcttcctgaatgccacctgtgatgagtacttcaccaggaacaacgtgacagagatccagggcatccctggggccgccagcggcctcatcaaggagaacctgtggagcagctacctgaccaagggcgtgattgtggagaggagcggcatgacctctgtgggcctggctgatggcacccccatcgacatggaccacccctacgtgttcagtgacatgaccagctacttcaccctgctggtgggcatctacttccccagcgtgacaggcatcatggccggcagcaacagaagtggggacctgagagatgcccagaagagcatccccaccggcaccatcctggccatcgccaccaccagcgctgtgtacatcagctctgtggtgctgtttggagcctgcatcgagggcgtggtgctgcgggacaagtttggagaggccgtgaatggaaacctggtggtgggcaccctggcctggcccagcccctgggtgattgtcatcggcagcttcttcagcacctgtggggccggcctgcagagcctgactggagccccccggctgctgcaggccatcagcagagatggcatcgtgcccttcctgcaggtgtttggccacggcaaggccaacggggagcccacctgggccctgctgctgacagcctgcatctgtgagatcggcatcctgattgccagcctggatgaggtggcccccatcctgtccatgttcttcctgatgtgctacatgtttgtgaacctggcctgtgctgtgcagaccctgctgcggacccccaactggaggccccgcttccgctactaccactggaccctgtccttcctgggcatgagcctgtgcctggccctgatgttcatctgctcctggtactatgccctggtggccatgctgattgctggcctcatctacaagtacatcgagtacagaggagctgagaaggagtggggagatggcatccggggcctgagcctgtctgctgcccgctatgccctgctgcggctggaggagggccccccccacaccaagaactggaggccccagctgctggtgctggtgcgggtggaccaggaccagaatgtggtgcacccccagctgctgagcctgaccagccagctgaaggccggcaagggcctgaccatcgtgggctctgtgctggagggcaccttcctggagaaccacccccaggcccagagagctgaggagagcatccggcggctgatggaggccgagaaggtgaagggcttctgccaggtggtgatcagcagcaacctgagagatggagtgagccacctgatccagagcggcggcctgggcggcctgcagcacaacacagtgctggtgggctggcccaggaactggaggcagaaggaggaccaccagacctggaggaacttcatcgagctggtgcgggagaccacagctggccacctggccctgctggtgaccaagaatgtgtccatgtttcctggcaaccctgagcgcttcagcgagggcagcattgatgtgtggtggatcgtgcatgatggcggcatgctgatgctgctgcccttcctgctgcggcaccacaaggtgtggaggaagtgcaagatgaggatcttcaccgtggcccagatggatgacaacagcatccagatgaagaaggacctgaccaccttcctgtaccacctgcgcatcacagctgaggtggaggtggtggagatgcatgaaagtgacatcagcgcctacacctatgagaagaccctggtgatggagcagaggagccagatcctgaagcagatgcacctgaccaagaatgaaagagagcgggagatccagagcatcacagatgagagccggggcagcatccggaggaagaacccagccaacacccggctgcggctgaatgtgcctgaggagacagctggggacagcgaggagaagccagaggaggaggtgcagctgattcatgaccagagcgcccccagctgccccagcagcagccccagccctggagaggagcctgagggggagggggagacagatcctgagaaggtgcacctgacctggaccaaggacaagtctgtggccgagaagaacaagggccccagccctgtgtcctctgagggcatcaaggacttcttctccatgaagccagagtgggagaacctgaaccagagcaatgtgcggaggatgcacacagctgtgcggctgaatgaggtgattgtgaagaagagcagagatgccaagctggtgctgctgaacatgcctggcccccccaggaacagaaatggagatgagaactacatggagttcctggaggtgctgacagagcacctggacagagtgatgctggtgcggggcggcggccgggaggtgatcaccatctacagctag

SEQ ID NO: 170165 - DNA, 561 bp, Artificial Sequence
  Description of Artificial Sequence: Synthetic coding sequence
atgctgaacaacctgacagactgtgaagatggagatggaggagccaaccctggagatggcaaccccaaggagagcagccccttcatcaacagcacagacacagagaagggcaaggagtatgatggcaagaacatggccctgtttgaggaggagatggacaccagccccatggtgagcagcctgctgagcggcctggccaactacaccaacctgccccagggcagccgggagcacgaggaggccgagaacaatgaaggaggcaagaagaagcctgtgcaggcccccaggatgggcaccttcatgggcgtgtacctgccctgcctgcagaacatctttggagtcatcctcttcctgcggctgacctgggtggtgggcattgctggcatcatggagagcttctgcatggtgttcatctgctgcagctgcaccatgctgacagccatctccatgtctgccatcgccaccaacggggtggtgcctgctgggggcagctactacatgatcagccgcagcctggccatggcccggcccatggagagccggcccggcccctgcagctag

SEQ ID NO: 170166 - DNA, 3258 bp, Artificial Sequence
  Description of Artificial Sequence: Synthetic coding sequence
atgccccacttcaccgtggtgcctgtggatggccccaggagaggagactatgacaacctggagggcctgtcctgggtggactatggagagcgggcagagctggatgacagtgatggccacggcaaccaccgggagagcagccccttcctgagccccctggaggccagccggggcatcgactactatgacaggaacctggccctgtttgaggaggagctggacatccggcccaaggtgagcagcctgctgggcaagctggtgtcctacaccaacctgacccagggcgccaaggagcacgaggaggccgagagcggggagggcacccggcggcgggctgctgaggcccccagcatgggcaccctgatgggcgtgtacctgccctgcctgcagaacatctttggagtcatcctcttcctgcggctgacctggatggtgggcacagctggggtgctgcaggccctgctgattgtgctgatctgctgctgctgcaccctgctgacagccatctccatgtctgccatcgccaccaatggagtggtgcctgctgggggcagctacttcatgatcagccgcagcctgggccctgagtttggaggagctgtgggcctgtgcttctacctgggcaccacctttgctgctgccatgtacatcctgggcgccatcgagatcctgctgacctacatcgcccccccagctgccatcttctaccccagcggggcccatgacaccagcaatgccaccctgaacaacatgagggtgtatggcaccatcttcctgaccttcatgaccctggtggtgtttgtgggcgtgaagtatgtgaacaagtttgccagcctcttcctggcctgtgtgatcatcagcatcctgagcatctatgccggcggcatcaagagcatctttgacccccctgtgtttcctgtgtgcatgctgggcaacagaaccctgagccgggaccagtttgacatctgtgccaagacagctgtggtggacaatgaaacagtggccacccagctgtggagcttcttctgccacagccccaacctgaccacagacagctgtgacccctacttcatgctgaacaacgtgacagagatccctggcatccctggagctgctgctggggtgctgcaggagaacctgtggagcgcctacctggagaagggggacatcgtggagaagcacggcctgcccagcgcagatgcccccagcctgaaggagagcctgcccctgtatgtggtggccgacatcgccaccagcttcaccgtgctggtgggcatcttcttccccagcgtgacaggcatcatggccggcagcaacagaagtggggacctgagagatgcccagaagagcatccctgtgggcaccatcctggccatcatcaccaccagcctggtgtacttcagctctgtggtgctgtttggagcctgcattgaaggagtggtgctgcgggacaagtatggagatggagtgtccaggaacctggtggtgggcaccctggcctggcccagcccctgggtgattgtgattggcagcttcttcagcacctgtggggccggcctgcagagcctgaccggggccccccggctgctgcaggccatcgccaaggacaacatcatccccttcctgcgggtgtttggacatggcaaggtgaatggagagcccacctgggccctgctgctgacagccctgattgctgagctgggcatcctgattgccagcctggacatggtggcccccatcctgtccatgttcttcctgatgtgctacctgtttgtgaacctggcctgtgctgtgcagaccctgctgcggacccccaactggaggccccgcttcaagtactaccactgggccctgtccttcctgggcatgagcctgtgcctggccctgatgtttgtgtcctcctggtactatgccctggtggccatgctgattgctggcatgatctacaagtacatcgagtaccagggcgctgagaaggagtggggagatggcatccggggcctgagcctgtctgctgcccgctatgccctgctgcggctggaggagggccccccccacaccaagaactggaggccccagctgctggtgctgctgaagctggatgaggacctgcacgtgaagtacccccggctgctgacctttgccagccagctgaaggccggcaagggcctgaccatcgtgggcagcgtcatccagggcagcttcctggagagctatggagaggcccaggccgctgagcagaccatcaagaacatgatggagattgagaaggtgaagggcttctgccaggtggtggtggccagcaaggtgcgggagggcctggcccacctgatccagagctgtggcctgggcggcatgaggcacaacagcgtggtgctgggctggccctacggctggaggcagagcgaggacccccgggcctggaagaccttcatcgacacagtgcgctgcaccacagctgcccacctggccctgctggtgcccaagaacatcgccttctaccccagcaaccacgagcgctacctggagggccacattgatgtgtggtggatcgtgcatgatggcggcatgctgatgctgctgcccttcctgctgcggcagcacaaggtgtggaggaaatgtaggatgaggatcttcaccgtggcccagatggatgacaacagcatccagatgaagaaggacctggccgtgttcctgtaccacctgcggctggaggccgaggtggaggtggtggagatgcacaacagcgacatcagcgcctacacctatgaaagaaccctgatgatggagcagaggagccagatgctgcggcagatgaggctgaccaagacagagcgggagcgggaggcccagctggtgaaggacagacacagcgccctgcggctggagagcctgtacagtgatgaggaggatgaatctgctgtgggcgctgacaagatccagatgacctggacccgggacaagtacatgacagagacctgggaccccagccacgccccagacaacttccgggagctggtgcacatcaagccagaccagagcaatgtgcggaggatgcacacagctgtgaagctgaatgaggtgattgtgaccaggagccatgatgcccggctggtgctgctgaacatgcctggcccccccaggaacagtgaaggagatgagaactacatggagttcctggaggtgctgacagagggcctggagcgggtgctgctggtgcggggcggcggccgggaggtgatcaccatctacagctag

SEQ ID NO: 170167 - DNA, 2343 bp, Artificial Sequence
  Description of Artificial Sequence: Synthetic coding sequence
atgccccacttcaccgtggtgcctgtggatggccccaggagaggagactatgacaacctggagggcctgtcctgggtggactatggagagcgggcagagctggatgacagtgatggccacggcaaccaccgggagagcagccccttcctgagccccctggaggccagccggggcatcgactactatgacaggaacctggccctgtttgaggaggagctggacatccggcccaaggtgagcagcctgctgggcaagctggtgtcctacaccaacctgacccagggcgccaaggagcacgaggaggccgagagcggggagggcacccggcggcgggctgctgaggcccccagcatgggcaccctgatgggcgtgtacctgccctgcctgcagaacatctttggagtcatcctcttcctgcggctgacctggatggtgggcacagctggggtgctgcaggccctgctgattgtgctgatctgctgctgctgcaccctgctgacagccatctccatgtctgccatcgccaccaatggagtggtgcctgctgggggcagctacttcatgatcagccgcagcctgggccctgagtttggaggagctgtgggcctgtgcttctacctgggcaccacctttgctgctgccatgtacatcctgggcgccatcgagatcctgctgacctacatcgcccccccagctgccatcttctaccccagcggggcccatgacaccagcaatgccaccctgaacaacatgagggtgtatggcaccatcttcctgaccttcatgaccctggtggtgtttgtgggcgtgaagtatgtgaacaagtttgccagcctcttcctggcctgtgtgatcatcagcatcctgagcatctatgccggcggcatcaagagcatctttgacccccctgtgtttcctgtgtgcatgctgggcaacagaaccctgagccgggaccagtttgacatctgtgccaagacagctgtggtggacaatgaaacagtggccacccagctgtggagcttcttctgccacagccccaacctgaccacagacagctgtgacccctacttcatgctgaacaacgtgacagagatccctggcatccctggagctgctgctggggtgctgcaggagaacctgtggagcgcctacctggagaagggggacatcgtggagaagcacggcctgcccagcgcagatgcccccagcctgaaggagagcctgcccctgtatgtggtggccgacatcgccaccagcttcaccgtgctggtgggcatcttcttccccagcgtgacaggcatcatggccggcagcaacagaagtggggacctgagagatgcccagaagagcatccctgtgggcaccatcctggccatcatcaccaccagcctggtgtacttcagctctgtggtgctgtttggagcctgcattgaaggagtggtgctgcgggacaagtatggagatggagtgtccaggaacctggtggtgggcaccctggcctggcccagcccctgggtgattgtgattggcagcttcttcagcacctgtggggccggcctgcagagcctgaccggggccccccggctgctgcaggccatcgccaaggacaacatcatccccttcctgcgggtgtttggacatggcaaggtgaatggagagcccacctgggccctgctgctgacagccctgattgctgagctgggcatcctgattgccagcctggacatggtggcccccatcctgtccatgttcttcctgatgtgctacctgtttgtgaacctggcctgtgctgtgcagaccctgctgcggacccccaactggaggccccgcttcaagtactaccactgggccctgtccttcctgggcatgagcctgtgcctggccctgatgtttgtgtcctcctggtactatgccctggtggccatgctgattgctggcatgatctacaagtacatcgagtaccagggcgctgagaaggagtggggagatggcatccggggcctgagcctgtctgctgcccgctatgccctgctgcggctggaggagggccccccccacaccaagaactggaggccccagctgctggtgctgctgaagctggatgaggacctgcacgtgaagtacccccggctgctgacctttgccagccagctgaaggccggcaagggcctgaccatcgtgggcagcgtcatccagggcagcttcctggagagctatggagaggcccaggccgctgagcagaccccctgtgccgccctgcggctgcccacctggccctgcagctgccccaggaccagccccagcaccccagccaccaccagcgccacctggagggccacctag

SEQ ID NO: 170168 - DNA, 3264 bp, Artificial Sequence
  Description of Artificial Sequence: Synthetic coding sequence
atgagagctggaggagcctgcaggcctggagctgctggaacagctgctggaacagctgctgggggctgggatggcggctgcggcggcgctgagcccgcccgctgcctgaccagcccctggtgccagtggacaggccgcggggccgccaccatgaccaccagccggggctctgtgggctggaccaccggcagcgcccccagctggatgaccaggacagaggagctggacatccggcccaaggtgagcagcctgctgggcaagctggtgtcctacaccaacctgacccagggcgccaaggagcacgaggaggccgagagcggggagggcacccggcggcgggctgctgaggcccccagcatgggcaccctgatgggcgtgtacctgccctgcctgcagaacatctttggagtcatcctcttcctgcggctgacctggatggtgggcacagctggggtgctgcaggccctgctgattgtgctgatctgctgctgctgcaccctgctgacagccatctccatgtctgccatcgccaccaatggagtggtgcctgctgggggcagctacttcatgatcagccgcagcctgggccctgagtttggaggagctgtgggcctgtgcttctacctgggcaccacctttgctgctgccatgtacatcctgggcgccatcgagatcctgctgacctacatcgcccccccagctgccatcttctaccccagcggggcccatgacaccagcaatgccaccctgaacaacatgagggtgtatggcaccatcttcctgaccttcatgaccctggtggtgtttgtgggcgtgaagtatgtgaacaagtttgccagcctcttcctggcctgtgtgatcatcagcatcctgagcatctatgccggcggcatcaagagcatctttgacccccctgtgtttcctgtgtgcatgctgggcaacagaaccctgagccgggaccagtttgacatctgtgccaagacagctgtggtggacaatgaaacagtggccacccagctgtggagcttcttctgccacagccccaacctgaccacagacagctgtgacccctacttcatgctgaacaacgtgacagagatccctggcatccctggagctgctgctggggtgctgcaggagaacctgtggagcgcctacctggagaagggggacatcgtggagaagcacggcctgcccagcgcagatgcccccagcctgaaggagagcctgcccctgtatgtggtggccgacatcgccaccagcttcaccgtgctggtgggcatcttcttccccagcgtgacaggcatcatggccggcagcaacagaagtggggacctgagagatgcccagaagagcatccctgtgggcaccatcctggccatcatcaccaccagcctggtgtacttcagctctgtggtgctgtttggagcctgcattgaaggagtggtgctgcgggacaagtatggagatggagtgtccaggaacctggtggtgggcaccctggcctggcccagcccctgggtgattgtgattggcagcttcttcagcacctgtggggccggcctgcagagcctgaccggggccccccggctgctgcaggccatcgccaaggacaacatcatccccttcctgcgggtgtttggacatggcaaggtgaatggagagcccacctgggccctgctgctgacagccctgattgctgagctgggcatcctgattgccagcctggacatggtggcccccatcctgtccatgttcttcctgatgtgctacctgtttgtgaacctggcctgtgctgtgcagaccctgctgcggacccccaactggaggccccgcttcaagtactaccactgggccctgtccttcctgggcatgagcctgtgcctggccctgatgtttgtgtcctcctggtactatgccctggtggccatgctgattgctggcatgatctacaagtacatcgagtaccagggcgctgagaaggagtggggagatggcatccggggcctgagcctgtctgctgcccgctatgccctgctgcggctggaggagggccccccccacaccaagaactggaggccccagctgctggtgctgctgaagctggatgaggacctgcacgtgaagtacccccggctgctgacctttgccagccagctgaaggccggcaagggcctgaccatcgtgggcagcgtcatccagggcagcttcctggagagctatggagaggcccaggccgctgagcagaccatcaagaacatgatggagattgagaaggtgaagggcttctgccaggtggtggtggccagcaaggtgcgggagggcctggcccacctgatccagagctgtggcctgggcggcatgaggcacaacagcgtggtgctgggctggccctacggctggaggcagagcgaggacccccgggcctggaagaccttcatcgacacagtgcgctgcaccacagctgcccacctggccctgctggtgcccaagaacatcgccttctaccccagcaaccacgagcgctacctggagggccacattgatgtgtggtggatcgtgcatgatggcggcatgctgatgctgctgcccttcctgctgcggcagcacaaggtgtggaggaaatgtaggatgaggatcttcaccgtggcccagatggatgacaacagcatccagatgaagaaggacctggccgtgttcctgtaccacctgcggctggaggccgaggtggaggtggtggagatgcacaacagcgacatcagcgcctacacctatgaaagaaccctgatgatggagcagaggagccagatgctgcggcagatgaggctgaccaagacagagcgggagcgggaggcccagctggtgaaggacagacacagcgccctgcggctggagagcctgtacagtgatgaggaggatgaatctgctgtgggcgctgacaagatccagatgacctggacccgggacaagtacatgacagagacctgggaccccagccacgccccagacaacttccgggagctggtgcacatcaagccagaccagagcaatgtgcggaggatgcacacagctgtgaagctgaatgaggtgattgtgaccaggagccatgatgcccggctggtgctgctgaacatgcctggcccccccaggaacagtgaaggagatgagaactacatggagttcctggaggtgctgacagagggcctggagcgggtgctgctggtgcggggcggcggccgggaggtgatcaccatctacagctag

SEQ ID NO: 170169 - DNA, 3240 bp, Artificial Sequence
  Description of Artificial Sequence: Synthetic coding sequence
atggctgctgagggcgctgtgtgtggctttgtgtacctggagggcacagcctgggccgtgcctgaggacacagagcccctggccagctgcaccctgggccacggcaaccaccgggagagcagccccttcctgagccccctggaggccagccggggcatcgactactatgacaggaacctggccctgtttgaggaggagctggacatccggcccaaggtgagcagcctgctgggcaagctggtgtcctacaccaacctgacccagggcgccaaggagcacgaggaggccgagagcggggagggcacccggcggcgggctgctgaggcccccagcatgggcaccctgatgggcgtgtacctgccctgcctgcagaacatctttggagtcatcctcttcctgcggctgacctggatggtgggcacagctggggtgctgcaggccctgctgattgtgctgatctgctgctgctgcaccctgctgacagccatctccatgtctgccatcgccaccaatggagtggtgcctgctgggggcagctacttcatgatcagccgcagcctgggccctgagtttggaggagctgtgggcctgtgcttctacctgggcaccacctttgctgctgccatgtacatcctgggcgccatcgagatcctgctgacctacatcgcccccccagctgccatcttctaccccagcggggcccatgacaccagcaatgccaccctgaacaacatgagggtgtatggcaccatcttcctgaccttcatgaccctggtggtgtttgtgggcgtgaagtatgtgaacaagtttgccagcctcttcctggcctgtgtgatcatcagcatcctgagcatctatgccggcggcatcaagagcatctttgacccccctgtgtttcctgtgtgcatgctgggcaacagaaccctgagccgggaccagtttgacatctgtgccaagacagctgtggtggacaatgaaacagtggccacccagctgtggagcttcttctgccacagccccaacctgaccacagacagctgtgacccctacttcatgctgaacaacgtgacagagatccctggcatccctggagctgctgctggggtgctgcaggagaacctgtggagcgcctacctggagaagggggacatcgtggagaagcacggcctgcccagcgcagatgcccccagcctgaaggagagcctgcccctgtatgtggtggccgacatcgccaccagcttcaccgtgctggtgggcatcttcttccccagcgtgacaggcatcatggccggcagcaacagaagtggggacctgagagatgcccagaagagcatccctgtgggcaccatcctggccatcatcaccaccagcctggtgtacttcagctctgtggtgctgtttggagcctgcattgaaggagtggtgctgcgggacaagtatggagatggagtgtccaggaacctggtggtgggcaccctggcctggcccagcccctgggtgattgtgattggcagcttcttcagcacctgtggggccggcctgcagagcctgaccggggccccccggctgctgcaggccatcgccaaggacaacatcatccccttcctgcgggtgtttggacatggcaaggtgaatggagagcccacctgggccctgctgctgacagccctgattgctgagctgggcatcctgattgccagcctggacatggtggcccccatcctgtccatgttcttcctgatgtgctacctgtttgtgaacctggcctgtgctgtgcagaccctgctgcggacccccaactggaggccccgcttcaagtactaccactgggccctgtccttcctgggcatgagcctgtgcctggccctgatgtttgtgtcctcctggtactatgccctggtggccatgctgattgctggcatgatctacaagtacatcgagtaccagggcgctgagaaggagtggggagatggcatccggggcctgagcctgtctgctgcccgctatgccctgctgcggctggaggagggccccccccacaccaagaactggaggccccagctgctggtgctgctgaagctggatgaggacctgcacgtgaagtacccccggctgctgacctttgccagccagctgaaggccggcaagggcctgaccatcgtgggcagcgtcatccagggcagcttcctggagagctatggagaggcccaggccgctgagcagaccatcaagaacatgatggagattgagaaggtgaagggcttctgccaggtggtggtggccagcaaggtgcgggagggcctggcccacctgatccagagctgtggcctgggcggcatgaggcacaacagcgtggtgctgggctggccctacggctggaggcagagcgaggacccccgggcctggaagaccttcatcgacacagtgcgctgcaccacagctgcccacctggccctgctggtgcccaagaacatcgccttctaccccagcaaccacgagcgctacctggagggccacattgatgtgtggtggatcgtgcatgatggcggcatgctgatgctgctgcccttcctgctgcggcagcacaaggtgtggaggaaatgtaggatgaggatcttcaccgtggcccagatggatgacaacagcatccagatgaagaaggacctggccgtgttcctgtaccacctgcggctggaggccgaggtggaggtggtggagatgcacaacagcgacatcagcgcctacacctatgaaagaaccctgatgatggagcagaggagccagatgctgcggcagatgaggctgaccaagacagagcgggagcgggaggcccagctggtgaaggacagacacagcgccctgcggctggagagcctgtacagtgatgaggaggatgaatctgctgtgggcgctgacaagatccagatgacctggacccgggacaagtacatgacagagacctgggaccccagccacgccccagacaacttccgggagctggtgcacatcaagccagaccagagcaatgtgcggaggatgcacacagctgtgaagctgaatgaggtgattgtgaccaggagccatgatgcccggctggtgctgctgaacatgcctggcccccccaggaacagtgaaggagatgagaactacatggagttcctggaggtgctgacagagggcctggagcgggtgctgctggtgcggggcggcggccgggaggtgatcaccatctacagctag

SEQ ID NO: 170170 - DNA, 3165 bp, Artificial Sequence
  Description of Artificial Sequence: Synthetic coding sequence
atgggagacaccctgagccctggccacggcaaccaccgggagagcagccccttcctgagccccctggaggccagccggggcatcgactactatgacaggaacctggccctgtttgaggaggagctggacatccggcccaaggtgagcagcctgctgggcaagctggtgtcctacaccaacctgacccagggcgccaaggagcacgaggaggccgagagcggggagggcaccaggagaagagctgctgaggcccccagcatgggcaccctgatgggcgtgtacctgccctgcctgcagaacatctttggagtcatcctcttcctgcggctgacctggatggtgggcacagctggggtgctgcaggccctgctgattgtgctgatctgctgctgctgcaccctgctgacagccatctccatgtctgccatcgccaccaacggggtggtgcctgctgggggcagctacttcatgatcagccgcagcctgggccctgagtttggaggagctgtgggcctgtgcttctacctgggcaccacctttgctgctgccatgtacatcctgggcgccatcgagatcctgctgacctacatcgcccctcctgctgccatcttctaccccagcggggcccatgacaccagcaatgccaccctgaacaacatgagggtgtatggcaccatcttcctgaccttcatgaccctggtggtgtttgtgggcgtgaagtatgtgaacaagtttgccagcctcttcctggcctgcgtcatcatcagcatcctgagcatctatgctgggggcatcaagagcatctttgatcctcctgtgtttcctgtgtgcatgctgggcaacagaaccctgagccgggaccagtttgacatctgtgccaagacagctgtggtggacaatgagaccgtggccacccagctgtggagcttcttctgccacagccccaacctgaccacagacagctgtgacccctacttcatgctgaacaacgtgacagagatccctggcatccctggagctgctgctggggtgctgcaggagaacctgtggagcgcctacctggagaagggggacatcgtggagaagcacggcctgcccagcgcagatgcccccagcctgaaggagagcctgcccctgtatgtggtggccgacatcgccaccagcttcaccgtgctggtgggcatcttcttccccagcgtgacaggcatcatggccggcagcaacagaagtggggacctgagagatgcccagaagagcatccctgtgggcaccatcctggccatcatcaccaccagcctggtgtacttcagctctgtggtgctgtttggagcctgcatcgagggcgtggtgctgcgggacaagtatggagatggagtgtccaggaacctggtggtgggcaccctggcctggcccagcccctgggtgattgtcatcggcagcttcttcagcacctgtggggccggcctgcagagcctgactggagccccccggctgctgcaggccatcgccaaggacaacatcatccccttcctgcgggtgtttggccacggcaaggtgaatggagagcccacctgggccctgctgctgacagccctgattgctgagctgggcatcctgattgccagcctggacatggtggcccccatcctgtccatgttcttcctgatgtgctacctgtttgtgaacctggcctgtgctgtgcagaccctgctgcggacccccaactggaggccccgcttcaagtactaccactgggccctgtccttcctgggcatgagcctgtgcctggccctgatgtttgtgtcctcctggtactatgccctggtggccatgctgattgctggcatgatctacaagtacatcgagtaccagggcgctgagaaggagtggggagatggcatccggggcctgagcctgtctgctgcccgctatgccctgctgcggctggaggagggccccccccacaccaagaactggaggccccagctgctggtgctgctgaagctggatgaggacctgcacgtgaagtacccccggctgctgacctttgccagccagctgaaggccggcaagggcctgaccatcgtgggcagcgtcatccagggcagcttcctggagagctatggagaggcccaggccgctgagcagaccatcaagaacatgatggagattgagaaggtgaagggcttctgccaggtggtggtggccagcaaggtgcgggagggcctggcccacctgatccagagctgtggcctgggcggcatgaggcacaacagcgtggtgctgggctggccctacggctggaggcagagcgaggacccccgggcctggaagaccttcatcgacacagtgcgctgcaccacagctgcccacctggccctgctggtgcccaagaacatcgccttctaccccagcaaccacgagcgctacctggagggccacattgatgtgtggtggatcgtgcatgatggcggcatgctgatgctgctgcccttcctgctgcggcagcacaaggtgtggaggaagtgcaggatgaggatcttcaccgtggcccagatggatgacaacagcatccagatgaagaaggacctggccgtgttcctgtaccacctgcggctggaggccgaggtggaggtggtggagatgcacaacagcgacatcagcgcctacacctatgaaagaaccctgatgatggagcagaggagccagatgctgcggcagatgaggctgaccaagacagagcgggagcgggaggcccagctggtgaaggacagacattctgccctgcggctggagagcctgtacagtgatgaagaagatgagagcgctgtgggcgctgacaagatccagatgacctggacccgggacaagtacatgacagagacctgggaccccagccacgccccagacaacttccgggagctggtgcacatcaagccagaccagagcaatgtgcggaggatgcacacagctgtgaagctgaatgaagtcatcgtgaccaggagccatgatgcccggctggtgctgctgaacatgcctggccccccaagaaattctgaaggagatgagaactacatggagttcctggaggtgctgacagagggcctggagcgggtgctgctggtgcggggcggcggccgggaggtgatcaccatctacagctag

SEQ ID NO: 170171 - DNA, 3300 bp, Artificial Sequence
  Description of Artificial Sequence: Synthetic coding sequence
atgccccacttcaccgtgaccaaggtggaggaccctgaggagggcgctgctgccagcatcagccaggagcccagcctggccgacatcaaggcccgcatccaggacagtgatgagccagacctgagccagaacagcatcactggagagcacagccagctgctggatgatggccacaagaaggccagaaatgcctacctgaacaacagcaactatgaggagggagatgagtactttgacaagaacctggccctgtttgaggaggagatggacacccggcccaaggtgagcagcctgctgaacaggatggccaactacaccaacctgacccagggcgccaaggagcacgaggaggccgagaacatcacagagggcaagaagaagcccaccaagaccccccagatgggcaccttcatgggcgtgtacctgccctgcctgcagaacatctttggagtcatcctcttcctgcggctgacctgggtggtgggcacagctggggtgctgcaggcctttgccatcgtgctgatctgctgctgctgcaccatgctgacagccatctccatgtctgccatcgccaccaatggagtggtgcctgctgggggcagctacttcatgatcagccgggccctgggccctgagtttggaggagctgtgggcctgtgcttctacctgggcaccacctttgctgctgccatgtacatcctgggcgccatcgagatcttcctggtgtacatcgtgccccgggccgccatcttccacagtgatgatgccctgaaggagagcgctgccatgctgaacaacatgagggtgtatggaacagccttcctggtgctgatggtgctggtggtgttcatcggcgtgcgctacgtgaacaagtttgccagcctcttcctggcctgtgtgattgtgtccatcctggccatctatgctggggccatcaagagcagctttgccccaccccacttccctgtgtgcatgctgggcaacagaaccctgagcagccgccacattgatgtgtgcagcaagaccaaggagatcaacaacatgacagtgcccagcaagctgtggggcttcttctgcaacagcagccagttcttcaatgccacctgtgatgagtactttgtgcacaacaacgtgaccagcatccagggcatccctggcctggccagcggcatcatcacagagaacctgtggagcaactacctgcccaagggggagatcatcgagaagcccagcgccaagagcagtgatgtgctgggcagcctgaaccatgaatatgtgctggtggacatcaccaccagcttcaccctgctggtgggcatcttcttccccagcgtgacaggcatcatggccggcagcaacagaagtggggacctgaaggatgcccagaagagcatccccatcggcaccatcctggccatcctgaccaccagctttgtgtacctgagcaatgtggtgctgtttggagcctgcattgaaggagtggtgctgcgggacaagtttggagatgctgtgaagggcaacctggtggtgggcaccctgtcctggcccagcccctgggtgattgtgattggcagcttcttcagcacctgtggggccggcctgcagagcctgaccggggccccccggctgctgcaggccatcgccaaggacaacatcatccccttcctgcgggtgtttggccacagcaaggccaatggagagcccacctgggccctgctgctgacagctgccatcgccgagctgggcatcctgattgccagcctggacctggtggcccccatcctgtccatgttcttcctgatgtgctacctgtttgtgaacctggcctgtgccctgcagaccctgctgcggacccccaactggaggccccgcttccgctactaccactgggccctgtccttcatgggcatgagcatctgcctggccctgatgttcatcagctcctggtactatgccatcgtggccatggtgattgctggcatgatctacaagtacatcgagtaccagggcgctgagaaggagtggggagatggcatccggggcctgagcctgtctgctgccaggtttgccctgctgcggctggaggagggccccccccacaccaagaactggaggccccagctgctggtgctgctgaagctggatgaggacctgcacgtgaagcacccccggctgctgacctttgccagccagctgaaggccggcaagggcctgaccatcgtgggctctgtgattgtgggcaacttcctggagaactatggagaggccctggccgctgagcagaccatcaagcacctgatggaggccgagaaggtgaagggcttctgccagctggtggtggccgccaagctgcgggagggcatcagccacctgatccagagctgtggcctgggcggcatgaagcacaacacagtggtgatgggctggcccaacggctggaggcagagtgaagatgcccgggcctggaagaccttcatcggcaccgtgcgggtgaccacagctgcccacctggccctgctggtggccaagaacatctccttcttccccagcaatgtggagcagttcagcgagggcaacattgatgtgtggtggatcgtgcatgatggcggcatgctgatgctgctgcccttcctgctgaagcagcacaaggtgtggaggaaatgttccatccgcatcttcaccgtggcccagctggaggacaacagcatccagatgaagaaggacctggccaccttcctgtaccacctgcgcatcgaggccgaggtggaggtggtggagatgcatgacagcgacatcagcgcctacacctatgaaagaaccctgatgatggagcagaggagccagatgctgcggcacatgaggctgagcaagacagagcgggaccgggaggcccagctggtgaaggacaggaacagcatgctgcggctgaccagcattggaagtgatgaagatgaggagacagagacctaccaggagaaggtgcacatgacctggaccaaggacaagtacatggccagccggggccagaaggccaagtccatggagggcttccaggacctgctgaacatgaggccagaccagagcaatgtgcggaggatgcacacagctgtgaagctgaatgaggtgattgtgaacaagagccatgaggccaagctggtgctgctgaacatgcctggcccccccaggaacccagaaggagatgagaactacatggagttcctggaggtgctgacagagggcctggagcgggtgctgctggtgcggggcggcggcagcgaggtgatcaccatctacagctag

SEQ ID NO: 170172 - DNA, 3453 bp, Artificial Sequence
  Description of Artificial Sequence: Synthetic coding sequence
atgcaccccccagagaccaccaccaagatggcctctgtgcgcttcatggtgacccccaccaagattgatgacatccctggcctgagtgacaccagcccagacctgagcagccgcagcagcagccgggtgcgcttcagcagccgggagagcgtgcctgagaccagccgctctgagcccatgtctgagatgtctggggccaccaccagcctggccaccgtggccctggaccccccaagtgacaggaccagccacccccaggatgtgattgaggacctgagccagaacagcatcaccggggagcacagccagctgctggatgatggccacaagaaggccagaaatgcctacctgaacaacagcaactatgaggagggagatgagtactttgacaagaacctggccctgtttgaggaggagatggacacccggcccaaggtgagcagcctgctgaacaggatggccaactacaccaacctgacccagggcgccaaggagcacgaggaggccgagaacatcacagagggcaagaagaagcccaccaagaccccccagatgggcaccttcatgggcgtgtacctgccctgcctgcagaacatctttggagtcatcctcttcctgcggctgacctgggtggtgggcacagctggggtgctgcaggcctttgccatcgtgctgatctgctgctgctgcaccatgctgacagccatctccatgtctgccatcgccaccaacggggtggtgcctgctgggggcagctacttcatgatcagccgggccctgggccctgagtttggaggagctgtgggcctgtgcttctacctgggcaccacctttgctgctgccatgtacatcctgggcgccatcgagatcttcctggtgtacatcgtgcccagggctgccatcttccacagtgatgatgccctgaaggagagcgctgccatgctgaacaacatgagggtgtatggaacagccttcctggtgctgatggtgctggtggtgttcatcggcgtgcgctacgtgaacaagtttgccagcctcttcctggcctgcgtcatcgtgtccatcctggccatctatgctggggccatcaagagcagctttgccccaccccacttccctgtgtgcatgctgggcaacagaaccctgagcagccgccacattgatgtgtgcagcaagaccaaggagatcaacaacatgacagtgcccagcaagctgtggggcttcttctgcaacagcagccagttcttcaatgccacctgtgatgagtactttgtgcacaacaacgtgaccagcatccagggcatccctggcctggccagcggcatcatcacagagaacctgtggagcaactacctgcccaagggggagatcatcgagaagcccagcgccaagagcagtgatgtgctgggcagcctgaaccacgagtatgtgctggtggacatcaccaccagcttcaccctgctggtgggcatcttcttccccagcgtgacaggcatcatggccggcagcaacagaagtggggacctgaaggatgcccagaagagcatccccatcggcaccatcctggccatcctgaccaccagctttgtgtacctgagcaatgtggtgctgtttggagcctgcatcgagggcgtggtgctgcgggacaagtttggagatgctgtgaagggcaacctggtggtgggcaccctgtcctggcccagcccctgggtgattgtcatcggcagcttcttcagcacctgtggggccggcctgcagagcctgactggagccccccggctgctgcaggccatcgccaaggacaacatcatccccttcctgcgggtgtttggccacagcaaggccaacggggagcccacctgggccctgctgctgacagctgccatcgccgagctgggcatcctgattgccagcctggacctggtggcccccatcctgtccatgttcttcctgatgtgctacctgtttgtgaacctggcctgtgccctgcagaccctgctgcggacccccaactggaggccccgcttccgctactaccactgggccctgtccttcatgggcatgagcatctgcctggccctgatgttcatcagctcctggtactatgccatcgtggccatggtgattgctggcatgatctacaagtacatcgagtaccagggcgctgagaaggagtggggagatggcatccggggcctgagcctgtctgctgccaggtttgccctgctgcggctggaggagggccccccccacaccaagaactggaggccccagctgctggtgctgctgaagctggatgaggacctgcacgtgaagcacccccggctgctgacctttgccagccagctgaaggccggcaagggcctgaccatcgtgggcagcgtcatcgtgggcaacttcctggagaactacggggaggccctggccgctgagcagaccatcaagcacctgatggaggccgagaaggtgaagggcttctgccagctggtggtggccgccaagctgcgggagggcatcagccacctgatccagagctgtggcctgggcggcatgaagcacaacacagtggtgatgggctggcccaacggctggaggcagagtgaagatgcccgggcctggaagaccttcatcggcaccgtgcgggtgaccacagctgcccacctggccctgctggtggccaagaacatctccttcttccccagcaatgtggagcagttcagcgagggcaacattgatgtgtggtggatcgtgcatgatggcggcatgctgatgctgctgcccttcctgctgaagcagcacaaggtgtggaggaagtgcagcatccgcatcttcaccgtggcccagctggaggacaacagcatccagatgaagaaggacctggccaccttcctgtaccacctgagaattgaagctgaggtggaggtggtggagatgcatgacagcgacatcagcgcctacacctatgaaagaaccctgatgatggagcagaggagccagatgctgcggcacatgaggctgagcaagacagagcgggaccgggaggcccagctggtgaaggacagaaattccatgctgcggctgaccagcatcggcagtgatgaagatgaggagacagagacctaccaggagaaggtgcacatgacctggaccaaggacaagtacatggccagccggggccagaaggccaagtccatggagggcttccaggacctgctgaacatgaggccagaccagagcaatgtgcggaggatgcacacagctgtgaagctgaatgaagtcatcgtgaacaagagccatgaggccaagctggtgctgctgaacatgcctggccccccaagaaatccagaaggagatgagaactacatggagttcctggaggtgctgacagagggcctggagcgggtgctgctggtgcggggcggcggcagcgaggtgatcaccatctacagctag

SEQ ID NO: 170173 - DNA, 3276 bp, Artificial Sequence
  Description of Artificial Sequence: Synthetic coding sequence
atgtctgagatgtctggggccaccaccagcctggccaccgtggccctggacccccccagcgacaggaccagccacccccaggatgtgattgaggacctgagccagaacagcatcactggagagcacagccagctgctggatgatggccacaagaaggccagaaatgcctacctgaacaacagcaactatgaggagggagatgagtactttgacaagaacctggccctgtttgaggaggagatggacacccggcccaaggtgagcagcctgctgaacaggatggccaactacaccaacctgacccagggcgccaaggagcacgaggaggccgagaacatcacagagggcaagaagaagcccaccaagaccccccagatgggcaccttcatgggcgtgtacctgccctgcctgcagaacatctttggagtcatcctcttcctgcggctgacctgggtggtgggcacagctggggtgctgcaggcctttgccatcgtgctgatctgctgctgctgcaccatgctgacagccatctccatgtctgccatcgccaccaatggagtggtgcctgctgggggcagctacttcatgatcagccgggccctgggccctgagtttggaggagctgtgggcctgtgcttctacctgggcaccacctttgctgctgccatgtacatcctgggcgccatcgagatcttcctggtgtacatcgtgccccgggccgccatcttccacagtgatgatgccctgaaggagagcgctgccatgctgaacaacatgagggtgtatggaacagccttcctggtgctgatggtgctggtggtgttcatcggcgtgcgctacgtgaacaagtttgccagcctcttcctggcctgtgtgattgtgtccatcctggccatctatgctggggccatcaagagcagctttgccccaccccacttccctgtgtgcatgctgggcaacagaaccctgagcagccgccacattgatgtgtgcagcaagaccaaggagatcaacaacatgacagtgcccagcaagctgtggggcttcttctgcaacagcagccagttcttcaatgccacctgtgatgagtactttgtgcacaacaacgtgaccagcatccagggcatccctggcctggccagcggcatcatcacagagaacctgtggagcaactacctgcccaagggggagatcatcgagaagcccagcgccaagagcagtgatgtgctgggcagcctgaaccatgaatatgtgctggtggacatcaccaccagcttcaccctgctggtgggcatcttcttccccagcgtgacaggcatcatggccggcagcaacagaagtggggacctgaaggatgcccagaagagcatccccatcggcaccatcctggccatcctgaccaccagctttgtgtacctgagcaatgtggtgctgtttggagcctgcattgaaggagtggtgctgcgggacaagtttggagatgctgtgaagggcaacctggtggtgggcaccctgtcctggcccagcccctgggtgattgtgattggcagcttcttcagcacctgtggggccggcctgcagagcctgaccggggccccccggctgctgcaggccatcgccaaggacaacatcatccccttcctgcgggtgtttggccacagcaaggccaatggagagcccacctgggccctgctgctgacagctgccatcgccgagctgggcatcctgattgccagcctggacctggtggcccccatcctgtccatgttcttcctgatgtgctacctgtttgtgaacctggcctgtgccctgcagaccctgctgcggacccccaactggaggccccgcttccgctactaccactgggccctgtccttcatgggcatgagcatctgcctggccctgatgttcatcagctcctggtactatgccatcgtggccatggtgattgctggcatgatctacaagtacatcgagtaccagggcgctgagaaggagtggggagatggcatccggggcctgagcctgtctgctgccaggtttgccctgctgcggctggaggagggccccccccacaccaagaactggaggccccagctgctggtgctgctgaagctggatgaggacctgcacgtgaagcacccccggctgctgacctttgccagccagctgaaggccggcaagggcctgaccatcgtgggctctgtgattgtgggcaacttcctggagaactatggagaggccctggccgctgagcagaccatcaagcacctgatggaggccgagaaggtgaagggcttctgccagctggtggtggccgccaagctgcgggagggcatcagccacctgatccagagctgtggcctgggcggcatgaagcacaacacagtggtgatgggctggcccaacggctggaggcagagtgaagatgcccgggcctggaagaccttcatcggcaccgtgcgggtgaccacagctgcccacctggccctgctggtggccaagaacatctccttcttccccagcaatgtggagcagttcagcgagggcaacattgatgtgtggtggatcgtgcatgatggcggcatgctgatgctgctgcccttcctgctgaagcagcacaaggtgtggaggaaatgttccatccgcatcttcaccgtggcccagctggaggacaacagcatccagatgaagaaggacctggccaccttcctgtaccacctgcgcatcgaggccgaggtggaggtggtggagatgcatgacagcgacatcagcgcctacacctatgaaagaaccctgatgatggagcagaggagccagatgctgcggcacatgaggctgagcaagacagagcgggaccgggaggcccagctggtgaaggacaggaacagcatgctgcggctgaccagcattggaagtgatgaagatgaggagacagagacctaccaggagaaggtgcacatgacctggaccaaggacaagtacatggccagccggggccagaaggccaagtccatggagggcttccaggacctgctgaacatgaggccagaccagagcaatgtgcggaggatgcacacagctgtgaagctgaatgaggtgattgtgaacaagagccatgaggccaagctggtgctgctgaacatgcctggcccccccaggaacccagaaggagatgagaactacatggagttcctggaggtgctgacagagggcctggagcgggtgctgctggtgcggggcggcggcagcgaggtgatcaccatctacagctag

SEQ ID NO: 170174 - DNA, 3408 bp, Artificial Sequence
  Description of Artificial Sequence: Synthetic coding sequence
atgcaccccccagagaccaccaccaagatggcctctgtgcgcttcatggtgacccccaccaagattgatgacatccctggcctgagtgacaccagcccagacctgagcagccgcagcagcagccgggtgcgcttcagcagccgggagagcgtgcctgagaccagccgctctgagcccatgtctgagatgtctggggccaccaccagcctggccaccgtggccctggaccccccaagtgacaggaccagccacccccaggatgtgattgaagatgatggccacaagaaggccagaaatgcctacctgaacaacagcaactatgaggagggagatgagtactttgacaagaacctggccctgtttgaggaggagatggacacccggcccaaggtgagcagcctgctgaacaggatggccaactacaccaacctgacccagggcgccaaggagcacgaggaggccgagaacatcacagagggcaagaagaagcccaccaagaccccccagatgggcaccttcatgggcgtgtacctgccctgcctgcagaacatctttggagtcatcctcttcctgcggctgacctgggtggtgggcacagctggggtgctgcaggcctttgccatcgtgctgatctgctgctgctgcaccatgctgacagccatctccatgtctgccatcgccaccaatggagtggtgcctgctgggggcagctacttcatgatcagccgggccctgggccctgagtttggaggagctgtgggcctgtgcttctacctgggcaccacctttgctgctgccatgtacatcctgggcgccatcgagatcttcctggtgtacatcgtgccccgggccgccatcttccacagtgatgatgccctgaaggagagcgctgccatgctgaacaacatgagggtgtatggaacagccttcctggtgctgatggtgctggtggtgttcatcggcgtgcgctacgtgaacaagtttgccagcctcttcctggcctgtgtgattgtgtccatcctggccatctatgctggggccatcaagagcagctttgccccaccccacttccctgtgtgcatgctgggcaacagaaccctgagcagccgccacattgatgtgtgcagcaagaccaaggagatcaacaacatgacagtgcccagcaagctgtggggcttcttctgcaacagcagccagttcttcaatgccacctgtgatgagtactttgtgcacaacaacgtgaccagcatccagggcatccctggcctggccagcggcatcatcacagagaacctgtggagcaactacctgcccaagggggagatcatcgagaagcccagcgccaagagcagtgatgtgctgggcagcctgaaccatgaatatgtgctggtggacatcaccaccagcttcaccctgctggtgggcatcttcttccccagcgtgacaggcatcatggccggcagcaacagaagtggggacctgaaggatgcccagaagagcatccccatcggcaccatcctggccatcctgaccaccagctttgtgtacctgagcaatgtggtgctgtttggagcctgcattgaaggagtggtgctgcgggacaagtttggagatgctgtgaagggcaacctggtggtgggcaccctgtcctggcccagcccctgggtgattgtgattggcagcttcttcagcacctgtggggccggcctgcagagcctgaccggggccccccggctgctgcaggccatcgccaaggacaacatcatccccttcctgcgggtgtttggccacagcaaggccaatggagagcccacctgggccctgctgctgacagctgccatcgccgagctgggcatcctgattgccagcctggacctggtggcccccatcctgtccatgttcttcctgatgtgctacctgtttgtgaacctggcctgtgccctgcagaccctgctgcggacccccaactggaggccccgcttccgctactaccactgggccctgtccttcatgggcatgagcatctgcctggccctgatgttcatcagctcctggtactatgccatcgtggccatggtgattgctggcatgatctacaagtacatcgagtaccagggcgctgagaaggagtggggagatggcatccggggcctgagcctgtctgctgccaggtttgccctgctgcggctggaggagggccccccccacaccaagaactggaggccccagctgctggtgctgctgaagctggatgaggacctgcacgtgaagcacccccggctgctgacctttgccagccagctgaaggccggcaagggcctgaccatcgtgggctctgtgattgtgggcaacttcctggagaactatggagaggccctggccgctgagcagaccatcaagcacctgatggaggccgagaaggtgaagggcttctgccagctggtggtggccgccaagctgcgggagggcatcagccacctgatccagagctgtggcctgggcggcatgaagcacaacacagtggtgatgggctggcccaacggctggaggcagagtgaagatgcccgggcctggaagaccttcatcggcaccgtgcgggtgaccacagctgcccacctggccctgctggtggccaagaacatctccttcttccccagcaatgtggagcagttcagcgagggcaacattgatgtgtggtggatcgtgcatgatggcggcatgctgatgctgctgcccttcctgctgaagcagcacaaggtgtggaggaaatgttccatccgcatcttcaccgtggcccagctggaggacaacagcatccagatgaagaaggacctggccaccttcctgtaccacctgcgcatcgaggccgaggtggaggtggtggagatgcatgacagcgacatcagcgcctacacctatgaaagaaccctgatgatggagcagaggagccagatgctgcggcacatgaggctgagcaagacagagcgggaccgggaggcccagctggtgaaggacaggaacagcatgctgcggctgaccagcattggaagtgatgaagatgaggagacagagacctaccaggagaaggtgcacatgacctggaccaaggacaagtacatggccagccggggccagaaggccaagtccatggagggcttccaggacctgctgaacatgaggccagaccagagcaatgtgcggaggatgcacacagctgtgaagctgaatgaggtgattgtgaacaagagccatgaggccaagctggtgctgctgaacatgcctggcccccccaggaacccagaaggagatgagaactacatggagttcctggaggtgctgacagagggcctggagcgggtgctgctggtgcggggcggcggcagcgaggtgatcaccatctacagctag

SEQ ID NO: 170175 - DNA, 2889 bp, Artificial Sequence
  Description of Artificial Sequence: Synthetic coding sequence
atggacacccggcccaaggtgagcagcctgctgaacaggatggccaactacaccaacctgacccagggcgccaaggagcacgaggaggccgagaacatcacagagggcaagaagaagcccaccaagaccatgctgacagccatctccatgtctgccatcgccaccaacggggtggtgcctgctgggggcagctacttcatgatcagccgggccctgggccctgagtttggaggagctgtgggcctgtgcttctacctgggcaccacctttgctgctgccatgtacatcctgggcgccatcgagatcttcctggtgtacatcgtgcccagggctgccatcttccacagtgatgatgccctgaaggagagcgctgccatgctgaacaacatgagggtgtatggaacagccttcctggtgctgatggtgctggtggtgttcatcggcgtgcgctacgtgaacaagtttgccagcctcttcctggcctgcgtcatcgtgtccatcctggccatctatgctggggccatcaagagcagctttgccccaccccacttccctgtgtgcatgctgggcaacagaaccctgagcagccgccacattgatgtgtgcagcaagaccaaggagatcaacaacatgacagtgcccagcaagctgtggggcttcttctgcaacagcagccagttcttcaatgccacctgtgatgagtactttgtgcacaacaacgtgaccagcatccagggcatccctggcctggccagcggcatcatcacagagaacctgtggagcaactacctgcccaagggggagatcatcgagaagcccagcgccaagagcagtgatgtgctgggcagcctgaaccacgagtatgtgctggtggacatcaccaccagcttcaccctgctggtgggcatcttcttccccagcgtgacaggcatcatggccggcagcaacagaagtggggacctgaaggatgcccagaagagcatccccatcggcaccatcctggccatcctgaccaccagctttgtgtacctgagcaatgtggtgctgtttggagcctgcatcgagggcgtggtgctgcgggacaagtttggagatgctgtgaagggcaacctggtggtgggcaccctgtcctggcccagcccctgggtgattgtcatcggcagcttcttcagcacctgtggggccggcctgcagagcctgactggagccccccggctgctgcaggccatcgccaaggacaacatcatccccttcctgcgggtgtttggccacagcaaggccaacggggagcccacctgggccctgctgctgacagctgccatcgccgagctgggcatcctgattgccagcctggacctggtggcccccatcctgtccatgttcttcctgatgtgctacctgtttgtgaacctggcctgtgccctgcagaccctgctgcggacccccaactggaggccccgcttccgctactaccactgggccctgtccttcatgggcatgagcatctgcctggccctgatgttcatcagctcctggtactatgccatcgtggccatggtgattgctggcatgatctacaagtacatcgagtaccagggcgctgagaaggagtggggagatggcatccggggcctgagcctgtctgctgccaggtttgccctgctgcggctggaggagggccccccccacaccaagaactggaggccccagctgctggtgctgctgaagctggatgaggacctgcacgtgaagcacccccggctgctgacctttgccagccagctgaaggccggcaagggcctgaccatcgtgggcagcgtcatcgtgggcaacttcctggagaactacggggaggccctggccgctgagcagaccatcaagcacctgatggaggccgagaaggtgaagggcttctgccagctggtggtggccgccaagctgcgggagggcatcagccacctgatccagagctgtggcctgggcggcatgaagcacaacacagtggtgatgggctggcccaacggctggaggcagagtgaagatgcccgggcctggaagaccttcatcggcaccgtgcgggtgaccacagctgcccacctggccctgctggtggccaagaacatctccttcttccccagcaatgtggagcagttcagcgagggcaacattgatgtgtggtggatcgtgcatgatggcggcatgctgatgctgctgcccttcctgctgaagcagcacaaggtgtggaggaagtgcagcatccgcatcttcaccgtggcccagctggaggacaacagcatccagatgaagaaggacctggccaccttcctgtaccacctgagaattgaagctgaggtggaggtggtggagatgcatgacagcgacatcagcgcctacacctatgaaagaaccctgatgatggagcagaggagccagatgctgcggcacatgaggctgagcaagacagagcgggaccgggaggcccagctggtgaaggacagaaattccatgctgcggctgaccagcatcggcagtgatgaagatgaggagacagagacctaccaggagaaggtgcacatgacctggaccaaggacaagtacatggccagccggggccagaaggccaagtccatggagggcttccaggacctgctgaacatgaggccagaccagagcaatgtgcggaggatgcacacagctgtgaagctgaatgaagtcatcgtgaacaagagccatgaggccaagctggtgctgctgaacatgcctggccccccaagaaatccagaaggagatgagaactacatggagttcctggaggtgctgacagagggcctggagcgggtgctgctggtgcggggcggcggcagcgaggtgatcaccatctacagctag

SEQ ID NO: 170176 - DNA, 3276 bp, Artificial Sequence; identical to SEQ ID NO: 170173
  Description of Artificial Sequence: Synthetic coding sequence

SEQ ID NO: 170177 - DNA, 3426 bp, Artificial Sequence
  Description of Artificial Sequence: Synthetic coding sequence
atggcctctgtgcgcttcatggtgacccccaccaagattgatgacatccctggcctgagtgacaccagcccagacctgagcagccgcagcagcagccgggtgcgcttcagcagccgggagagcgtgcctgagaccagccgctctgagcccatgtctgagatgtctggggccaccaccagcctggccaccgtggccctggacccccccagcgacaggaccagccacccccaggatgtgattgaggacctgagccagaacagcatcactggagagcacagccagctgctggatgatggccacaagaaggccagaaatgcctacctgaacaacagcaactatgaggagggagatgagtactttgacaagaacctggccctgtttgaggaggagatggacacccggcccaaggtgagcagcctgctgaacaggatggccaactacaccaacctgacccagggcgccaaggagcacgaggaggccgagaacatcacagagggcaagaagaagcccaccaagaccccccagatgggcaccttcatgggcgtgtacctgccctgcctgcagaacatctttggagtcatcctcttcctgcggctgacctgggtggtgggcacagctggggtgctgcaggcctttgccatcgtgctgatctgctgctgctgcaccatgctgacagccatctccatgtctgccatcgccaccaatggagtggtgcctgctgggggcagctacttcatgatcagccgggccctgggccctgagtttggaggagctgtgggcctgtgcttctacctgggcaccacctttgctgctgccatgtacatcctgggcgccatcgagatcttcctggtgtacatcgtgccccgggccgccatcttccacagtgatgatgccctgaaggagagcgctgccatgctgaacaacatgagggtgtatggaacagccttcctggtgctgatggtgctggtggtgttcatcggcgtgcgctacgtgaacaagtttgccagcctcttcctggcctgtgtgattgtgtccatcctggccatctatgctggggccatcaagagcagctttgccccaccccacttccctgtgtgcatgctgggcaacagaaccctgagcagccgccacattgatgtgtgcagcaagaccaaggagatcaacaacatgacagtgcccagcaagctgtggggcttcttctgcaacagcagccagttcttcaatgccacctgtgatgagtactttgtgcacaacaacgtgaccagcatccagggcatccctggcctggccagcggcatcatcacagagaacctgtggagcaactacctgcccaagggggagatcatcgagaagcccagcgccaagagcagtgatgtgctgggcagcctgaaccatgaatatgtgctggtggacatcaccaccagcttcaccctgctggtgggcatcttcttccccagcgtgacaggcatcatggccggcagcaacagaagtggggacctgaaggatgcccagaagagcatccccatcggcaccatcctggccatcctgaccaccagctttgtgtacctgagcaatgtggtgctgtttggagcctgcattgaaggagtggtgctgcgggacaagtttggagatgctgtgaagggcaacctggtggtgggcaccctgtcctggcccagcccctgggtgattgtgattggcagcttcttcagcacctgtggggccggcctgcagagcctgaccggggccccccggctgctgcaggccatcgccaaggacaacatcatccccttcctgcgggtgtttggccacagcaaggccaatggagagcccacctgggccctgctgctgacagctgccatcgccgagctgggcatcctgattgccagcctggacctggtggcccccatcctgtccatgttcttcctgatgtgctacctgtttgtgaacctggcctgtgccctgcagaccctgctgcggacccccaactggaggccccgcttccgctactaccactgggccctgtccttcatgggcatgagcatctgcctggccctgatgttcatcagctcctggtactatgccatcgtggccatggtgattgctggcatgatctacaagtacatcgagtaccagggcgctgagaaggagtggggagatggcatccggggcctgagcctgtctgctgccaggtttgccctgctgcggctggaggagggccccccccacaccaagaactggaggccccagctgctggtgctgctgaagctggatgaggacctgcacgtgaagcacccccggctgctgacctttgccagccagctgaaggccggcaagggcctgaccatcgtgggctctgtgattgtgggcaacttcctggagaactatggagaggccctggccgctgagcagaccatcaagcacctgatggaggccgagaaggtgaagggcttctgccagctggtggtggccgccaagctgcgggagggcatcagccacctgatccagagctgtggcctgggcggcatgaagcacaacacagtggtgatgggctggcccaacggctggaggcagagtgaagatgcccgggcctggaagaccttcatcggcaccgtgcgggtgaccacagctgcccacctggccctgctggtggccaagaacatctccttcttccccagcaatgtggagcagttcagcgagggcaacattgatgtgtggtggatcgtgcatgatggcggcatgctgatgctgctgcccttcctgctgaagcagcacaaggtgtggaggaaatgttccatccgcatcttcaccgtggcccagctggaggacaacagcatccagatgaagaaggacctggccaccttcctgtaccacctgcgcatcgaggccgaggtggaggtggtggagatgcatgacagcgacatcagcgcctacacctatgaaagaaccctgatgatggagcagaggagccagatgctgcggcacatgaggctgagcaagacagagcgggaccgggaggcccagctggtgaaggacaggaacagcatgctgcggctgaccagcattggaagtgatgaagatgaggagacagagacctaccaggagaaggtgcacatgacctggaccaaggacaagtacatggccagccggggccagaaggccaagtccatggagggcttccaggacctgctgaacatgaggccagaccagagcaatgtgcggaggatgcacacagctgtgaagctgaatgaggtgattgtgaacaagagccatgaggccaagctggtgctgctgaacatgcctggcccccccaggaacccagaaggagatgagaactacatggagttcctggaggtgctgacagagggcctggagcgggtgctgctggtgcggggcggcggcagcgaggtgatcaccatctacagctag

SEQ ID NO: 170178 - DNA, 3453 bp, Artificial Sequence; identical to SEQ ID NO: 170172
  Description of Artificial Sequence: Synthetic coding sequence

SEQ ID NO: 170179 - DNA, 186 bp, Artificial Sequence
  Description of Artificial Sequence: Synthetic coding sequence
atgtctgagatgtctggggccaccaccagcctggccaccgtggccctggacccccccagcgacaggaccagccacccccaggatgtgattgaggacctgagccagaacagcatcactggagagcacagccagctgctggatgatggccacaagaaggccagaaatgcctacctgaacaacagctag

SEQ ID NO: 170180 - DNA, 2889 bp, Artificial Sequence; identical to SEQ ID NO: 170175
  Description of Artificial Sequence: Synthetic coding sequence

SEQ ID NO: 170181 - DNA, 3453 bp, Artificial Sequence; identical to SEQ ID NO: 170172
  Description of Artificial Sequence: Synthetic coding sequence

SEQ ID NO: 170182 - DNA, 459 bp, Artificial Sequence
  Description of Artificial Sequence: Synthetic coding sequence
atggcctctgtgcgcttcatggtgacccccaccaagattgatgacatccctggcctgagtgacaccagcccagacctgagcagccgcagcagcagccgggtgcgcttcagcagccgggagagcgtgcctgagaccagccgctctgagcccatgtctgagatgtctggggccaccaccagcctggccaccgtggccctggacccccccagcgacaggaccagccacccccaggatgtgattgaggacctgagccagaacagcatcactggagagcacagccagctgctggatgatggccacaagaaggccagaaatgcctacctgaacaacagcaactatgaggagggagatgagtactttgacaagaacctggccctgtttgaggaggagatggacacccggcccaaggtgagcagcctgctgaacaggatggccaactacaccaacctgacccagtag

SEQ ID NO: 170183 - DNA, 3252 bp, Artificial Sequence
  Description of Artificial Sequence: Synthetic coding sequence
atgcccaccaacttcaccgtggtgcctgtggaggcccacgcagatggcggcggagatgaaacagctgagaggacagaggcccctggcaccccagagggccctgagcctgagcggcccagccctggagatggcaacccccgggagaacagccccttcctgaacaacgtggaggtggagcaggagagcttctttgagggcaagaacatggccctgtttgaggaggagatggacagcaaccccatggtgagcagcctgctgaacaagctggccaactacaccaacctgagccagggcgtggtggagcacgaggaggatgaggagagcagaagaagagaggccaaggcccccaggatgggcaccttcatcggcgtgtacctgccctgcctgcagaacatcctgggcgtcatcctcttcctgcggctgacctggatcgtgggcgtggccggcgtgctggagagcttcctgattgtggccatgtgctgcacctgcaccatgctgacagccatctccatgtctgccatcgccaccaatggagtggtgcctgctgggggcagctactacatgatcagccgcagcctgggccctgagtttggaggagctgtgggcctgtgcttctacctgggcaccacctttgctggggccatgtacatcctgggcaccatcgagatcttcctgacctacatcagccctggggccgccatcttccaggccgaggccgccggcggggaggccgccgccatgctgcacaacatgagggtgtatggcacctgcaccctggtgctgatggccctggtggtgtttgtgggcgtgaagtatgtgaacaagctggccctggtgttcctggcctgtgtggtgctgagcatcctggccatctatgctggggtcatcaagagcgcctttgaccccccagacatccctgtgtgcctgctgggcaacagaaccctgagcagaagaagctttgatgcctgtgtgaaggcctacggcatccacaacaacagcgccaccagcgccctgtggggcctcttctgcaatggcagccagcccagcgctgcctgtgatgagtacttcatccagaacaacgtgacagagatccagggcatccctggggccgccagcggggtcttcctggagaacctgtggagcacctacgcccacgccggggcctttgtggagaagaagggcgtgcccagcgtgcctgtggccgaggagagccgggccagcgccctgccctacgtgctgacagacattgctgccagcttcaccctgctggtgggcatctacttccccagcgtgacaggcatcatggccggcagcaacagaagtggggacctgaaggatgcccagaagagcatccccaccggcaccatcctggccatcgtgaccaccagcttcatctacctgagctgcatcgtgctgtttggagcctgcattgaaggagtggtgctgcgggacaagtttggagaggccctgcagggcaacctggtgattggcatgctggcctggcccagcccctgggtgattgtgattggcagcttcttcagcacctgtggggccggcctgcagagcctgaccggggccccccggctgctgcaggccatcgccagagatggcatcgtgcccttcctgcaggtgtttggacatggcaaggccaatggagagcccacctgggccctgctgctgactgtgctgatctgtgaaacaggcatcctgattgccagcctggacagcgtggcccccatcctgtccatgttcttcctgatgtgctacctgtttgtgaacctggcctgtgctgtgcagaccctgctgcggacccccaactggaggccccgcttcaagttctaccactggaccctgtccttcctgggcatgagcctgtgcctggccctgatgttcatctgctcctggtactatgccctgagcgccatgctgattgctggctgcatctacaagtacatcgagtacagaggagctgagaaggagtggggagatggcatccggggcctgagcctgaatgctgcccgctatgccctgctgcgggtggagcacggccccccccacaccaagaactggaggccccaggtgctggtgatgctgaacctggatgctgagcaggccgtgaagcacccccggctgctgtccttcaccagccagctgaaggccggcaagggcctgaccatcgtgggctctgtgctggagggcacctacctggacaagcacatggaggcccagagagctgaggagaacatccgcagcctgatgagcacagagaagaccaagggcttctgccagctggtggtgagcagcagcctgagagatggcatgagccacctgatccagagcgctggcctgggcggcctgaagcacaacacagtgctgatggcctggccagcctcctggaagcaggaggacaaccccttctcctggaagaactttgtggacacagtgcgggacaccacagctgcccaccaggccctgctggtggccaagaatgtggacagcttcccccagaaccaggagagatttggaggcggccacattgatgtgtggtggatcgtgcatgatggcggcatgctgatgctgctgcccttcctgctgcggcagcacaaggtgtggaggaaatgtaggatgaggatcttcaccgtggcccaggtggatgacaacagcatccagatgaagaaggacctgcagatgttcctgtaccacctgcgcatctctgctgaggtggaggtggtggagatggtggagaatgacatcagcgccttcacctatgaaagaaccctgatgatggagcagaggagccagatgctgaagcagatgcagctgagcaagaatgagcaggagcgggaggcccagctgattcatgacaggaacacagccagccacacagctgctgctgcccggacccaggccccacccaccccagacaaggtgcagatgacctggacccgggagaagctgattgctgagaagtaccgcagccgggacaccagcctgagcggcttcaaggacctcttctccatgaagccagaccagagcaatgtgcggaggatgcacacagctgtgaagctgaatggagtggtgctgaacaagagccaggatgcccagctggtgctgctgaacatgcctggcccccccaagaaccggcagggagatgagaactacatggagttcctggaggtgctgacagagggcctgaacagagtgctgctggtgcggggcggcggccgggaggtgatcaccatctacagctag

SEQ ID NO: 170184 - DNA, 801 bp, Artificial Sequence
  Description of Artificial Sequence: Synthetic coding sequence
atgcccaccaacttcaccgtggtgcctgtggaggcccacgcagatggcggcggagatgaaacagctgagaggacagaggcccctggcaccccagagggccctgagcctgagcggcccagccctggagatggcaacccccgggagaacagccccttcctgaacaacgtggaggtggagcaggagagcttctttgagggcaagaacatggccctgtttgaggaggagatggacagcaaccccatggtgagcagcctgctgaacaagctggccaactacaccaacctgagccagggcgtggtggagcacgaggaggatgaggagagcagaagaagagaggccaaggcccccaggatgggcaccttcatcggcgtgtacctgccctgcctgcagaacatcctgggcgtcatcctcttcctgcggctgacctggatcgtgggcgtggccggcgtgctggagagcttcctgattgtggccatgtgctgcacctgcaccatgctgacagccatctccatgtctgccatcgccaccaatggagtggtgcctgctgggggcagctactacatgatcagccgcagcctgggccctgagtttggaggagctgtgggcctgtgcttctacctgggcaccacctttgctggggccatgtacatcctgggcaccatcgagatcttcctgaccggcacagaagatggagtgggcagcctgggcctgggcctggcccagggcaacagacggcagacccacctgagccccagtgatgctgcccaggccgcccatggagccagctatggcagcttctag

SEQ ID NO: 170185 - DNA, 3066 bp, Artificial Sequence
  Description of Artificial Sequence: Synthetic coding sequence
atggccgagctgcccaccacagagaccccaggagatgccaccctgtgcagcggccgcttcaccatcagcaccctgctgagcagtgatgagcccagccccccagctgcctatgacagcagccaccccagccacctgacccacagcagcaccttctgcatgaggaccttcggctacaacaccattgatgtggtgcccacctatgagcactacgccaacagcacccagcccggggagcccaggaaggtgcggcccaccctggccgacctgcacagcttcctgaagcaggagggccgccacctgcacgccctggcctttgacagccggcccagccatgagatgacagatggcctggtggagggggaggccggcaccagcagcgagaagaaccctgaggagcctgtgcgcttcggctgggtgaagggcgtgatgatccgctgcatgctgaacatctggggcgtcatcctgtacctgcggctgccctggatcacagcccaggccggcatcgtgctgacctggatcatcatcctgctgtctgtgacagtgaccagcatcaccggcctgagcatcagcgccatcagcaccaacgggaaggtgaagagcggcggcacctacttcctgatcagccgcagcctgggccctgagctgggcggcagcatcggcctcatctttgcctttgccaatgctgtgggcgtggccatgcacacagtgggctttgctgagaccgtgcgggacctgctgcaggagtatggagcccccatcgtggaccccatcaatgacatccgcatcatcgctgtggtgtctgtgacagtgctgctggccatcagcctggccggcatggagtgggagagcaaggcccaggtgctcttcttcctggtgatcatggtgtcctttgccaactacctggtgggcaccctcatccccccatctgaggacaaggccagcaagggcttcttctcctacagagctgacatctttgtgcagaacctggtgcctgactggaggggcccagatggcaccttcttcggcatgttcagcatcttcttccccagcgccaccggcatcctggccggggccaacatcagcggggacctgaaggaccctgccatcgccatccccaagggcaccctgatggccatcttctggaccaccatctcctacctggccatcagcgccaccatcggcagctgtgtggtgagagatgccagcggcgtgctgaatgacacagtgaccccaggctggggcgcctgtgagggcctggcctgcagctatggctggaacttcacagaatgtacccagcagcacagctgccactacggcctcatcaactactaccagaccatgtccatggtgtctggctttgcccccctcatcacagctggcatctttggagccaccctgagcagcgccctggcctgcctggtgtctgctgccaaggtgttccagtgcctgtgtgaggaccagctgtaccccctcatcggcttcttcggcaagggctacggcaagaacaaggagcctgtgcggggctacctgctggcctatgccatcgctgtggccttcatcatcatcgccgagctgaacaccatcgcccccatcatcagcaacttcttcctgtgcagctatgccctgatcaacttcagctgcttccacgccagcatcaccaacagccctggctggaggcccagcttccagtactacaacaagtgggccgccctgtttggagccatcatctctgtggtgatcatgttcctgctgacctggtgggccgccctgattgccatcggcgtggtgctcttcctgctgctgtatgtgatctacaagaagccagaggtgaactggggcagctctgtgcaggccggcagctacaacctggccctgagctacagcgtgggcctgaatgaggtggaggaccacatcaagaactaccggccccagtgcctggtgctgactggaccacccaacttccggcctgccctggtggactttgtgggcaccttcaccaggaacctgagcctgatgatctgtggccacgtgctgattggcccccacaagcagaggatgcctgagctgcagctgattgccaacggccacaccaagtggctgaacaagaggaagatcaaggccttctacagtgatgtgattgctgaggacctgcggcggggcgtgcagatcctgatgcaggccgccggcctgggccgcatgaagcccaacatcctggtggtgggcttcaagaagaactggcagagcgcccacccagccaccgtggaggactacatcggcatcctgcatgatgcctttgacttcaactatggagtgtgtgtgatgaggatgagggagggcctgaatgtgtccaagatgatgcaggcccacatcaaccctgtgtttgatcctgcagaagatggcaaggaggccagcgcccgggtggaccccaaggccctggtgaaggaggagcaggccaccaccatcttccagagcgagcagggcaagaagaccatcgacatctactggctgtttgatgatggcggcctgaccctgctgatcccctacctgctgggcaggaagaggcgctggagcaagtgcaagatccgggtgtttgtgggcggccagatcaacaggatggaccaggagaggaaggccatcatcagcctgctgagcaagttccggctgggcttccacgaggtgcacatcctgcctgacatcaaccagaaccccagggctgagcacaccaagagatttgaggacatgattgcccccttccggctgaatgatggcttcaaggatgaggccaccgtgaatgagatgaggcgggactgcccctggaagatcagtgatgaggagatcaccaagaacagagtgaagagcctgcggcaggtgcggctgaatgagatcgtgctggactacagcagagatgctgccctgattgtcatcaccctgcccatcggcaggaagggcaagtgccccagcagcctgtacatggcctggctggagaccctgagccaggacctgcggccccctgtgatcctgatccggggcaaccaggagaatgtgctgaccttctactgccagtag

SEQ ID NO: 170186 - DNA, 3090 bp, Artificial Sequence
  Description of Artificial Sequence: Synthetic coding sequence
atggccgagctgcccaccacagagaccccaggagatgccaccctgtgcagcggccgcttcaccatcagcaccctgctgagcagtgatgagcccagccccccagctgcctatgacagcagccaccccagccacctgacccacagcagcaccttctgcatgaggaccttcggctacaacaccattgatgtggtgcccacctatgagcactacgccaacagcacccagcccggggagcccaggaaggtgcggcccaccctggccgacctgcacagcttcctgaaggagggccgccacctgcacgccctggcctttgacagccggcccagccatgagatgacagatggcctggtggagggggaggccggcaccagcagcgagaagaaccctgaggagcctgtgcgcttcggctgggtgaagggcgtgatgatccgctgcatgctgaacatctggggcgtcatcctgtacctgcggctgccctggatcacagcccaggccggcatcgtgctgacctggatcatcatcctgctgtctgtgacagtgaccagcatcaccggcctgagcatcagcgccatcagcaccaacgggaaggtgaagagcggcggcacctacttcctgatcagccgcagcctgggccctgagctgggcggcagcatcggcctcatctttgcctttgccaatgctgtgggcgtggccatgcacacagtgggctttgctgagaccgtgcgggacctgctgcaggagtatggagcccccatcgtggaccccatcaatgacatccgcatcatcgctgtggtgtctgtgacagtgctgctggccatcagcctggccggcatggagtgggagagcaaggcccaggtgctcttcttcctggtgatcatggtgtcctttgccaactacctggtgggcaccctcatccccccatctgaggacaaggccagcaagggcttcttctcctacagagctgacatctttgtgcagaacctggtgcctgactggaggggcccagatggcaccttcttcggcatgttcagcatcttcttccccagcgccaccggcatcctggccggggccaacatcagcggggacctgaaggaccctgccatcgccatccccaagggcaccctgatggccatcttctggaccaccatctcctacctggccatcagcgccaccatcggcagctgtgtggtgagagatgccagcggcgtgctgaatgacacagtgaccccaggctggggcgcctgtgagggcctggcctgcagctatggctggaacttcacagagtgcacccagcagcacagctgccactacggcctcatcaactactaccagaccatgtccatggtgtctggctttgcccccctcatcacagctggcatctttggagccaccctgagcagcgccctggcctgcctggtgtctgctgccaaggtgttccagtgcctgtgtgaggaccagctgtaccccctgattggcttcttcggcaagggctacggcaagaacaaggagcctgtgcggggctacctgctggcctatgccatcgctgtggccttcatcatcatcgccgagctgaacaccatcgcccccatcatcagcaacttcttcctgtgcagctatgccctgatcaacttcagctgcttccacgccagcatcaccaacagccctggctggaggcccagcttccagtactacaacaagtgggccgccctgtttggagccatcatctctgtggtgatcatgttcctgctgacctggtgggccgccctgattgccatcggcgtggtgctcttcctgctgctgtatgtgatctacaagaagccagaggtgaactggggcagctctgtgcaggccggcagctacaacctggccctgagctacagcgtgggcctgaatgaggtggaggaccacatcaagaactaccggccccagtgcctggtgctgaccggcccccccaacttccggcctgccctggtggactttgtgggcaccttcaccaggaacctgagcctgatgatctgtggccacgtgctgattggcccccacaagcagaggatgcctgagctgcagctgattgccaacggccacaccaagtggctgaacaagaggaagatcaaggccttctacagtgatgtgattgctgaggacctgcggcggggcgtgcagatcctgatgcaggccgccggcctgggccgcatgaagcccaacatcctggtggtgggcttcaagaagaactggcagagcgcccacccagccaccgtggaggactacatcggcatcctgcatgatgcctttgacttcaactacggcgtgtgtgtgatgaggatgagggagggcctgaatgtgtccaagatgatgcaggcccacatcaaccctgtgtttgatcctgcagaagatggcaaggaggccagcgcccggggggcccggcccagcgtgtctggggccctggaccccaaggccctggtgaaggaggagcaggccaccaccatcttccagagcgagcagggcaagaagaccatcgacatctactggctgtttgatgatggcggcctgaccctgctgatcccctacctgctgggcaggaagaggcgctggagcaagtgcaagatccgggtgtttgtgggcggccagatcaacaggatggaccaggagaggaaggccatcatcagcctgctgagcaagttccggctgggcttccacgaggtgcacatcctgcctgacatcaaccagaaccccagggctgagcacaccaagagatttgaggacatgattgcccccttccggctgaatgatggcttcaaggatgaggccaccgtgaatgagatgaggcgggactgcccctggaagatcagtgatgaggagatcaccaagaacagagtgaagagcctgcggcaggtgcggctgaatgagatcgtgctggactacagcagagatgctgccctgattgtcatcaccctgcccatcggcaggaagggcaagtgccccagcagcctgtacatggcctggctggagaccctgagccaggacctgcggccccctgtgatcctgatccggggcaaccaggagaatgtgctgaccttctactgccagtag

SEQ ID NO: 170187 - DNA, 3093 bp, Artificial Sequence
  Description of Artificial Sequence: Synthetic coding sequence
atggccgagctgcccaccacagagaccccaggagatgccaccctgtgcagcggccgcttcaccatcagcaccctgctgagcagtgatgagcccagccccccagctgcctatgacagcagccaccccagccacctgacccacagcagcaccttctgcatgaggaccttcggctacaacaccattgatgtggtgcccacctatgagcactacgccaacagcacccagcccggggagcccaggaaggtgcggcccaccctggccgacctgcacagcttcctgaagcaggagggccgccacctgcacgccctggcctttgacagccggcccagccatgagatgacagatggcctggtggagggggaggccggcaccagcagcgagaagaaccctgaggagcctgtgcgcttcggctgggtgaagggcgtgatgatccgctgcatgctgaacatctggggcgtcatcctgtacctgcggctgccctggatcacagcccaggccggcatcgtgctgacctggatcatcatcctgctgtctgtgacagtgaccagcatcaccggcctgagcatcagcgccatcagcaccaacgggaaggtgaagagcggcggcacctacttcctgatcagccgcagcctgggccctgagctgggcggcagcatcggcctcatctttgcctttgccaatgctgtgggcgtggccatgcacacagtgggctttgctgagaccgtgcgggacctgctgcaggagtatggagcccccatcgtggaccccatcaatgacatccgcatcatcgctgtggtgtctgtgacagtgctgctggccatcagcctggccggcatggagtgggagagcaaggcccaggtgctcttcttcctggtgatcatggtgtcctttgccaactacctggtgggcaccctcatccccccatctgaggacaaggccagcaagggcttcttctcctacagagctgacatctttgtgcagaacctggtgcctgactggaggggcccagatggcaccttcttcggcatgttcagcatcttcttccccagcgccaccggcatcctggccggggccaacatcagcggggacctgaaggaccctgccatcgccatccccaagggcaccctgatggccatcttctggaccaccatctcctacctggccatcagcgccaccatcggcagctgtgtggtgagagatgccagcggcgtgctgaatgacacagtgaccccaggctggggcgcctgtgagggcctggcctgcagctatggctggaacttcacagaatgtacccagcagcacagctgccactacggcctcatcaactactaccagaccatgtccatggtgtctggctttgcccccctcatcacagctggcatctttggagccaccctgagcagcgccctggcctgcctggtgtctgctgccaaggtgttccagtgcctgtgtgaggaccagctgtaccccctcatcggcttcttcggcaagggctacggcaagaacaaggagcctgtgcggggctacctgctggcctatgccatcgctgtggccttcatcatcatcgccgagctgaacaccatcgcccccatcatcagcaacttcttcctgtgcagctatgccctgatcaacttcagctgcttccacgccagcatcaccaacagccctggctggaggcccagcttccagtactacaacaagtgggccgccctgtttggagccatcatctctgtggtgatcatgttcctgctgacctggtgggccgccctgattgccatcggcgtggtgctcttcctgctgctgtatgtgatctacaagaagccagaggtgaactggggcagctctgtgcaggccggcagctacaacctggccctgagctacagcgtgggcctgaatgaggtggaggaccacatcaagaactaccggccccagtgcctggtgctgactggaccacccaacttccggcctgccctggtggactttgtgggcaccttcaccaggaacctgagcctgatgatctgtggccacgtgctgattggcccccacaagcagaggatgcctgagctgcagctgattgccaacggccacaccaagtggctgaacaagaggaagatcaaggccttctacagtgatgtgattgctgaggacctgcggcggggcgtgcagatcctgatgcaggccgccggcctgggccgcatgaagcccaacatcctggtggtgggcttcaagaagaactggcagagcgcccacccagccaccgtggaggactacatcggcatcctgcatgatgcctttgacttcaactatggagtgtgtgtgatgaggatgagggagggcctgaatgtgtccaagatgatgcaggcccacatcaaccctgtgtttgatcctgcagaagatggcaaggaggccagcgcccggggggcccggcccagcgtgtctggggccctggaccccaaggccctggtgaaggaggagcaggccaccaccatcttccagagcgagcagggcaagaagaccatcgacatctactggctgtttgatgatggcggcctgaccctgctgatcccctacctgctgggcaggaagaggcgctggagcaagtgcaagatccgggtgtttgtgggcggccagatcaacaggatggaccaggagaggaaggccatcatcagcctgctgagcaagttccggctgggcttccacgaggtgcacatcctgcctgacatcaaccagaaccccagggctgagcacaccaagagatttgaggacatgattgcccccttccggctgaatgatggcttcaaggatgaggccaccgtgaatgagatgagaagagactgcccctggaagatcagtgatgaggagatcaccaagaacagagtgaagagcctgcggcaggtgcggctgaatgaaattgtgctggactacagcagagatgctgccctgattgtcatcaccctgcccatcggcaggaaaggaaaatgtcccagcagcctgtacatggcctggctggagaccctgagccaggacctgcggccccctgtgatcctgatccggggcaaccaggagaatgtgctgaccttctactgccagtag

SEQ ID NO: 170188 - DNA, 3090 bp, Artificial Sequence; identical to SEQ ID NO: 170186
  Description of Artificial Sequence: Synthetic coding sequence

SEQ ID NO: 170189 - DNA, 1293 bp, Artificial Sequence
  Description of Artificial Sequence: Synthetic coding sequence
atgagcctgaacaacagcagcaatgtgttcctggacagcgtgcccagcaacaccaaccgcttccaggtgtctgtcatcaatgaaaaccacgagagcagcgctgctgctgatgacaacacagaccccccccactatgaggagaccagctttggagatgaggcccagaagaggctgcgcatctccttccggcccggcaaccaggagtgctatgacaacttcctgcagagcggggagacagccaagacagatgccagcttccacgcctatgacagccacaccaacacctactacctgcagaccttcggccacaacaccatggatgctgtgcccaagattgagtactacagaaacacaggcagcatcagcggccccaaggtgaaccggcccagcctgctggagatccacgagcagctggccaagaatgtggccgtgacccccagcagcgctgacagagtggccaatggagatggcatccctggagatgagcaggccgagaacaaggaggatgaccaggccggcgtggtgaagtttggctgggtgaagggcgtgctggtgcgctgcatgctgaacatctggggcgtgatgctgttcatccggctgtcctggatcgtgggggaggccggcatcggcctgggcgtgctgatcatcctgctgagcaccatggtgaccagcatcaccggcctgagcaccagcgccatcgccaccaacggctttgtgcggggcggcggggcctactacctgatcagccgcagcctgggccctgagtttggaggcagcatcggcctcatctttgcctttgccaatgctgtggccgtggccatgtatgtggtgggctttgctgagaccgtggtggacctgctgaaggagagtgacagcatgatggtggaccccaccaatgacatccgcatcatcggcagcatcaccgtggtgatcctgctgggcatctctgtggccggcatggagtgggaggccaaggcccaggtgatcctgctggtgatcctgctgattgccatcgccaacttcttcatcggcaccgtcatccccagcaacaatgagaagaagagccggggcttcttcaactaccaggccagcatctttgctgagaactttggcccccgcttcaccaagggggagggcttcttctctgtgtttgccatcttcttccctgctgccaccggcatcctggccggggccaacatcagcggggacctggaggccctgaggaagcagggcgccagccccctgccccagggcgcccagagcagaagaagacggcagaccagcctcatctag

SEQ ID NO: 170190 - DNA, 3300 bp, Artificial Sequence
  Description of Artificial Sequence: Synthetic coding sequence
atgagcctgaacaacagcagcaatgtgttcctggacagcgtgcccagcaacaccaaccgcttccaggtgtctgtcatcaatgaaaaccacgagagcagcgctgctgctgatgacaacacagaccccccccactatgaggagaccagctttggagatgaggcccagaagaggctgcgcatctccttccggcccggcaaccaggagtgctatgacaacttcctgcagagcggggagacagccaagacagatgccagcttccacgcctatgacagccacaccaacacctactacctgcagaccttcggccacaacaccatggatgctgtgcccaagattgagtactacagaaacacaggcagcatcagcggccccaaggtgaaccggcccagcctgctggagatccacgagcagctggccaagaatgtggccgtgacccccagcagcgctgacagagtggccaatggagatggcatccctggagatgagcaggccgagaacaaggaggatgaccaggccggcgtggtgaagtttggctgggtgaagggcgtgctggtgcgctgcatgctgaacatctggggcgtgatgctgttcatccggctgtcctggatcgtgggggaggccggcatcggcctgggcgtgctgatcatcctgctgagcaccatggtgaccagcatcaccggcctgagcaccagcgccatcgccaccaacggctttgtgcggggcggcggggcctactacctgatcagccgcagcctgggccctgagtttggaggcagcatcggcctcatctttgcctttgccaatgctgtggccgtggccatgtatgtggtgggctttgctgagaccgtggtggacctgctgaaggagagtgacagcatgatggtggaccccaccaatgacatccgcatcatcggcagcatcaccgtggtgatcctgctgggcatctctgtggccggcatggagtgggaggccaaggcccaggtgatcctgctggtgatcctgctgattgccatcgccaacttcttcatcggcaccgtcatccccagcaacaatgagaagaagagccggggcttcttcaactaccaggccagcatctttgctgagaactttggcccccgcttcaccaagggggagggcttcttctctgtgtttgccatcttcttccctgctgccaccggcatcctggccggggccaacatcagcggggacctggaggacccccaggatgccatcccccggggcaccatgctggccatcttcatcaccaccgtggcctacctgggcgtggccatctgtgtgggcgcctgtgtggtgagagatgccaccggcaacatgaatgacaccatcatcagcggcatgaactgcaatggcagcgctgcctgtggcctgggctatgacttcagccgctgcagacatgagccctgccagtatggcctgatgaacaacttccaggtgatgtccatggtgtctggcttcggccccctcatcacagctggcatcttcagcgccaccctgagcagcgccctggccagcctggtgtctgcccccaaggtgttccaggccctgtgcaaggacaacatctacaaggccctgcagttctttgccaagggctacggcaagaacaatgagcccctgcggggctacatcctgaccttcctgattgccatggccttcatcctgattgctgagctgaacaccatcgcccccatcatcagcaacttcttcctggccagctatgccctgatcaacttcagctgcttccacgccagctatgccaagagccctggctggaggcctgcctacggcatctacaacatgtgggtgtccctgtttggagctgtgctgtgctgtgctgtgatgtttgtgatcaactggtgggccgccgtcatcacctacgtgattgagttcttcctgtatgtgtatgtgacctgcaagaagccagatgtgaactggggcagcagcacccaggccctgtcctatgtgtctgccctggacaatgccctggagctgaccaccgtggaggaccacgtgaagaacttccggccccagtgcatcgtgctgaccggcggccccatgaccaggcctgccctgctggacatcacccacgccttcaccaagaacagcggcctgtgcatctgctgtgaggtgtttgtgggccccaggaagctgtgtgtgaaggagatgaacagcggcatggccaagaagcaggcctggctgatcaagaacaagatcaaggccttctatgctgctgtggccgctgactgcttcagagatggagtgcgcagcctgctgcaggccagcggcctgggccgcatgaagcccaacaccctggtgattggctacaagaagaactggaggaaggcccccctgacagaaattgagaactacgtgggcatcatccatgatgcctttgattttgaaattggagtggtgattgtgcgcatcagccagggctttgacatcagccaggtgctgcaggtgcaggaggagctggagcggctggagcaggagcggctggccctggaggccaccatcaaggacaatgaatgtgaggaggagagcggcggcatccggggcctcttcaagaaggccggcaagctgaacatcaccaagaccacccccaagaaggatggcagcatcaacaccagccagagcatgcacgtgggggagttcaaccagaagctggtggaggccagcacccagttcaagaagaagcaggagaagggcaccattgatgtgtggtggctgtttgatgatggcggcctgaccctgctgatcccctacatcctgaccctgaggaagaagtggaaggactgcaagctgcgcatctacgtgggcggcaagatcaaccgcatcgaggaggagaagatcgtgatggccagcctgctgagcaagttccgcatcaagtttgctgacatccacatcatcggggacatcaacatccggcccaacaaggagagctggaaggtgtttgaggagatgattgagccctaccgcctgcacgagagctgcaaggacctgaccacagctgagaagctgaagcgggagaccccctggaagatcacagatgctgagctggaggccgtgaaggagaagagctaccggcaggtgcggctgaatgagctgctgcaggagcacagcagagctgccaacctgattgtgctgagcctgcctgtggccaggaagggcagcatcagtgacctgctgtacatggcctggctggagatcctgaccaagaacctgccccctgtgctgctggtgcggggcaaccacaagaatgtgctgaccttctacagctag

SEQ ID NO: 170191 - DNA, 3300 bp, Artificial Sequence
  Description of Artificial Sequence: Synthetic coding sequence
atgagcctgaacaacagcagcaatgtgttcctggacagcgtgcccagcaacaccaaccgcttccaggtgtctgtcatcaatgaaaaccacgagagcagcgctgctgctgatgacaacacagaccccccccactatgaggagaccagctttggagatgaggcccagaagaggctgcgcatctccttccggcccggcaaccaggagtgctatgacaacttcctgcagagcggggagacagccaagacagatgccagcttccacgcctatgacagccacaccaacacctactacctgcagaccttcggccacaacaccatggatgctgtgcccaagattgagtactacagaaacacaggcagcatcagcggccccaaggtgaaccggcccagcctgctggagatccacgagcagctggccaagaatgtggccgtgacccccagcagcgctgacagagtggccaatggagatggcatccctggagatgagcaggccgagaacaaggaggatgaccaggccggcgtggtgaagtttggctgggtgaagggcgtgctggtgcgctgcatgctgaacatctggggcgtgatgctgttcatccggctgtcctggatcgtgggggaggccggcatcggcctgggcgtcatcatcatcggcctgtctgtggtggtgaccaccctgaccggcatctccatgtctgccatctgcaccaacggggtggtgcggggcggcggggcctactacctgatcagccgcagcctgggccctgagtttggaggcagcatcggcctcatctttgcctttgccaatgctgtggccgtggccatgtatgtggtgggctttgctgagaccgtggtggacctgctgaaggagagtgacagcatgatggtggaccccaccaatgacatccgcatcatcggcagcatcaccgtggtgatcctgctgggcatctctgtggccggcatggagtgggaggccaaggcccaggtgatcctgctggtgatcctgctgattgccatcgccaacttcttcatcggcaccgtcatccccagcaacaatgagaagaagagccggggcttcttcaactaccaggccagcatctttgctgagaactttggcccccgcttcaccaagggggagggcttcttctctgtgtttgccatcttcttccctgctgccaccggcatcctggccggggccaacatcagcggggacctggaggacccccaggatgccatcccccggggcaccatgctggccatcttcatcaccaccgtggcctacctgggcgtggccatctgtgtgggcgcctgtgtggtgagagatgccaccggcaacatgaatgacaccatcatcagcggcatgaactgcaatggcagcgctgcctgtggcctgggctatgacttcagccgctgcagacatgagccctgccagtatggcctgatgaacaacttccaggtgatgtccatggtgtctggcttcggccccctcatcacagctggcatcttcagcgccaccctgagcagcgccctggccagcctggtgtctgcccccaaggtgttccaggccctgtgcaaggacaacatctacaaggccctgcagttctttgccaagggctacggcaagaacaatgagcccctgcggggctacatcctgaccttcctgattgccatggccttcatcctgattgctgagctgaacaccatcgcccccatcatcagcaacttcttcctggccagctatgccctgatcaacttcagctgcttccacgccagctatgccaagagccctggctggaggcctgcctacggcatctacaacatgtgggtgtccctgtttggagctgtgctgtgctgtgctgtgatgtttgtgatcaactggtgggccgccgtcatcacctacgtgattgagttcttcctgtatgtgtatgtgacctgcaagaagccagatgtgaactggggcagcagcacccaggccctgtcctatgtgtctgccctggacaatgccctggagctgaccaccgtggaggaccacgtgaagaacttccggccccagtgcatcgtgctgaccggcggccccatgaccaggcctgccctgctggacatcacccacgccttcaccaagaacagcggcctgtgcatctgctgtgaggtgtttgtgggccccaggaagctgtgtgtgaaggagatgaacagcggcatggccaagaagcaggcctggctgatcaagaacaagatcaaggccttctatgctgctgtggccgctgactgcttcagagatggagtgcgcagcctgctgcaggccagcggcctgggccgcatgaagcccaacaccctggtgattggctacaagaagaactggaggaaggcccccctgacagaaattgagaactacgtgggcatcatccatgatgcctttgattttgaaattggagtggtgattgtgcgcatcagccagggctttgacatcagccaggtgctgcaggtgcaggaggagctggagcggctggagcaggagcggctggccctggaggccaccatcaaggacaatgaatgtgaggaggagagcggcggcatccggggcctcttcaagaaggccggcaagctgaacatcaccaagaccacccccaagaaggatggcagcatcaacaccagccagagcatgcacgtgggggagttcaaccagaagctggtggaggccagcacccagttcaagaagaagcaggagaagggcaccattgatgtgtggtggctgtttgatgatggcggcctgaccctgctgatcccctacatcctgaccctgaggaagaagtggaaggactgcaagctgcgcatctacgtgggcggcaagatcaaccgcatcgaggaggagaagatcgtgatggccagcctgctgagcaagttccgcatcaagtttgctgacatccacatcatcggggacatcaacatccggcccaacaaggagagctggaaggtgtttgaggagatgattgagccctaccgcctgcacgagagctgcaaggacctgaccacagctgagaagctgaagcgggagaccccctggaagatcacagatgctgagctggaggccgtgaaggagaagagctaccggcaggtgcggctgaatgagctgctgcaggagcacagcagagctgccaacctgattgtgctgagcctgcctgtggccaggaagggcagcatcagtgacctgctgtacatggcctggctggagatcctgaccaagaacctgccccctgtgctgctggtgcggggcaaccacaagaatgtgctgaccttctacagctag

SEQ ID NO: 170192 - DNA, 1782 bp, Artificial Sequence
  Description of Artificial Sequence: Synthetic coding sequence
atgctgaacatctggggcgtgatgctgttcatccggctgtcctggatcgtgggggaggccggcatcggcctgggcgtgctgatcatcctgctgagcaccatggtgaccagcatcaccggcctgagcaccagcgccatcgccaccaatggatttgtgcggggcggcggggcctactacctgatcagccgcagcctgggccctgagtttggaggcagcatcggcctcatctttgcctttgccaatgctgtggccgtggccatgtatgtggtgggctttgctgagaccgtggtggacctgctgaaggagagtgacagcatgatggtggaccccaccaatgacatccgcatcatcggcagcatcaccgtggtgatcctgctgggcatctctgtggccggcatggagtgggaggccaaggcccaggtgatcctgctggtgatcctgctgattgccatcgccaacttcttcatcggcaccgtcatccccagcaacaatgagaagaagagccggggcttcttcaactaccaggccagcatctttgctgaaaattttggcccccgcttcaccaagggggagggcttcttctctgtgtttgccatcttcttccctgctgccaccggcatcctggccggggccaacatcagcggggacctggaggacccccaggatgccatcccccggggcaccatgctggccatcttcatcaccaccgtggcctacctgggcgtggccatctgtgtgggcgcctgtgtggtgagagatgccactggaaacatgaatgacaccatcatcagcggcatgaactgcaatggatctgctgcctgtggcctgggctatgacttcagccgctgcagacatgagccctgccagtatggcctgatgaacaacttccaggtgatgtccatggtgtctggcttcggccccctcatcacagctggcatcttcagcgccaccctgagcagcgccctggccagcctggtgtctgcccccaaggtgttccaggccctgtgcaaggacaacatctacaaggccctgcagttctttgccaagggctacggcaagaacaatgagcccctgcggggctacatcctgaccttcctgattgccatggccttcatcctgattgctgagctgaacaccatcgcccccatcatcagcaacttcttcctggccagctatgccctgatcaacttcagctgcttccacgccagctatgccaagagccctggctggaggcctgcctacggcatctacaacatgtgggtgtccctgtttggagctgtgctgtgctgtgctgtgatgtttgtgatcaactggtgggccgctgtgatcacctacgtgattgagttcttcctgtatgtgtatgtgacctgcaagaagccagatgtgaactggggcagcagcacccaggccctgtcctatgtgtctgccctggacaatgccctggagctgaccaccgtggaggaccacgtgaagaacttccggccccagtgcatcgtgctgactggaggccccatgaccaggcctgccctgctggacatcacccacgccttcaccaagaacagcggcctgtgcatctgctgtgaggtgtttgtgggccccaggaagctgtgtgtgaaggagatgaacagcggcatggccaagacaggcctggcctacaaggagcagaaccagggcttcctgtgctgcagcggcggccgcctcttccagggctggtgccccaagagcagcagcggcctgcggctgaggaagaatgagaccaagcacagcggggactggatctag

SEQ ID NO: 170193 - DNA, 540 bp, Artificial Sequence
  Description of Artificial Sequence: Synthetic coding sequence
atgaggaccatgagagctgtgcagctgcagatgaccatcctgacccaccacatcatgaagaagcccctgctgggcatgaagctgaggaaggacagcgagagcgccctgggcctgggcatccgcagcgccatgaccatcagcagcaagcaggccctgtcctatgtgtctgccctggacaatgccctggagctgaccaccgtggaggaccacgtgaagaacttccggccccagtgcatcgtgctgaccggcggccccatgaccaggcctgccctgctggacatcacccacgccttcaccaagaacagcggcctgtgcatctgctgtgaggtgtttgtgggccccaggaagctgtgtgtgaaggagatgaacagcggcatggccaagaagcaggcctggctgatcaagaacaagatcaaggccttctatgctgctgtggccgctgactgcttcagagatggagtgcgcagcctgctgcaggccagcggcctgggccgcatgaagcccaacaccctggtgattggctacaagaagaactggtag

SEQ ID NO: 170194 - DNA, 3300 bp, Artificial Sequence; identical to SEQ ID NO: 170190
  Description of Artificial Sequence: Synthetic coding sequence

SEQ ID NO: 170195 - DNA, 1947 bp, Artificial Sequence
  Description of Artificial Sequence: Synthetic coding sequence
atgctgaacatctggggcgtgatgctgttcatccggctgtcctggatcgtgggggaggccggcatcggcctgggcgtgctgatcatcctgctgagcaccatggtgaccagcatcaccggcctgagcaccagcgccatcgccaccaatggatttgtgcggggcggcggggcctactacctgatcagccgcagcctgggccctgagtttggaggcagcatcggcctcatctttgcctttgccaatgctgtggccgtggccatgtatgtggtgggctttgctgagaccgtggtggacctgctgaaggagagtgacagcatgatggtggaccccaccaatgacatccgcatcatcggcagcatcaccgtggtgatcctgctgggcatctctgtggccggcatggagtgggaggccaaggcccaggtgatcctgctggtgatcctgctgattgccatcgccaacttcttcatcggcaccgtcatccccagcaacaatgagaagaagagccggggcttcttcaactaccaggccagcatctttgctgaaaattttggcccccgcttcaccaagggggagggcttcttctctgtgtttgccatcttcttccctgctgccaccggcatcctggccggggccaacatcagcggggacctggaggacccccaggatgccatcccccggggcaccatgctggccatcttcatcaccaccgtggcctacctgggcgtggccatctgtgtgggcgcctgtgtggtgagagatgccactggaaacatgaatgacaccatcatcagcggcatgaactgcaatggatctgctgcctgtggcctgggctatgacttcagccgctgcagacatgagccctgccagtatggcctgatgaacaacttccaggtgatgtccatggtgtctggcttcggccccctcatcacagctggcatcttcagcgccaccctgagcagcgccctggccagcctggtgtctgcccccaaggtgttccaggccctgtgcaaggacaacatctacaaggccctgcagttctttgccaagggctacggcaagaacaatgagcccctgcggggctacatcctgaccttcctgattgccatggccttcatcctgattgctgagctgaacaccatcgcccccatcatcagcaacttcttcctggccagctatgccctgatcaacttcagctgcttccacgccagctatgccaagagccctggctggaggcctgcctacggcatctacaacatgtgggtgtccctgtttggagctgtgctgtgctgtgctgtgatgtttgtgatcaactggtgggccgctgtgatcacctacgtgattgagttcttcctgtatgtgtatgtgacctgcaagaagccagatgtgaactggggcagcagcacccaggccctgtcctatgtgtctgccctggacaatgccctggagctgaccaccgtggaggaccacgtgaagaacttccggccccagtgcatcgtgctgactggaggccccatgaccaggcctgccctgctggacatcacccacgccttcaccaagaacagcggcctgtgcatctgctgtgaggtgtttgtgggccccaggaagctgtgtgtgaaggagatgaacagcggcatggccaagaagcaggcctggctgatcaagaacaagatcaaggccttctacgccgctgtggccgctgactgcttcagagatggagtgcgcagcctgctgcaggccagcggcctgggccgcatgaagcccaacaccctggtgattggctacaagaagaactggaggaaggcccccctgacagaaattgaaaattatgtgggcatcatccatgatgcctttgattttgaaattggagtggtgattgtgcgcatcagccagggctttgacatcagccaggtgctgcaggtgcaggaggagctggagcggctggagtag

SEQ ID NO: 170196 - DNA, 3639 bp, Artificial Sequence
  Description of Artificial Sequence: Synthetic coding sequence
atggagccccggcccacagcccccagcagcggggcccctggcctggccggcgtgggggagaccccatctgctgctgccctggccgccgcccgggtggagctgcctggaacagctgtgcccagcgtgcctgaagatgctgccccagccagcagagatggcggcggcgtgagagatgagggccctgctgctgctggagatggcctgggccggcccctgggccccacccccagccagagccgcttccaggtggacctggtgtctgaaaatgccggccgggctgctgctgctgctgctgctgctgctgctgctgctgctgctgctggagctggagctggggccaagcagaccccagcagatggagaggccagcggggagagcgagcccgccaagggcagcgaggaggccaagggccgcttccgggtgaactttgtggaccctgctgccagcagcagcgctgaggacagcctgagtgatgctgctggggtgggcgtggatggccccaacgtgtccttccagaatggaggagacacagtgctgtctgagggcagcagcctgcacagcggcggcggcggcggcagcggccaccaccagcactactactatgacacccacaccaacacctactacctgcggaccttcggccacaacaccatggatgctgtgcccagaattgaccactaccgccacacagctgcccagctgggggagaagctgctgcggcccagcctggccgagctgcatgatgagctggagaaggagccctttgaagatggctttgccaatggagaggagagcacccccaccagagatgctgtggtgacctacacagctgagagcaagggcgtggtgaagtttggctggatcaagggcgtgctggtgcgctgcatgctgaacatctggggcgtgatgctgttcatccggctgtcctggatcgtgggccaggccggcatcggcctgtctgtgctggtgatcatgatggccaccgtggtgaccaccatcaccggcctgagcaccagcgccatcgccaccaacggctttgtgcggggcggcggggcctactacctgatcagccgcagcctgggccctgagtttggaggagccatcggcctcatctttgcctttgccaatgctgtggccgtggccatgtatgtggtgggctttgctgagaccgtggtggagctgctgaaggagcacagcatcctgatgattgatgagatcaatgacatccgcatcatcggggccatcaccgtggtgatcctgctgggcatctctgtggccggcatggagtgggaggccaaggcccagatcgtgctgctggtgatcctgctgctggccatcggggactttgtgattggcaccttcatccccctggagagcaagaagcccaagggcttcttcggctacaagtctgagatcttcaatgaaaattttggaccagacttccgggaggaggagaccttcttctctgtgtttgccatcttcttccctgctgccaccggcatcctggccggggccaacatcagcggggacctggccgacccccagagcgccatccccaagggcaccctgctggccatcctgatcaccaccctggtgtatgtgggcattgctgtgtctgtgggcagctgtgtggtgagagatgccactggaaatgtgaatgacaccatcgtgacagagctgaccaactgcaccagcgctgcctgcaagctgaactttgacttcagcagctgtgagagcagcccctgcagctatggcctgatgaacaacttccaggtgatgtccatggtgtctggcttcacccccctcatctctgctggcatcttcagcgccaccctgagcagcgccctggccagcctggtgtctgcccccaagatcttccaggccctgtgcaaggacaacatctacccagccttccagatgtttgccaagggctacggcaagaacaatgagcccctgcggggctacatcctgaccttcctgattgccctgggcttcatcctgattgctgagctgaatgtcatcgcccccatcatcagcaacttcttcctggccagctatgccctgatcaacttcagcgtcttccacgccagcctggccaagagccctggctggaggcctgccttcaagtactacaacatgtggatcagcctgctgggcgccatcctgtgctgcatcgtgatgtttgtgatcaactggtgggccgccctgctgacctacgtgattgtgctgggcctgtacatctacgtgacctacaagaagccagatgtgaactggggcagcagcacccaggccctgacctacctgaatgccctgcagcacagcatccggctgagcggcgtggaggaccacgtgaagaacttccggccccagtgcctggtgatgactggagcccccaacagcaggcctgccctgctgcacctggtgcatgacttcaccaagaatgtgggcctgatgatctgtggccacgtgcacatgggcccccggcggcaggccatgaaggagatgagcattgaccaggccaagtaccagcgctggctgatcaagaacaagatgaaggccttctacgcccctgtgcatgctgatgacctgcgggagggcgcccagtacctgatgcaggccgccggcctgggccgcatgaagcccaacaccctggtgctgggcttcaagaaggactggctgcaggccgacatgagagatgtggacatgtacatcaacctcttccatgatgcctttgacatccagtatggagtggtggtgatccggctgaaggagggcctggacatcagccacctgcagggccaggaggagctgctgagcagccaggagaagagccctggcaccaaggatgtggtggtgtctgtggagtacagcaagaagagtgacctggacaccagcaagcccctgtctgagaagcccatcacccacaaggtggaggaggaggatggcaagacagccacccagcccctgctgaagaaggagagcaagggccccatcgtgcccctgaatgtggccgaccagaagctgctggaggccagcacccagttccagaagaagcagggcaagaacaccattgatgtgtggtggctgtttgatgatggcggcctgaccctgctgatcccctacctgctgaccaccaagaagaagtggaaggactgcaagatccgggtcttcatcggcggcaagatcaacagaattgaccatgacagaagagccatggccaccctgctgagcaagttcagaattgacttcagtgacatcatggtgctgggggacatcaacaccaagcccaagaaggagaacatcatcgcctttgaggagatcatcgagccctaccgcctgcatgaagatgacaaggagcaggacattgctgacaagatgaaggaggatgagccctggaggatcacagacaatgagctggagctgtacaagaccaagacctaccggcagatccggctgaatgagctgctgaaggagcacagcagcacagccaacatcatcgtgatgagcctgcctgtggccaggaaaggagctgtgagcagcgccctgtacatggcctggctggaggccctgagcaaggacctgccccccatcctgctggtgcggggcaaccaccagagcgtgctgaccttctacagctag

SEQ ID NO: 170197 - DNA, 3591 bp, Artificial Sequence
  Description of Artificial Sequence: Synthetic coding sequence
atggagccccggcccacagcccccagcagcggggcccctggcctggccggcgtgggggagaccccatctgctgctgccctggccgccgcccgggtggagctgcctggaacagctgtgcccagcgtgcctgaagatgctgccccagccagcagagatggcggcggcgtgagagatgagggccctgctgctgctggagatggcctgggccggcccctgggccccacccccagccagagccgcttccaggtggacctggtgtctgaaaatgccggccgggctgctgctgctgctgctgctgctgctgctgctgctgctgctgctggagctggagctggggccaagcagaccccagcagatggagaggccagcggggagagcgagcccgccaagggcagcgaggaggccaagggccgcttccgggtgaactttgtggaccctgctgccagcagcagcgctgaggacagcctgagtgatgctgctggggtgggcgtggatggccccaacgtgtccttccagaatggaggagacacagtgctgtctgagggcagcagcctgcacagcggcggcggcggcggcagcggccaccaccagcactactactatgacacccacaccaacacctactacctgcggaccttcggccacaacaccatggatgctgtgcccagaattgaccactaccgccacacagctgcccagctgggggagaagctgctgcggcccagcctggccgagctgcatgatgagctggagaaggagccctttgaagatggctttgccaatggagaggagagcacccccaccagagatgctgtggtgacctacacagctgagagcaagggcgtggtgaagtttggctggatcaagggcgtgctggtgcgctgcatgctgaacatctggggcgtgatgctgttcatccggctgtcctggatcgtgggccaggccggcatcggcctgtctgtgctggtgatcatgatggccaccgtggtgaccaccatcaccggcctgagcaccagcgccatcgccaccaacggctttgtgcggggcggcggggcctactacctgatcagccgcagcctgggccctgagtttggaggagccatcggcctcatctttgcctttgccaatgctgtggccgtggccatgtatgtggtgggctttgctgagaccgtggtggagctgctgaaggagcacagcatcctgatgattgatgagatcaatgacatccgcatcatcggggccatcaccgtggtgatcctgctgggcatctctgtggccggcatggagtgggaggccaaggcccagatcgtgctgctggtgatcctgctgctggccatcggggactttgtgattggcaccttcatccccctggagagcaagaagcccaagggcttcttcggctacaagtctgagatcttcaatgaaaattttggaccagacttccgggaggaggagaccttcttctctgtgtttgccatcttcttccctgctgccaccggcatcctggccggggccaacatcagcggggacctggccgacccccagagcgccatccccaagggcaccctgctggccatcctgatcaccaccctggtgtatgtgggcattgctgtgtctgtgggcagctgtgtggtgagagatgccactggaaatgtgaatgacaccatcgtgacagagctgaccaactgcaccagcgctgcctgcaagctgaactttgacttcagcagctgtgagagcagcccctgcagctatggcctgatgaacaacttccaggtgatgtccatggtgtctggcttcacccccctcatctctgctggcatcttcagcgccaccctgagcagcgccctggccagcctggtgtctgcccccaagatcttccaggccctgtgcaaggacaacatctacccagccttccagatgtttgccaagggctacggcaagaacaatgagcccctgcggggctacatcctgaccttcctgattgccctgggcttcatcctgattgctgagctgaatgtcatcgcccccatcatcagcaacttcttcctggccagctatgccctgatcaacttcagcgtcttccacgccagcctggccaagagccctggctggaggcctgccttcaagtactacaacatgtggatcagcctgctgggcgccatcctgtgctgcatcgtgatgtttgtgatcaactggtgggccgccctgctgacctacgtgattgtgctgggcctgtacatctacgtgacctacaagaagccagatgtgaactggggcagcagcacccaggccctgacctacctgaatgccctgcagcacagcatccggctgagcggcgtggaggaccacgtgaagaacttccggccccagtgcctggtgatgactggagcccccaacagcaggcctgccctgctgcacctggtgcatgacttcaccaagaatgtgggcctgatgatctgtggccacgtgcacatgggcccccggcggcaggccatgaaggagatgagcattgaccaggccaagtaccagcgctggctgatcaagaacaagatgaaggccttctacgcccctgtgcatgctgatgacctgcgggagggcgcccagtacctgatgcaggccgccggcctgggccgcatgaagcccaacaccctggtgctgggcttcaagaaggactggctgcaggccgacatgagagatgtggacatgtacatcaacctcttccatgatgcctttgacatccagtatggagtggtggtgatccggctgaaggagggcctggacatcagccacctgcagggccaggaggagctgctgagcagccaggagaagagccctggcaccaaggatgtggtggtgtctgtggagtacagcaagaagagtgacctggacaccagcaagcccctgtctgagaagcccatcacccacaaggagagcaagggccccatcgtgcccctgaatgtggccgaccagaagctgctggaggccagcacccagttccagaagaagcagggcaagaacaccattgatgtgtggtggctgtttgatgatggcggcctgaccctgctgatcccctacctgctgaccaccaagaagaagtggaaggactgcaagatccgggtcttcatcggcggcaagatcaacagaattgaccatgacagaagagccatggccaccctgctgagcaagttcagaattgacttcagtgacatcatggtgctgggggacatcaacaccaagcccaagaaggagaacatcatcgcctttgaggagatcatcgagccctaccgcctgcatgaagatgacaaggagcaggacattgctgacaagatgaaggaggatgagccctggaggatcacagacaatgagctggagctgtacaagaccaagacctaccggcagatccggctgaatgagctgctgaaggagcacagcagcacagccaacatcatcgtgatgagcctgcctgtggccaggaaaggagctgtgagcagcgccctgtacatggcctggctggaggccctgagcaaggacctgccccccatcctgctggtgcggggcaaccaccagagcgtgctgaccttctacagctag

SEQ ID NO: 170198 - DNA, 1788 bp, Artificial Sequence
  Description of Artificial Sequence: Synthetic coding sequence
atgaagttcttctcctacatcctggtgtaccgccgcttcctgtttgtggtgttcaccgtgctggtgctgctgcccctgcccatcgtgctgcacaccaaggaggccgagtgtgcctacaccctgtttgtggtggccaccttctggctgacagaggccctgcccctgtctgtgacagccctgctgcccagcctgatgctgcccatgtttggcatcatgcccagcaagaaggtggccagcgcctacttcaaggacttccacctgctgctgattggagtcatctgcctggccaccagcattgagaagtggaacctgcacaagagaattgccctgaagatggtgatgatggtgggcgtgaacccagcctggctgaccctgggcttcatgagcagcacagccttcctgtccatgtggctgagcaacaccagcacagctgccatggtgatgcccatcgccgaggccgtggtgcagcagatcatcaatgctgaggccgaggtggaggccacccagatgacctacttcaacggcagcaccaaccacggcctggagattgatgagagcgtgaatggccacgagatcaatgaaaggaaggagaagaccaagcctgtgcccggctacaacaatgacaccgggaagatcagcagcaaggtggagctggagaagaacagcggcatgaggaccaagtaccgcaccaagaagggccacgtgaccaggaagctgacctgcctgtgcatcgcctacagcagcaccatcggcggcctgaccaccatcaccggcaccagcaccaacctgatctttgctgagtacttcaacacccgctacccagactgccgctgcctgaactttggctcctggttcaccttctccttccctgctgccctgatcatcctgctgctgtcctggatctggctgcagtggctgttcctgggcttcaacttcaaggagatgtttaaatgtgggaagaccaagacagtgcagcagaaggcctgtgccgaggtgatcaagcaggagtaccagaagctgggccccatccgctaccaggagatcgtgaccctggtgctcttcatcatcatggccctgctgtggttcagccgggaccccggctttgtgcccggctggagcgccctcttcagcgagtacccaggctttgccacagacagcacagtggccctgctgattggcctgctcttcttcctgatcccagccaagaccctgaccaagaccacccccaccggggagatcgtggcctttgactacagccccctcatcacctggaaggagttccagagcttcatgccctgggacatcgccatcctggtgggcggcggctttgccctggctgatggctgtgaggagagcggcctgagcaagtggattggcaacaagctgagccccctgggcagcctgcctgcctggctgatcatcctgatcagcagcctgatggtgaccagcctgacagaggtggccagcaacccagccaccatcaccctcttcctgcccatcctgagccccctggccgaggccatccacgtgaaccccctgtacatcctgatccccagcaccctgtgcaccagctttgccttcctgctgcctgtggccaaccccccaaatgccatcgtgttctcctatggccacctgaaggtgattgacatggtgaaggccggcctgggcgtgaacatcgtgggcgtggccgtggtgatgctgggcatctgcacctggatcgtgcccatgtttgacctgtacacctaccccagctgggccccagccatgagcaatgagaccatgccctag

SEQ ID NO: 170199 - DNA, 486 bp, Artificial Sequence
  Description of Artificial Sequence: Synthetic coding sequence
atgctgcccatgtttggcatcatgcccagcaagaaggtggccagcgcctacttcaaggacttccacctgctgctgattggagtcatctgcctggccaccagcattgagaagtggaacctgcacaagagaattgccctgaagatggtgatgatggtgggcgtgaacccagcctggctgaccctgggcttcatgagcagcacagccttcctgtccatgtggctgagcaacaccagcacagctgccatggtgatgcccatcgccgaggccgtggtgcagcagatcatcaatgctgaggccgaggtggaggccacccagatgacctacttcaacggcagcaccaaccacggcctggagattgatgagagcgtgaatggccacgagatcaatgaaaggaaggagaagaccaagcctgtgcccggctacaacaatgacaccgggaagatcagcagcaaggtggagctggagaagtacctgcaggtgaggtag

SEQ ID NO: 170200 - DNA, 1881 bp, Artificial Sequence
  Description of Artificial Sequence: Synthetic coding sequence
atgggcctgctgcagggcctgctgcgggtgaggaagctgctgctggtggtgtgtgtgcccctgctgctgctgcccctgcctgtgctgcaccccagcagcgaggccagctgtgcctacgtgctgattgtgacagctgtgtactgggtgtctgaggccgtgcccctgggcgccgccgccctggtgcctgccttcctgtaccccttctttggagtgctgcggagcaatgaggtggccgctgagtacttcaagaacaccaccctgctgctggtgggcgtcatctgtgtggccgctgctgtggagaagtggaacctgcacaagagaattgccctgaggatggtgctgatggccggggccaagccaggcatgctgctgctgtgcttcatgtgctgcaccaccctgctgtccatgtggctgagcaacaccagcaccacagccatggtgatgcccatcgtggaggccgtgctgcaggagctggtgtctgcagaagatgagcagctggtggccggcaacagcaacacagaggaggccgagcccatcagcctggatgtgaagaacagccagcccagcctggagctgatctttgtgaatgaggagagcaatgctgacctgaccaccctgatgcacaatgaaaacctgaatggagtgcccagcatcaccaaccccatcaagacagccaaccagcaccagggcaagaagcagcaccccagccaggagaagccccaggtgctgacccccagccccaggaagcagaagctgaacaggaagtaccgcagccaccacgaccagatgatctgcaagtgcctgagcctgagcatctcctacagcgccaccatcggcggcctgaccaccatcatcggcaccagcaccagcctcatcttcctggagcacttcaacaaccagtacccagctgctgaggtggtgaactttggcacctggttcctgttctccttccccatcagcctcatcatgctggtggtgtcctggttctggatgcactggctgttcctgggctgcaacttcaaggagacctgcagcctgagcaagaagaagaagaccaagcgggagcagctgtctgagaagaggatccaggaggagtatgagaagctgggggacatctcctacccagagatggtgacaggcttcttcttcatcctgatgacagtgctgtggttcacccgggagcccggctttgtgcccggctgggacagcttctttgagaagaagggctacagaacagatgccaccgtgtctgtgttcctgggcttcctgctcttcctgatcccagccaagaagccctgcttcggcaagaagaatgatggagagaaccaggagcacagcctgggcacagagcccatcatcacctggaaggacttccagaagaccatgccctgggagatcgtcatcctggtgggcggcggctacgccctggccagcggcagcaagagcagcggcctgagcacctggattggcaaccagatgctgagcctgagcagcctgcccccctgggccgtgaccctgctggcctgcatcctggtgtccatcgtgacagaatttgtgagcaacccagccaccatcaccatcttcctgcccatcctgtgcagcctgtctgagaccctgcacatcaaccccctgtacaccctcatccctgtgaccatgtgcatcagctttgctgtgatgctgcctgtgggcaaccccccaaatgccatcgtgttctcctatggccactgccagatcaaggacatggtgaaggccggcctgggcgtgaatgtgattggcctggtgattgtgatggtggccatcaacacctggggcgtgtccctcttccacctggacacctacccagcctgggcccgggtgagcaacatcacagaccaggcctag

SEQ ID NO: 170201 - DNA, 1569 bp, Artificial Sequence
  Description of Artificial Sequence: Synthetic coding sequence
atggccagcgccctgtcctatgtgtccaagttcaagagctttgtgatcctgtttgtgacccccctgctgctgctgcccctggtgatcctgatgcctgccaagtttgtgcgctgtgcctacgtgatcatcctgatggccatctactggtgcacagaggtgatccccctggccgtgaccagcctgatgcctgtgctgctcttccccctcttccagatcctggacagccggcaggtgtgtgtgcagtacatgaaggacaccaacatgctgttcctgggcggcctgattgtggccgtggccgtggagcgctggaacctgcacaagagaattgccctgcggaccctgctgtgggtgggcgccaagccagcccggctgatgctgggcttcatgggcgtgacagccctgctgtccatgtggatcagcaacacagccaccacagccatgatggtgcccatcgtggaggccatcctgcagcagatggaggccaccagcgctgccacagaggccggcctggagctggtggacaagggcaaggccaaggagctgcccggcagccaggtgatctttgagggccccaccctgggccagcaggaggaccaggagaggaagaggctgtgcaaggccatgaccctgtgcatctgctatgctgccagcatcggcggcacagccaccctgactggaacaggccccaacgtggtgctgctgggccagatgaatgagctgttcccagacagcaaggacctggtgaactttgcctcctggtttgcctttgccttccccaacatgctggtgatgctgctgtttgcctggctgtggctgcagtttgtgtacatgaggttcaacttcaagaagtcctggggctgcggcctggagagcaagaagaatgagaaggccgccctgaaggtgctgcaggaggagtacaggaagctgggccccctgagctttgctgagatcaacgtgctgatctgcttcttcctgctggtgatcctgtggttcagccgggaccccggcttcatgcctggctggctgactgtggcctgggtggagggggagaccaagtatgtgtctgatgccaccgtggccatctttgtggccaccctgctcttcatcgtgcccagccagaagcccaagttcaacttccgcagccagacagaggaggagaggaagacccccttctaccccccacccctgctggactggaaggtgacccaggagaaggtgccctggggcatcgtgctgctgctgggcggcggctttgccctggccaagggcagcgaggccagcggcctgtctgtgtggatgggcaagcagatggagcccctgcatgctgtgcccccagctgccatcaccctcatcctgagcctgctggtggccgtgttcacagaatgtaccagcaatgtggccaccaccaccctcttcctgcccatctttgcctccatggtgaagacaggagtcatcatgaacatcattggagtcttctgtgtgttcctggccgtgaacacctggggccgggccatctttgacctggaccacttcccagactgggccaacgtgacccacatcgagacctag

SEQ ID NO: 170202 - DNA, 1707 bp, Artificial Sequence
  Description of Artificial Sequence: Synthetic coding sequence
atggccagcgccctgtcctatgtgtccaagttcaagagctttgtgatcctgtttgtgacccccctgctgctgctgcccctggtgatcctgatgcctgccaagtttgtgcgctgtgcctacgtgatcatcctgatggccatctactggtgcacagaggtgatccccctggccgtgaccagcctgatgcctgtgctgctcttccccctcttccagatcctggacagccggcaggtgtgtgtgcagtacatgaaggacaccaacatgctgttcctgggcggcctgattgtggccgtggccgtggagcgctggaacctgcacaagagaattgccctgcggaccctgctgtgggtgggcgccaagccagcccggctgatgctgggcttcatgggcgtgacagccctgctgtccatgtggatcagcaacacagccaccacagccatgatggtgcccatcgtggaggccatcctgcagcagatggaggccaccagcgctgccacagaggccggcctggagctggtggacaagggcaaggccaaggagctgcccggcagccaggtgatctttgagggccccaccctgggccagcaggaggaccaggagaggaagaggctgtgcaaggccatgaccctgtgcatctgctatgctgccagcatcggcggcacagccaccctgactggaacaggccccaacgtggtgctgctgggccagatgaatgagctgttcccagacagcaaggacctggtgaactttgcctcctggtttgcctttgccttccccaacatgctggtgatgctgctgtttgcctggctgtggctgcagtttgtgtacatgaggttcaacttcaagaagtcctggggctgcggcctggagagcaagaagaatgagaaggccgccctgaaggtgctgcaggaggagtacaggaagctgggccccctgagctttgctgagatcaacgtgctgatctgcttcttcctgctggtgatcctgtggttcagccgggaccccggcttcatgcctggctggctgactgtggcctgggtggagggggagaccaagtatgtgtctgatgccaccgtggccatctttgtggccaccctgctcttcatcgtgcccagccagaagcccaagttcaacttccgcagccagacagaggaggagaggaagacccccttctaccccccacccctgctggactggaaggtgacccaggagaaggtgccctggggcatcgtgctgctgctgggcggcggctttgccctggccaagggcagcgaggccagcggcctgtctgtgtggatgggcaagcagatggagcccctgcatgctgtgcccccagctgccatcaccctcatcctgagcctgctggtggccgtgttcacagaatgtaccagcaatgtggccaccaccaccctcttcctgcccatctttgcctccatgagccgcagcatcggcctgaaccccctgtacatcatgctgccctgcaccctgagcgccagctttgccttcatgctgcctgtggccaccccaccaaatgccatcgtgttcacctacggccacctgaaggtggccgacatggtgaagacaggagtcatcatgaacatcattggagtcttctgtgtgttcctggccgtgaacacctggggccgggccatctttgacctggaccacttcccagactgggccaacgtgacccacatcgagacctag

SEQ ID NO: 170203 - DNA, 1578 bp, Artificial Sequence
  Description of Artificial Sequence: Synthetic coding sequence
atggccagcgccctgtcctatgtgtccaagttcaagagctttgtgatcctgtttgtgacccccctgctgctgctgcccctggtgatcctgatgcctgccaaggtgtgtgtgcagtacatgaaggacaccaacatgctgttcctgggcggcctcatcgtggccgtggccgtggagcgctggaacctgcacaagagaattgccctgcggaccctgctgtgggtgggcgccaagccagcccggctgatgctgggcttcatgggcgtgacagccctgctgtccatgtggatcagcaacacagccaccacagccatgatggtgcccatcgtggaggccatcctgcagcagatggaggccaccagcgctgccacagaagctggcctggagctggtggacaagggcaaggccaaggagctgcccggcagccaggtgatctttgagggccccaccctgggccagcaggaggaccaggagaggaagaggctgtgcaaggccatgaccctgtgcatctgctacgccgccagcattggaggaacagccaccctgaccggcaccggccccaacgtggtgctgctgggccagatgaatgaactcttcccagacagcaaggacctggtgaactttgcctcctggtttgcctttgccttccccaacatgctggtgatgctgctgtttgcctggctgtggctgcagtttgtgtacatgaggttcaacttcaagaagtcctggggctgcggcctggagagcaagaagaatgagaaggccgccctgaaggtgctgcaggaggagtacaggaagctgggccccctgagctttgctgagatcaacgtgctgatctgcttcttcctgctggtgatcctgtggttcagccgggaccccggcttcatgcctggctggctgactgtggcctgggtggagggggagaccaagtatgtgtctgatgccaccgtggccatctttgtggccaccctgctcttcatcgtgcccagccagaagcccaagttcaacttccgcagccagacagaggaggagaggaagacccccttctaccccccacccctgctggactggaaggtgacccaggagaaggtgccctggggcatcgtgctgctgctgggcggcggctttgccctggccaagggcagcgaggccagcggcctgtctgtgtggatgggcaagcagatggagcccctgcatgctgtgcccccagctgccatcaccctcatcctgagcctgctggtggccgtgttcacagagtgcaccagcaatgtggccaccaccaccctcttcctgcccatctttgcctccatgagccgcagcatcggcctgaaccccctgtacatcatgctgccctgcaccctgagcgccagctttgccttcatgctgcctgtggccaccccaccaaatgccatcgtgttcacctacggccacctgaaggtggccgacatggtgaagacaggagtcatcatgaacatcatcggggtcttctgtgtgttcctggccgtgaacacctggggccgggccatctttgacctggaccacttcccagactgggccaacgtgacccacatcgagacctag

SEQ ID NO: 170204 - DNA, 1569 bp, Artificial Sequence; identical to SEQ ID NO: 170201
  Description of Artificial Sequence: Synthetic coding sequence

SEQ ID NO: 170205 - DNA, 1779 bp, Artificial Sequence
  Description of Artificial Sequence: Synthetic coding sequence
atggccacctgctggcaggccctgtgggcctaccgcagctacctgattgtgttctttgtgcccatcctgctgctgcccctgcccatcctggtgcccagcaaggaggcctactgtgcctatgccatcatcctgatggccctcttctggtgcacagaggccctgcccctggccgtgacagccctcttccccctcatcctcttccccatgatgggcatcgtggatgccagcgaggtggccgtggagtacctgaaggacagcaacctgctcttctttggaggcctgctggtggccatcgctgtggagcactggaacctgcacaagagaattgccctgcgggtgctgctgattgtgggcgtgcggcctgcccccctcatcctgggcttcatgctggtgacagccttcctgtccatgtggatcagcaacacagccaccagcgccatgatggtgcccatcgcccatgctgtgctggaccagctgcacagcagccaggccagcagcaatgtggaggagggcagcaacaaccccacctttgagctgcaggagcccagcccccagaaggaggtgaccaagctggacaatggccaggccctgcctgtgaccagcgccagcagcgagggccgggcccacctgagccagaagcacctgcacctgacccagtgcatgagcctgtgtgtgtgctacagcgccagcattggaggcatcgccaccctgaccggcacagcccccaacctggtgctgcagggccagatcaacagcctcttcccccagaatggaaatgtggtgaactttgcctcctggttctcctttgccttccccaccatggtgatcctgctgctgctggcctggctgtggctgcagatcctcttcctgggcttcaacttcaggaagaactttggcatcggggagaagatgcaggagcagcagcaggccgcctactgtgtgatccagacagagcaccggctgctgggccccatgacctttgctgagaaggccatcagcatcctcttcgtcatcctggtgctgctgtggttcacccgggagcccggcttcttcctgggctggggcaacctggccttccccaatgccaagggggagagcatggtgtctgatggcaccgtggccatcttcatcggcatcatcatgttcatcatccccagcaagtttcctggcctgacccaggaccctgagaaccctgggaagctgaaggcccccctgggcctgctggactggaagacagtgaaccagaagatgccctggaacatcgtgctgctgctgggcggcggctacgccctggccaagggcagcgagaggagcggcctgtctgagtggctgggcaacaagctgacccccctgcagagcgtgcctgccccagccatcgccatcatcctgagcctgctggtggccaccttcacagagtgcaccagcaatgtggccaccaccaccatcttcctgcccatcctggcctccatggcccaggccatctgcctgcaccccctgtatgtgatgctgccctgcaccctggccaccagcctggccttcatgctgcctgtggccaccccaccaaatgccatcgtgttctcctttggagacctgaaggtgctggacatggcccgggccggcttcctgctgaacatcatcggcgtgctgatcatcgccctggccatcaacagctggggcatccccctcttcagcctgcacagcttccccagctgggcccagagcaacaccacagcccagtgcctgcccagcctggccaacaccaccacccccagcccctag

SEQ ID NO: 170206 - DNA, 1926 bp, Artificial Sequence
  Description of Artificial Sequence: Synthetic coding sequence
atggccacctgctggcaggccctgtgggcctaccgcagctacctgattgtgttctttgtgcccatcctgctgctgcccctgcccatcctggtgcccagcaaggaggcctactgtgcctatgccatcatcctgatggccctcttctggtgcacagaggccctgcccctggccgtgacagccctcttccccctcatcctcttccccatgatgggcatcgtggatgccagcgagatcatccagaggcccttccccagcagctttgagagccctggagagtgccagagcgtgggcatgtctgtgacagccagccacaacctgggcggcaccgtgggggacagcagggtcttcccccccctgagccacgtgtccacctgccaggtggccgtggagtacctgaaggacagcaacctgctcttcttcggcggcctgctggtggccatcgctgtggagcactggaacctgcacaagagaattgccctgcgggtgctgctgattgtgggcgtgcggcctgcccccctcatcctgggcttcatgctggtgacagccttcctgtccatgtggatcagcaacacagccaccagcgccatgatggtgcccatcgcccatgctgtgctggaccagctgcacagcagccaggccagcagcaatgtggaggagggcagcaacaaccccacctttgagctgcaggagcccagcccccagaaggaggtgaccaagctggacaatggccaggccctgcctgtgaccagcgccagcagcgagggccgggcccacctgagccagaagcacctgcacctgacccagtgcatgagcctgtgtgtgtgctacagcgccagcatcggcggcatcgccaccctgactggaacagcccccaacctggtgctgcagggccagatcaacagcctcttcccccagaatggaaatgtggtgaactttgcctcctggttctcctttgccttccccaccatggtgatcctgctgctgctggcctggctgtggctgcagatcctcttcctgggcttcaacttcaggaagaactttggaattggagagaagatgcaggagcagcagcaggccgcctactgcgtcatccagacagagcaccggctgctgggccccatgacctttgctgagaaggccatcagcatcctgtttgtgatcctggtgctgctgtggttcacccgggagcccggcttcttcctgggctggggcaacctggccttccccaatgccaagggggagagcatggtgtctgatggcaccgtggccatcttcatcggcatcatcatgttcatcatccccagcaagtttcctggcctgacccaggaccctgaaaatcctgggaagctgaaggcccccctgggcctgctggactggaagacagtgaaccagaagatgccctggaacatcgtgctgctgctgggcggcggctacgccctggccaagggcagcgagaggagcggcctgtctgagtggctgggcaacaagctgacccccctgcagagcgtgcctgccccagccatcgccatcatcctgagcctgctggtggccaccttcacagaatgtaccagcaatgtggccaccaccaccatcttcctgcccatcctggcctccatggcccaggccatctgcctgcaccccctgtatgtgatgctgccctgcaccctggccaccagcctggccttcatgctgcctgtggccaccccaccaaatgccatcgtgttctcctttggagacctgaaggtgctggacatggcccgggccggcttcctgctgaacatcattggagtgctgatcatcgccctggccatcaacagctggggcatccccctcttcagcctgcacagcttccccagctgggcccagagcaacaccacagcccagtgcctgcccagcctggccaacaccaccacccccagcccctag

SEQ ID NO: 170207 - DNA, 1566 bp, Artificial Sequence
  Description of Artificial Sequence: Synthetic coding sequence
atgcctgtgtgtggaaatgtggccgtggagtacctgaaggacagcaacctgctcttcttcggcggcctgctggtggccatcgctgtggagcactggaacctgcacaagagaattgccctgcgggtgctgctgattgtgggcgtgcggcctgcccccctcatcctgggcttcatgctggtgacagccttcctgtccatgtggatcagcaacacagccaccagcgccatgatggtgcccatcgcccatgctgtgctggaccagctgcacagcagccaggccagcagcaatgtggaggagggcagcaacaaccccacctttgagctgcaggagcccagcccccagaaggaggtgaccaagctggacaatggccaggccctgcctgtgaccagcgccagcagcgagggccgggcccacctgagccagaagcacctgcacctgacccagtgcatgagcctgtgtgtgtgctacagcgccagcatcggcggcatcgccaccctgactggaacagcccccaacctggtgctgcagggccagatcaacagcctcttcccccagaatggaaatgtggtgaactttgcctcctggttctcctttgccttccccaccatggtgatcctgctgctgctggcctggctgtggctgcagatcctcttcctgggcttcaacttcaggaagaactttggaattggagagaagatgcaggagcagcagcaggccgcctactgcgtcatccagacagagcaccggctgctgggccccatgacctttgctgagaaggccatcagcatcctgtttgtgatcctggtgctgctgtggttcacccgggagcccggcttcttcctgggctggggcaacctggccttccccaatgccaagggggagagcatggtgtctgatggcaccgtggccatcttcatcggcatcatcatgttcatcatccccagcaagtttcctggcctgacccaggaccctgaaaatcctgggaagctgaaggcccccctgggcctgctggactggaagacagtgaaccagaagatgccctggaacatcgtgctgctgctgggcggcggctacgccctggccaagggcagcgagaggagcggcctgtctgagtggctgggcaacaagctgacccccctgcagagcgtgcctgccccagccatcgccatcatcctgagcctgctggtggccaccttcacagaatgtaccagcaatgtggccaccaccaccatcttcctgcccatcctggcctccatggcccaggccatctgcctgcaccccctgtatgtgatgctgccctgcaccctggccaccagcctggccttcatgctgcctgtggccaccccaccaaatgccatcgtgttctcctttggagacctgaaggtgctggacatggcccgggccggcttcctgctgaacatcattggagtgctgatcatcgccctggccatcaacagctggggcatccccctcttcagcctgcacagcttccccagctgggcccagagcaacaccacagcccagtgcctgcccagcctggccaacaccaccacccccagcccctag

SEQ ID NO: 170208 - DNA, 1035 bp, Artificial Sequence
  Description of Artificial Sequence: Synthetic coding sequence
atggccctcttctggtgcacagaggccctgcccctggccgtgacagccctcttccccctcatcctcttccccatgatgggcatcgtggatgccagcgaggtggccgtggagtacctgaaggacagcaacctgctcttctttggaggcctgctggtggccatcgctgtggagcactggaacctgcacaagagaattgccctgcgggtgctgctgattgtgggcgtgcggcctgcccccctcatcctgggcttcatgctggtgacagccttcctgtccatgtggatcagcaacacagccaccagcgccatgatggtgcccatcgcccatgctgtgctggaccagctgcacagcagccaggccagcagcaatgtggaggagggcagcaacaaccccacctttgagctgcaggagcccagcccccagaaggaggtgaccaagctggacaatggccaggccctgcctgtgaccagcgccagcagcgagggccgggcccacctgagccagaagcacctgcacctgacccagtgcatgagcctgtgtgtgtgctacagcgccagcattggaggcatcgccaccctgaccggcacagcccccaacctggtgctgcagggccagatcaacagcctcttcccccagaatggaaatgtggtgaactttgcctcctggttctcctttgccttccccaccatggtgatcctgctgctgctggcctggctgtggctgcagatcctcttcctgggcttcaacttcaggaagaactttggcatcggggagaagatgcaggagcagcagcaggccgcctactgtgtgatccagacagagcaccggctgctgggccccatgacctttgctgagaaggccatcagcatcctcttcgtcatcctggtgctgctgtggttcacccgggagcccggcttcttctggctgggccagtttggcttcagccagtgccagggcggggaggtgcgggtggccggcgtgggccgccgcacccacctgggcctgacctgcagcggccggcgggagggctactag

SEQ ID NO: 170209 - DNA, 1650 bp, Artificial Sequence
  Description of Artificial Sequence: Synthetic coding sequence
atggccacctgctggcaggccctgtgggcctaccgcagctacctgattgtgttctttgtgcccatcctgctgctgcccctgcccatcctggtgcccagcaaggtggccgtggagtacctgaaggacagcaacctgctcttcttcggcggcctgctggtggccatcgctgtggagcactggaacctgcacaagagaattgccctgcgggtgctgctgattgtgggcgtgcggcctgcccccctcatcctgggcttcatgctggtgacagccttcctgtccatgtggatcagcaacacagccaccagcgccatgatggtgcccatcgcccatgctgtgctggaccagctgcacagcagccaggccagcagcaatgtggaggagggcagcaacaaccccacctttgagctgcaggagcccagcccccagaaggaggtgaccaagctggacaatggccaggccctgcctgtgaccagcgccagcagcgagggccgggcccacctgagccagaagcacctgcacctgacccagtgcatgagcctgtgtgtgtgctacagcgccagcatcggcggcatcgccaccctgactggaacagcccccaacctggtgctgcagggccagatcaacagcctcttcccccagaatggaaatgtggtgaactttgcctcctggttctcctttgccttccccaccatggtgatcctgctgctgctggcctggctgtggctgcagatcctcttcctgggcttcaacttcaggaagaactttggaattggagagaagatgcaggagcagcagcaggccgcctactgcgtcatccagacagagcaccggctgctgggccccatgacctttgctgagaaggccatcagcatcctgtttgtgatcctggtgctgctgtggttcacccgggagcccggcttcttcctgggctggggcaacctggccttccccaatgccaagggggagagcatggtgtctgatggcaccgtggccatcttcatcggcatcatcatgttcatcatccccagcaagtttcctggcctgacccaggaccctgaaaatcctgggaagctgaaggcccccctgggcctgctggactggaagacagtgaaccagaagatgccctggaacatcgtgctgctgctgggcggcggctacgccctggccaagggcagcgagaggagcggcctgtctgagtggctgggcaacaagctgacccccctgcagagcgtgcctgccccagccatcgccatcatcctgagcctgctggtggccaccttcacagaatgtaccagcaatgtggccaccaccaccatcttcctgcccatcctggcctccatggcccaggccatctgcctgcaccccctgtatgtgatgctgccctgcaccctggccaccagcctggccttcatgctgcctgtggccaccccaccaaatgccatcgtgttctcctttggagacctgaaggtgctggacatggcccgggccggcttcctgctgaacatcattggagtgctgatcatcgccctggccatcaacagctggggcatccccctcttcagcctgcacagcttccccagctgggcccagagcaacaccacagcccagtgcctgcccagcctggccaacaccaccacccccagcccctag

SEQ ID NO: 170210 - DNA, 1809 bp, Artificial Sequence
  Description of Artificial Sequence: Synthetic coding sequence
atggccgccctggccgctgctgccaagaaggtgtggagcgcccggcggctgctggtgctgctcttcacccccctggccctgctgcctgtggtgtttgccctgccccccaaggagggccgctgcctgtttgtgatcctgctgatggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcaccggcgcatcgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagcgaggagaacacagctgctgtgagaagaaatggcctgcacacagtgcccacagagatgcagttcctggccagcacagaggccaaggaccaccctggagaaacagaggtgcccctggacctgcctgctgacagcaggaaagaagatgagtacagaagaaacatctggaagggcttcctgatcagcatcccctacagcgccagcatcggcggcacagccaccctgactggaacagcccccaacctgatcctgctgggccagctgaagagcttcttcccccagtgtgatgtggtgaactttggctcctggttcatctttgccttccccctgatgctgctcttcctgctggccggctggctgtggatctccttcctgtatggaggcctgtccttccggggctggaggaagaacaagtctgagatccgcaccaatgcagaagatcgggcccgggccgtcatccgggaggagtaccagaacctgggccccatcaagtttgctgagcaggccgtgttcatcctcttctgcatgtttgccatcctgctcttcacccgggaccccaagttcatccctggctgggccagcctcttcaaccctggcttcctgagtgatgctgtgactggagtggccatcgtgaccatcctcttcttcttccccagccagaggcccagcctgaagtggtggtttgacttcaaggcccccaacacagaaacagagcccctgctgacctggaagaaggcccaggagaccgtgccctggaacatcatcctgctgctgggcggcggctttgccatggccaagggctgtgaggagagcggcctgtctgtgtggattggaggccagctgcaccccctggagaatgtgcccccagccctggccgtgctgctgatcaccgtggtgattgccttcttcacagaatttgccagcaacacagccaccatcatcatcttcctgcctgtgctggccgagctggccatccggctgcgggtgcaccccctgtacctgatgatccctggcaccgtgggctgcagctttgccttcatgctgcctgtgtccaccccacccaacagcatcgcctttgccagcggccacctgctggtgaaggacatggtgaggacaggcctgctgatgaacctgatgggcgtgctgctgctgagcctggccatgaacacctgggcccagaccatcttccagctgggcaccttcccagactgggccgacatgtacagcgtgaatgtgacagccctgccccccaccctggccaatgacaccttccgcaccctgtag

SEQ ID NO: 170211 - DNA, 1668 bp, Artificial Sequence
  Description of Artificial Sequence: Synthetic coding sequence
atggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcacagaagaattgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagtgaagaaaatacagctgctgtgagaagaaatggcctgcacacagtgcccacagagatgcagttcctggccagcacagaggccaaggaccaccctggagaaacagaggtgcccctggacctgcctgctgacagcaggaaggaggatgagtacagaagaaacatctggaagggcttcctgatcagcatcccctacagcgccagcattggaggaacagccaccctgaccggcacagcccccaacctgatcctgctgggccagctgaagagcttcttcccccagtgtgatgtggtgaactttggctcctggttcatctttgccttccccctgatgctgctcttcctgctggccggctggctgtggatctccttcctgtatggaggcctgtccttccggggctggaggaagaacaagtctgagatccgcaccaatgctgaggaccgggcccgggctgtgatccgggaggagtaccagaacctgggccccatcaagtttgctgagcaggccgtgttcatcctcttctgcatgtttgccatcctgctcttcacccgggaccccaagttcatccctggctgggccagcctcttcaaccctggcttcctgagtgatgctgtgactggagtggccatcgtgaccatcctcttcttcttccccagccagaggcccagcctgaagtggtggtttgacttcaaggcccccaacacagaaacagagcccctgctgacctggaagaaggcccaggagaccgtgccctggaacatcatcctgctgctgggcggcggctttgccatggccaagggctgtgaggagagcggcctgtctgtgtggattggaggccagctgcaccccctggagaatgtgcccccagccctggccgtgctgctgatcaccgtggtgattgccttcttcacagaatttgccagcaacacagccaccatcatcatcttcctgcctgtgctggccgagctggccatccggctgcgggtgcaccccctgtacctgatgatccctggcaccgtgggctgcagctttgccttcatgctgcctgtgtccaccccacccaacagcatcgcctttgccagcggccacctgctggtgaaggacatggtgaggacaggcctgctgatgaacctgatgggcgtgctgctgctgagcctggccatgaacacctgggcccagaccatcttccagctgggcaccttcccagactgggccgacatgtacagcgtgaatgtgacagccctgccccccaccctggccaatgacaccttccgcaccctgtag

SEQ ID NO: 170212 - DNA, 699 bp, Artificial Sequence
  Description of Artificial Sequence: Synthetic coding sequence
atggccgccctggccgctgctgccaagaaggtgtggagcgcccggcggctgctggtgctgctcttcacccccctggccctgctgcctgtggtgtttgccctgccccccaaggagggccgctgcctgtttgtgatcctgctgatggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcaccggcgcatcgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagcgaggagaacacaggcatcgagcccaacaccttcctgtctgaggagcggctgaagctgcaggcccccctggtgatccggctgggccagatcacagaaagtggccagtggaacatgtctggaaatgatgtgtgcaacttccgggtgctgtccttcctgcccggcggcatgtag

SEQ ID NO: 170213 - DNA, 1017 bp, Artificial Sequence
  Description of Artificial Sequence: Synthetic coding sequence
atggccgccctggccgctgctgccaagaaggtgtggagcgcccggcggctgctggtgctgctcttcacccccctggccctgctgcctgtggtgtttgccctgccccccaaggagggccgctgcctgtttgtgatcctgctgatggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcaccggcgcatcgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagcgaggagaacacagccaagaccaccctgggccggcagcgcttccactggatctgccgcctgaccccaggccgcaggatgaacatcgtgggcaccagcggccgggccagcagcagccccagccccacccagcctgtgctgggcgcccagccccacagccgggcccagcccctgaccagcagctgcctggccagcagccggggctggctgtggatctccttcctgtatggaggcctgtccttccggggctggaggaagaacaagtctgagatccgcaccaatgcagaagatcgggcccgggccgtcatccgggaggagtaccagaacctgggccccatcaagtttgctgagcaggccgtgttcatcctcttctgcatgtttgccatcctgctcttcacccgggaccccaagttcatccctggctgggccagcctcttcaaccctggctgcaagatgggcatcatcagcatcagcaccatccagaagatgtag

SEQ ID NO: 170214 - DNA, 1563 bp, Artificial Sequence
  Description of Artificial Sequence: Synthetic coding sequence
atggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcacagaagaattgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagtgaagaaaatacagctgctgtgagaagaaatggcctgcacacagtgcccacagagatgcagttcctggccagcacagaggccaaggaccaccctggagaaacagaggtgcccctggacctgcctgctgacagcaggaaggaggatgagtacagaagaaacatctggaagggcttcctgatcagcatcccctacagcgccagcattggaggaacagccaccctgaccggcacagcccccaacctgatcctgctgggccagctgaagagcttcttcccccagtgtgatgtggtgaactttggctcctggttcatctttgccttccccctgatgctgctcttcctgctggccggctggctgtggatctccttcctgtatggaggcctgtccttccggggctggaggaagaacaagtctgagatccgcaccaatgctgaggaccgggcccgggctgtgatccgggaggagtaccagaacctgggccccatcaagttcctgagtgatgctgtgactggagtggccatcgtgaccatcctcttcttcttccccagccagaggcccagcctgaagtggtggtttgacttcaaggcccccaacacagaaacagagcccctgctgacctggaagaaggcccaggagaccgtgccctggaacatcatcctgctgctgggcggcggctttgccatggccaagggctgtgaggagagcggcctgtctgtgtggattggaggccagctgcaccccctggagaatgtgcccccagccctggccgtgctgctgatcaccgtggtgattgccttcttcacagaatttgccagcaacacagccaccatcatcatcttcctgcctgtgctggccgagctggccatccggctgcgggtgcaccccctgtacctgatgatccctggcaccgtgggctgcagctttgccttcatgctgcctgtgtccaccccacccaacagcatcgcctttgccagcggccacctgctggtgaaggacatggtgaggacaggcctgctgatgaacctgatgggcgtgctgctgctgagcctggccatgaacacctgggcccagaccatcttccagctgggcaccttcccagactgggccgacatgtacagcgtgaatgtgacagccctgccccccaccctggccaatgacaccttccgcaccctgtag

SEQ ID NO: 170215 - DNA, 1659 bp, Artificial Sequence
  Description of Artificial Sequence: Synthetic coding sequence
atggccgccctggccgctgctgccaagaaggtgtggagcgcccggcggctgctggtgctgctcttcacccccctggccctgctgcctgtggtgtttgccctgccccccaaggagggccgctgcctgtttgtgatcctgctgatggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcaccggcgcatcgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagcgaggagaacacagccaagaccaccctgggccggcagcgcttccactggatctgccgcctgaccccaggccgcaggatgaacatcgtgggcaccagcggccgggccagcagcagccccagccccacccagcctgtgctgggcgcccagccccacagccgggcccagcccctgaccagcagctgcctggccagcagccggggctggctgtggatctccttcctgtatggaggcctgtccttccggggctggaggaagaacaagtctgagatccgcaccaatgcagaagatcgggcccgggccgtcatccgggaggagtaccagaacctgggccccatcaagtttgctgagcaggccgtgttcatcctcttctgcatgtttgccatcctgctcttcacccgggaccccaagttcatccctggctgggccagcctcttcaaccctggcttcctgagtgatgctgtgactggagtggccatcgtgaccatcctcttcttcttccccagccagaggcccagcctgaagtggtggtttgacttcaaggcccccaacacagaaacagagcccctgctgacctggaagaaggcccaggagaccgtgccctggaacatcatcctgctgctgggcggcggctttgccatggccaagggctgtgaggagagcggcctgtctgtgtggattggaggccagctgcaccccctggagaatgtgcccccagccctggccgtgctgctgatcaccgtggtgattgccttcttcacagaatttgccagcaacacagccaccatcatcatcttcctgcctgtgctggccgagctggccatccggctgcgggtgcaccccctgtacctgatgatccctggcaccgtgggctgcagctttgccttcatgctgcctgtgtccaccccacccaacagcatcgcctttgccagcggccacctgctggtgaaggacatggtgaggacaggcctgctgatgaacctgatgggcgtgctgctgctgagcctggccatgaacacctgggcccagaccatcttccagctgggcaccttcccagactgggccgacatgtacagcgtgaatgtgacagccctgccccccaccctggccaatgacaccttccgcaccctgtag

SEQ ID NO: 170216 - DNA, 558 bp, Artificial Sequence
  Description of Artificial Sequence: Synthetic coding sequence
atggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcacagaagaattgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagtgaagaaaatactggaattgagcccaacaccttcctgtctgaggagcggctgaagctgcaggcccccctggtgatccggctgggccagatcacagagagcggccagtggaacatgtctggaaatgatgtgtgcaacttccgggtgctgtccttcctgcccggcggcatgtag

SEQ ID NO: 170217 - DNA, 564 bp, Artificial Sequence
  Description of Artificial Sequence: Synthetic coding sequence
atgctgagccctgcctggctgctgagccccagctgcagcagcagccggcccaagggccccctgagcagcggcggcctgaccagcaaggagagcggcctgtctgtgtggattggaggccagctgcaccccctggagaatgtgcccccagccctggccgtgctgctgatcaccgtggtgattgccttcttcacagaatttgccagcaacacagccaccatcatcatcttcctgcctgtgctggccgagctggccatccggctgcgggtgcaccccctgtacctgatgatccctggcaccgtgggctgcagctttgccttcatgctgcctgtgtccaccccacccaacagcatcgcctttgccagcggccacctgctggtgaaggacatggtgaggacaggcctgctgatgaacctgatgggcgtgctgctgctgagcctggccatgaacacctgggcccagaccatcttccagctgggcaccttcccagactgggccgacatgtacagcgtgaatgtgacagccctgccccccaccctggccaatgacaccttccgcaccctgtag

SEQ ID NO: 170218 - DNA, 1230 bp, Artificial Sequence
  Description of Artificial Sequence: Synthetic coding sequence
atggctgtgtactggtgcacagaggccctgcccctgtctgtgacagccctgctgcccatcgtgctcttccccttcatgggcatcctgcccagcaacaaggtgtgcccccagtacttcctggacaccaacttcctgttcctgagcggcctcatcatggccagcgccatcgaggagtggaacctgcacagaagaattgccctgaagatcctgatgctggtgggcgtgcagcctgcccggctcatcctgggcatgatggtgaccaccagcttcctgtccatgtggctgagcaacacagccagcacagccatgatgctgcccatcgccaatgccatcctgaagagcctgtttggccagaaggaggtgaggaaggaccccagccaggagagtgaagaaaatacagctgctgtgagaagaaatggcctgcacacagtgcccacagagatgcagttcctggccagcacagaggccaaggaccaccctggagaaacagaggtgcccctggacctgcctgctgacagcaggaaggaggatgagtacagaagaaacatctggaagggcttcctgatcagcatcccctacagcgccagcattggaggaacagccaccctgaccggcacagcccccaacctgatcctgctgggccagctgaagagcttcttcccccagtgtgatgtggtgaactttggctcctggttcatctttgccttccccctgatgctgctcttcctgctggccggctggctgtggatctccttcctgtatggaggcctgtccttccggggctggaggaagaacaagtctgagatccgcaccaatgctgaggaccgggcccgggctgtgatccgggaggagtaccagaacctgggccccatcaagtttgctgagcaggccgtgttcatcctcttctgcatgtttgccatcctgctcttcacccgggaccccaagttcatccctggctgggccagcctcttcaaccctggcttcctgagtgatgctgtgactggagtggccatcgtgaccatcctcttcttcttccccagccagaggcccagcctgaagtggtggtttgacttcaaggcccccaacacagaaacagagcccctgctgacctggaagaaggcccaggagaccgtgccctggaacatcatcctgctgctgggcggcggctttgccatggccaagggctgtgaggagagcggcctgtctgtgtggattggaggccagctgtag

SEQ ID NO: 170219 - DNA, 1668 bp, Artificial Sequence; identical to SEQ ID NO: 170211
  Description of Artificial Sequence: Synthetic coding sequence

SEQ ID NO: 170220 - DNA, 2763 bp, Artificial Sequence
  Description of Artificial Sequence: Synthetic coding sequence
atgtctgacccccacagcagccccctgctgcctgagcccctgagcagccgctacaagctgtatgaagctgagttcaccagccccagctggcccagcaccagcccagacacccacccagccctgcccctgctggagatgcctgaggagaaggacctgcggagcagcaatgaagacagccacatcgtgaagattgagaagctgaatgaaagaagcaagaggaaggatgatggagtggcccaccgggacagcgctggccagcgctgcatctgcctgagcaaggctgtgggctacctgactggagacatgaaggagtaccgcatctggctgaaggacaagcacctggccctgcagttcatcgactgggtgctgcggggcacagcccaggtgatgttcatcaacaaccccctgagcggcctcatcatcttcatcggcctgctgatccagaacccctggtggaccatcactggaggcctgggcaccgtggtgtccaccctgacagccctggccctgggccaggacagaagtgccatcgccagcggcctgcacggctacaacggcatgctggtgggcctgctgatggctgtgttttctgagaagctggactactactggtggctgctcttccctgtgaccttcaccgccatgagctgccctgtgctgagcagcgccctgaacagcatcttcagcaagtgggacctgcccgtcttcaccctgcccttcaacattgctgtgaccctgtacctggccgccaccggccactacaacctcttcttccccaccaccctggtggagcctgtgtcctctgtgcccaacatcacctggacagagatggagatgcccctgctgctgcaggccatccctgtgggcgtgggccaggtgtatggctgtgacaacccctggacaggaggagtcttcctggtggccctcttcatcagcagccccctcatctgcctgcacgccgccatcggcagcatcgtgggcctgctggccgccctgtctgtggccaccccatttgagaccatctacacaggcctgtggagctacaactgtgtgctgagctgcatcgccatcggcggcatgttctacgccctgacctggcagacccacctgctggccctgatctgtgccctcttctgtgcctacatggaggccgccatcagcaacatcatgtctgtggtgggcgtgcccccaggcacctgggccttctgcctggccaccatcatcttcctgctgctgaccaccaacaacccagccatcttccggctgcccctgagcaaggtgacctacccagaggccaaccgcatctactacctgactgtgaagagcggggaggaggagaaggcccccagcggcggcggcggggagcaccccccaacagctggccccaaggtggaggagggcagcgaggccgtgctgagcaagcacaggtctgtgttccacatcgagtggagcagcatcagaagaagaagcaaggtgtttggaaaaggagagcaccaggagcggcagaacaaggaccccttcccctaccgctacaggaagcccaccgtggagctgctggacctggacaccatggaggagagcagcgagatcaaggtggagaccaacatcagcaagacctcctggatccgcagctccatggccgccagcggcaagagggtgtccaaggccctgagctacatcactggagagatgaaggaatgtggggagggcctgaaggacaagagccctgtgttccagttctttgactgggtgctgcggggcaccagccaggtgatgtttgtgaacaaccccctgagcggcatcctgatcatcctgggcctcttcatccagaacccctggtgggccatcagcggctgcctgggcaccatcatgagcaccctgacagccctgatcctgagccaggacaagagcgccatcgctgctggcttccacggctacaatggagtgctggtgggcctgctgatggctgtgttcagtgacaagggggactactactggtggctgctgctgcctgtgatcatcatgtccatgagctgccccatcctgagcagcgccctgggcaccatcttcagcaagtgggacctgcccgtcttcaccctgcccttcaacatcaccgtgaccctgtacctggccgccaccggccactacaacctcttcttccccaccaccctgctgcagcctgccagcgccatgcccaacatcacctggagcgaggtgcaggtgcccctgctgctgcgggccatccctgtgggcatcggccaggtgtatggctgtgacaacccctggacaggaggcatcttcctgattgccctcttcatcagcagccccctcatctgcctgcacgccgccatcggcagcaccatgggcatgctggccgccctgaccatcgccaccccatttgacagcatctacttcggcctgtgtggcttcaacagcaccctggcctgcatcgccatcggcggcatgttctacgtgatcacctggcagacccacctgctggccatcgcctgtgccctgtttgctgcctacctgggcgccgccctggccaacatgctgtctgtgtttggcctgcccccctgcacctggcccttctgcctgagcgccctgaccttcctgctgctgaccaccaacaacccagccatctacaagctgcccctgagcaaggtgacctacccagaggccaaccgcatctactacctgagccaggagaggaacagaagagccagcatcatcaccaagtaccaggcctatgatgtgtcctag

SEQ ID NO: 170221 - DNA, 1170 bp, Artificial Sequence
  Description of Artificial Sequence: Synthetic coding sequence
atggaggacagccccaccatggtgcgggtggacagccccaccatggtgagaggagagaaccaggtgagcccctgccagggccgccgctgcttccccaaggccctgggctacgtgactggagacatgaaggagctggccaaccagctgaaggacaagcctgtggtgctgcagttcatcgactggatcctgcggggcatcagccaggtggtgtttgtgaacaaccctgtgtctggcatcctgatcctggtgggcctgctggtgcagaacccctggtgggccctgaccggctggctgggcaccgtggtgtccaccctgatggccctgctgctgagccaggacaggagcctgattgccagcggcctgtatggctacaatgccaccctggtgggcgtgctgatggctgtgttcagtgacaagggggactacttctggtggctgctgctgcctgtgtgtgccatgtccatgacctgccccatcttcagcagcgccctgaacagcatgctgagcaagtgggacctgcccgtcttcaccctgcccttcaacatggccctgtccatgtacctgagcgccaccggccactacaaccccttcttccctgccaagctggtgatccccatcaccacagcccccaacatctcctggagcgacctgagcgccctggagctgctgaagagcatccctgtgggcgtgggccagatctacggctgtgacaacccctggacaggaggcatcttcctgggcgccatcctgctgagcagccccctgatgtgcctgcacgccgccatcggcagcctgctgggcattgctgctggcctgagcctgagcgccccctttgaggacatctacttcggcctgtggggcttcaacagcagcctggcctgcatcgccatgggcggcatgttcatggccctgacctggcagacccacctgctggccctgggctgtgccctcttcaccgcctacctgggcgtgggcatggccaacttcatggccgaggtgggcctgcctgcctgcacctggcccttctgcctggccaccctgctcttcctgatcatgaccaccaagaacagcaacatctacaagatgcccctgagcaaggtgacctacccagaggagaaccgcatcttctacctgcaggccaagaagaggatggtggagagccccctgtag

SEQ ID NO: 170222 - DNA, 855 bp, Artificial Sequence
  Description of Artificial Sequence: Synthetic coding sequence
atggccctgctgctgagccaggacaggagcctcatcgccagcggcctgtatggctacaatgccaccctggtgggcgtgctgatggctgtgttcagtgacaagggggactacttctggtggctgctgctgcctgtgtgtgccatgtccatgacctgccccatcttcagcagcgccctgaacagcatgctgagcaagtgggacctgcctgtgttcaccctgcccttcaacatggccctgtccatgtacctgagcgccaccggccactacaaccccttcttccctgccaagctggtgatccccatcaccacagcccccaacatctcctggagcgacctgagcgccctggagctgctgaagagcatccctgtgggcgtgggccagatctacggctgtgacaacccctggacaggaggcatcttcctgggcgccatcctgctgagcagccccctgatgtgcctgcatgctgccatcggcagcctgctgggcattgctgctggcctgagcctgagcgccccctttgaggacatctacttcggcctgtggggcttcaacagcagcctggcctgcatcgccatgggcggcatgttcatggccctgacctggcagacccacctgctggccctgggctgtgccctcttcaccgcctacctgggcgtgggcatggccaacttcatggccgaggtgggcctgcctgcctgcacctggcccttctgcctggccaccctgctcttcctgatcatgaccaccaagaacagcaacatctacaagatgcccctgagcaaggtgacctacccagaagaaaatcgcatcttctacctgcaggccaagaagaggatggtggagagccccctgtag

SEQ ID NO: 170223 - DNA, 1338 bp, Artificial Sequence
  Description of Artificial Sequence: Synthetic coding sequence
atgaatggccgcagcctgattggaggagctggagatgcccggcacggccctgtgtggaaggaccccttcggcaccaaggctggagatgctgcccggcggggcatcgcccggctgagcctggccctggctgatggcagccaggagcaggagcctgaggaggagatcgccatggaggacagccccaccatggtgcgggtggacagccccaccatggtgagaggagagaaccaggtgagcccctgccagggccgccgctgcttccccaaggccctgggctacgtgactggagacatgaaggagctggccaaccagctgaaggacaagcctgtggtgctgcagttcatcgactggatcctgcggggcatcagccaggtggtgtttgtgaacaaccctgtgtctggcatcctgatcctggtgggcctgctggtgcagaacccctggtgggccctgaccggctggctgggcaccgtggtgtccaccctgatggccctgctgctgagccaggacaggagcctgattgccagcggcctgtatggctacaatgccaccctggtgggcgtgctgatggctgtgttcagtgacaagggggactacttctggtggctgctgctgcctgtgtgtgccatgtccatgacctgccccatcttcagcagcgccctgaacagcatgctgagcaagtgggacctgcccgtcttcaccctgcccttcaacatggccctgtccatgtacctgagcgccaccggccactacaaccccttcttccctgccaagctggtgatccccatcaccacagcccccaacatctcctggagcgacctgagcgccctggagctgctgaagagcatccctgtgggcgtgggccagatctacggctgtgacaacccctggacaggaggcatcttcctgggcgccatcctgctgagcagccccctgatgtgcctgcacgccgccatcggcagcctgctgggcattgctgctggcctgagcctgagcgccccctttgaggacatctacttcggcctgtggggcttcaacagcagcctggcctgcatcgccatgggcggcatgttcatggccctgacctggcagacccacctgctggccctgggctgtgccctcttcaccgcctacctgggcgtgggcatggccaacttcatggccgaggtgggcctgcctgcctgcacctggcccttctgcctggccaccctgctcttcctgatcatgaccaccaagaacagcaacatctacaagatgcccctgagcaaggtgacctacccagaggagaaccgcatcttctacctgcaggccaagaagaggatggtggagagccccctgtag

SEQ ID NO: 170224 - DNA, 1338 bp, Artificial Sequence; identical to SEQ ID NO: 170223
  Description of Artificial Sequence: Synthetic coding sequence

SEQ ID NO: 170225 - DNA, 645 bp, Artificial Sequence
  Description of Artificial Sequence: Synthetic coding sequence
atgaatggccgcagcctgattggaggagctggagatgcccggcacggccctgtgtggaaggaccccttcggcaccaaggctggagatgctgcccggcggggcatcgcccggctgagcctggccctggctgatggcagccaggagcaggagcctgaggaggagatcgccatggaggacagccccaccatggtgcgggtggacagccccaccatggtgagaggagagaaccaggtgagcccctgccagggccgccgctgcttccccaaggccctgggctacgtgactggagacatgaaggagctggccaaccagctgaaggacaagcctgtggtgctgcagttcatcgactggatcctgcggggcatcagccaggtggtgtttgtgaacaaccctgtgtctggcatcctgatcctggtgggcctgctggtgcagaacccctggtgggccctgaccggctggctgggcaccgtggtgtccaccctgatggccctgctgctgagccaggacaggagcctgattgccagcggcctgtatggctacaatgccaccctggtgggcgtgctgatggctgtgttcagtgacaagggggactacttctggtggctgctgctgcctgtgtgtgccatgtccatgacctgctgctag

SEQ ID NO: 170226 - DNA, 846 bp, Artificial Sequence
  Description of Artificial Sequence: Synthetic coding sequence
atgggcagaagaaacagaagcctgattgccagcggcctgtatggctacaatgccaccctggtgggcgtgctgatggctgtgttcagtgacaagggggactacttctggtggctgctgctgcctgtgtgtgccatgtccatgacctgccccatcttcagcagcgccctgaacagcatgctgagcaagtgggacctgcccgtcttcaccctgcccttcaacatggccctgtccatgtacctgagcgccaccggccactacaaccccttcttccctgccaagctggtgatccccatcaccacagcccccaacatctcctggagcgacctgagcgccctggagctgctgaagagcatccctgtgggcgtgggccagatctacggctgtgacaacccctggacaggaggcatcttcctgggcgccatcctgctgagcagccccctgatgtgcctgcacgccgccatcggcagcctgctgggcattgctgctggcctgagcctgagcgccccctttgaggacatctacttcggcctgtggggcttcaacagcagcctggcctgcatcgccatgggcggcatgttcatggccctgacctggcagacccacctgctggccctgggctgtgccctcttcaccgcctacctgggcgtgggcatggccaacttcatggccgaggtgggcctgcctgcctgcacctggcccttctgcctggccaccctgctcttcctgatcatgaccaccaagaacagcaacatctacaagatgcccctgagcaaggtgacctacccagaggagaaccgcatcttctacctgcaggccaagaagaggatggtggagagccccctgtag

SEQ ID NO: 170227 - DNA, 774 bp, Artificial Sequence
  Description of Artificial Sequence: Synthetic coding sequence
atggctgtgttcagtgacaagggggactacttctggtggctgctgctgcctgtgtgtgccatgtccatgacctgccccatcttcagcagcgccctgaacagcatgctgagcaagtgggacctgcccgtcttcaccctgcccttcaacatggccctgtccatgtacctgagcgccaccggccactacaaccccttcttccctgccaagctggtgatccccatcaccacagcccccaacatctcctggagcgacctgagcgccctggagctgctgaagagcatccctgtgggcgtgggccagatctacggctgtgacaacccctggacaggaggcatcttcctgggcgccatcctgctgagcagccccctgatgtgcctgcacgccgccatcggcagcctgctgggcattgctgctggcctgagcctgagcgccccctttgaggacatctacttcggcctgtggggcttcaacagcagcctggcctgcatcgccatgggcggcatgttcatggccctgacctggcagacccacctgctggccctgggctgtgccctcttcaccgcctacctgggcgtgggcatggccaacttcatggccgaggtgggcctgcctgcctgcacctggcccttctgcctggccaccctgctcttcctgatcatgaccaccaagaacagcaacatctacaagatgcccctgagcaaggtgacctacccagaggagaaccgcatcttctacctgcaggccaagaagaggatggtggagagccccctgtag

SEQ ID NO: 170228 - DNA, 2763 bp, Artificial Sequence; identical to SEQ ID NO: 170220
  Description of Artificial Sequence: Synthetic coding sequence

SEQ ID NO: 170229 - DNA, 708 bp, Artificial Sequence
  Description of Artificial Sequence: Synthetic coding sequence
atgtctgacccccacagcagccccctgctgcctgagcccctgagcagccgctacaagctgtatgaagctgagttcaccagccccagctggcccagcaccagcccagacacccacccagccctgcccctgctggagatgcctgaggagaaggacctgcggagcagcaatgaagacagccacatcgtgaagattgagaagctgaatgaaagaagcaagaggaaggatgatggagtggcccaccgggacagcgctggccagcgctgcatctgcctgagcaaggctgtgggctacctgactggagacatgaaggagtaccgcatctggctgaaggacaagcacctggccctgcagttcatcgactgggtgctgcggggcacagcccaggtgatgttcatcaacaaccccctgagcggcctcatcatcttcatcggcctgctgatccagaacccctggtggaccatcactggaggcctgggcaccgtggtgtccaccctgacagccctggccctgggccaggacagaagtgccatcgccagcggcctgcacggctacaacggcatgctggtgggcctgctgatggctgtgttttctgagaagctggactactactggtggctgctcttccctgtgaccttcaccgccatgtcctggatggagacagacttcaactggagcaagagcggctgctggaagcacctgctgcagtag

SEQ ID NO: 170230 - DNA, 627 bp, Artificial Sequence
  Description of Artificial Sequence: Synthetic coding sequence
atggaccagtggggcgtgtacttcaaccctgtgctggtgtccttctgccagagcttcttcggctaccccctgagcatcttcttcatcgtggtgaatgagttctgtgagcgcttctcctactacggcatgagggccatcctgatcctgtacttcaccaacttcatctcctgggatgacaacctgagcacagccatctaccacacctttgtggccctgtgctacctgacccccatcctgggcgccctgattgctgacagctggctgggcaagttcaagaccatcgtgtccctgagcatcgtgtacaccatcggccaggccgtgacctctgtgagcagcatcaatgacctgacagaccacaaccatgatggcaccccagacagcctgcctgtgcacgtggtgctgagcctgattggcctggccctgattgccctgggcaccggcggcatcaagccctgtgtgtctgccttcggcggggaccagtttgaggagggccaggagaagcagaggaaccgcttcttcagcatcttctacctggccatcaatgccggcagcctgctgagcaccatcatcacccccatgctgcggggcaagcgctacctgaagggcacctctgtgggcctcttctag

SEQ ID NO: 170231 - DNA, 849 bp, Artificial Sequence
  Description of Artificial Sequence: Synthetic coding sequence
atgagggccatcctgatcctgtacttcaccaacttcatctcctgggatgacaacctgagcacagccatctaccacacctttgtggccctgtgctacctgacccccatcctgggcgccctgattgctgacagctggctgggcaagttcaagaccatcgtgtccctgagcatcgtgtacaccatcggccaggccgtgacctctgtgagcagcatcaatgacctgacagaccacaaccatgatggcaccccagacagcctgcctgtgcacgtggtgctgagcctgattggcctggccctgattgccctgggcaccggcggcatcaagccctgtgtgtctgccttcggcggggaccagtttgaggagggccaggagaagcagaggaaccgcttcttcagcatcttctacctggccatcaatgccggcagcctgctgagcaccatcatcacccccatgctgcggggcaagcgctacctgaagggcacctctgtgggcctcttcctggtgcggcccagcccctgcctgctgcgctttgtgctcttcttccccagcgccctcttcagcagctgccagctgcatgctggcatgcacgtgggcatctggagcaagtgcttcctgccctgtgagttccacctgctgtttgtgctcttcaagagcctcatccctgtgaccaccggggagagcaagcccagcctggcctgggccagcatcttcctgaactgctacagctgcaaggtgatgctggtggtgcggggcaagaggcaggagcgctgcctgggcagccaggccggcggccgcagctgccacttcagcctgcaggccctgctgcccagcgacatctctgtgacctag

SEQ ID NO: 170232 - DNA, 2127 bp, Artificial Sequence
  Description of Artificial Sequence: Synthetic coding sequence
atgggcatgagcaagagccacagcttcttcggctaccccctgagcatcttcttcatcgtggtgaatgagttctgtgagcgcttctcctactacggcatgagggccatcctgatcctgtacttcaccaacttcatctcctgggatgacaacctgagcacagccatctaccacacctttgtggccctgtgctacctgacccccatcctgggcgccctgattgctgacagctggctgggcaagttcaagaccatcgtgtccctgagcatcgtgtacaccatcggccaggccgtgacctctgtgagcagcatcaatgacctgacagaccacaaccatgatggcaccccagacagcctgcctgtgcacgtggtgctgagcctgattggcctggccctgattgccctgggcaccggcggcatcaagccctgtgtgtctgccttcggcggggaccagtttgaggagggccaggagaagcagaggaaccgcttcttcagcatcttctacctggccatcaatgccggcagcctgctgagcaccatcatcacccccatgctgcgggtgcagcagtgtggcatccacagcaagcaggcctgctaccccctggccttcggcgtgcctgctgccctgatggctgtggccctgattgtgtttgtgctgggcagcggcatgtacaagaagttcaagccccagggcaacatcatgggcaaggtggccaagtgcatcggctttgccatcaagaaccgcttccgccacaggagcaaggccttccccaagcgggagcactggctggactgggccaaggagaagtatgatgagcggctcatcagccagatcaagatggtgaccagggtgatgttcctgtacatccccctgcccatgttctgggccctgtttgaccagcagggcagccgctggaccctgcaggccaccaccatgtctgggaagattggagccctggagatccagcctgaccagatgcagacagtgaatgccatcctgattgtcatcatggtgcccatctttgatgctgtgctgtaccccctcatcgccaagtgtggcttcaacttcaccagcctgaagaagatggctgtgggcatggtgctggcctccatggcctttgtggtggccgccatcgtgcaggtggagattgacaagaccctgcctgtgttccccaagggaaatgaggtgcagatcaaggtgctgaacatcggcaacaacaccatgaacatcagcctgcccggggagatggtgaccctgggccccatgagccagaccaatgccttcatgacctttgatgtgaacaagctgacccgcatcaacatcagcagccctggcagccctgtgacagctgtgacagatgacttcaagcagggccagaggcacaccctgctggtgtgggcccccaaccactaccaggtggtgaaggatggcctgaaccagaagccagagaagggagaaaatggcatccgctttgtgaacaccttcaatgaactcatcaccatcaccatgtctgggaaggtgtatgccaacatcagcagctacaatgccagcacctaccagttcttccccagcggcatcaagggcttcaccatcagcagcacagagatccccccccagtgccagcccaacttcaacaccttctacctggagtttggcagcgcctacacctacatcgtgcagaggaagaatgacagctgcccagaggtgaaggtgtttgaggacatcagcgccaacacagtgaacatggccctgcagatcccccagtacttcctgctgacctgtggggaggtggtgttttctgtgacaggcctggagttctcctacagccaggcccccagcaacatgaagtctgtgctgcaggccggctggctgctgactgtggccgtgggcaacatcatcgtgctgattgtggccggggccggccagttcagcaagcagtgggccgagtacatcctgtttgctgccctgctgctggtggtgtgtgtgatctttgccatcatggcccgcttctacacctacatcaacccagctgagattgaggcccagtttgatgaagatgagaagaagaaccggctggagaagagcaacccctacttcatgtctggggccaacagccagaagcagatgtag

SEQ ID NO: 170233 - DNA, 1503 bp, Artificial Sequence
  Description of Artificial Sequence: Synthetic coding sequence
atgcccccagctgtgggcggccctgtgggctacaccccaccagatggcggctggggctgggccgtggtgattggagccttcatcagcatcggcttctcctatgccttccccaagagcatcaccgtcttcttcaaggagattgagggcatcttccacgccaccaccagcgaggtgtcctggatcagcagcatcatgctggccgtgatgtatggaggcggccccatcagcagcatcctggtgaacaagtatggcagcagaattgtgatgattgtgggcggctgcctgagcggctgcggcctgattgctgccagcttctgcaacacagtgcagcagctgtatgtgtgcatcggcgtgattggaggcctgggcctggccttcaacctgaacccagccctgaccatgattggcaagtacttctacaagaggcggcccctggccaacggcctggccatggccggcagccctgtgttcctgtgcaccctggcccccctgaaccaggtgttcttcggcatcttcggctggaggggcagcttcctgatcctgggcggcctgctgctgaactgctgcgtggccggggccctgatgaggcccatcggccccaagcccaccaaggccggcaaggacaagagcaaggccagcctggagaaggccggcaagagcggcgtgaagaaggacctgcatgatgccaacacagacctgattggccgccaccccaagcaggagaagaggagcgtcttccagaccatcaaccagttcctggacctgaccctcttcacccaccggggcttcctgctgtacctgtctggaaatgtcatcatgttcttcggcctgtttgcccccctggtgttcctgagcagctatggcaagagccagcactacagcagcgagaagagcgccttcctgctgagcatcctggcctttgtggacatggtggcccggcccagcatgggcctggtggccaacaccaagcccatccggccccgcatccagtacttctttgctgcctctgtggtggccaacggggtgtgccacatgctggcccccctgagcaccacctacgtgggcttctgtgtgtatgccggcttctttggatttgccttcggctggctgagctctgtgctgtttgagaccctgatggacctggtgggcccccagcgcttcagcagcgctgtgggcctggtgaccatcgtggagtgctgccctgtgctgctgggcccccccctgctgggccgcctgaatgacatgtacggggactacaagtacacctactgggcctgtggggtggtgctgatcatcagcggcatctacctgttcatcggcatgggcatcaactaccgcctgctggccaaggagcagaaggccaatgagcagaagaaggagagcaaggaggaggagaccagcattgatgtggccggcaagcccaatgaggtgaccaaggctgctgagagcccagaccagaaggacacagatggcggccccaaggaggaggagagccctgtgtag

SEQ ID NO: 170234 - DNA, 648 bp, Artificial Sequence
  Description of Artificial Sequence: Synthetic coding sequence
atgcccccagctgtgggcggccctgtgggctacaccccaccagatggcggctggggctgggccgtggtgattggagccttcatcagcatcggcttctcctatgccttccccaagagcatcaccgtcttcttcaaggagattgagggcatcttccacgccaccaccagcgaggtgtcctggatcagcagcatcatgctggccgtgatgtatggaggcggccccatcagcagcatcctggtgaacaagtatggcagcagaattgtgatgattgtgggcggctgcctgagcggctgcggcctgattgctgccagcttctgcaacacagtgcagcagctgtatgtgtgcatcggcgtgattggaggcctgggcctggccttcaacctgaacccagccctgaccatgattggcaagtacttctacaagaggcggcccctggccaacggcctggccatggccggcagccctgtgttcctgtgcaccctggcccccctgaaccaggtgttcttcggcatcttcggctggaggggcagcttcctgatcctgggcggcctgctgctgaactgctgcgtggccggggccctgatgaggcccatcggccccaagcccaccaaggccggcaaggacaagagcaaggccagcctggagtag

SEQ ID NO: 170235 - DNA, 1293 bp, Artificial Sequence
  Description of Artificial Sequence: Synthetic coding sequence
atgcccccagctgtgggcggccctgtgggctacaccccaccagatggcggctggggctgggccgtggtgattggagccttcatcagcatcggcttctcctatgccttccccaagagcatcaccgtcttcttcaaggagattgagggcatcttccacgccaccaccagcgaggtgtcctggatcagcagcatcatgctggccgtgatgtatggaggcggccccatcagcagcatcctggtgaacaagtatggcagcagaattgtgatgattgtgggcggctgcctgagcggctgcggcctgattgctgccagcttctgcaacacagtgcagcagctgtatgtgtgcatcggcgtgattggaggcctgggcctggccttcaacctgaacccagccctgaccatgattggcaagtacttctacaagaggcggcccctggccaacggcctggccatggccggcagccctgtgttcctgtgcaccctggcccccctgaaccaggtgttcttcggcatcttcggctggaggggcagcttcctgatcctgggcggcctgctgctgaactgctgcgtggccggggccctgatgaggcccatcggccccaagcccaccaaggccggcaaggacaagagcaaggccagcctggagaaggccggcaagagcggcgtgaagaaggacctgcatgatgccaacacagacctgattggccgccaccccaagcaggagaagaggagcgtcttccagaccatcaaccagttcctggacctgaccctcttcacccaccggggcttcctgctgtacctgtctggaaatgtcatcatgttcttcggcctgtttgcccccctggtgttcctgagcagctatggcaagagccagcactacagcagcgagaagagcgccttcctgctgagcatcctggcctttgtggacatggtggcccggcccagcatgggcctggtggccaacaccaagcccatccggccccgcatccagtacttctttgctgcctctgtggtggccaacggggtgtgccacatgctggcccccctgagcaccacctacgtgggcttctgtgtgtatgccggcttctttggatttgccttcggctggctgagctctgtgctgtttgagaccctgatggacctggtgggcccccagcgcttcagcagcgctgtgggcctggtgaccatcgtggagtgctgccctgtgctgctgggcccccccctgctgggcatcgtgtacctgcccaccaacgtgggcctgctgcagaacaagcacgtgcgctgggagtgctag

SEQ ID NO: 170236 - DNA, 891 bp, Artificial Sequence
  Description of Artificial Sequence: Synthetic coding sequence
atgcccccagctgtgggcggccctgtgggctacaccccaccagatggcggctggggctgggccgtggtgattggagccttcatcagcatcggcttctcctatgccttccccaagagcatcaccgtcttcttcaaggagattgagggcatcttccacgccaccaccagcgaggtgtcctggatcagcagcatcatgctggccgtgatgtatggaggcggccccatcagcagcatcctggtgaacaagtatggcagcagaattgtgatgattgtgggcggctgcctgagcggctgcggcctgattgctgccagcttctgcaacacagtgcagcagctgtatgtgtgcatcggcgtgattggaggcctgggcctggccttcaacctgaacccagccctgaccatgattggcaagtacttctacaagaggcggcccctggccaacggcctggccatggccggcagccctgtgttcctgtgcaccctggcccccctgaaccaggtgttcttcggcatcttcggctggaggggcagcttcctgatcctgggcggcctgctgctgaactgctgcgtggccggggccctgatgaggcccatcggccccaagcccaccaaggccggcaaggacaagagcaaggccagcctggagaaggccggcaagagcggcgtgaagaaggacctgcatgatgccaacacagacctgattggccgccaccccaagcaggagaagaggagcgtcttccagaccatcaaccagttcctggacctgaccctcttcacccaccggggcttcctgctgtacctgtctggaaatgtcatcatgttcttcggcctgtttgcccccctggtgttcctgagcagctatggcaagagccagcactacagcagcgagtag

SEQ ID NO: 170237 - DNA, 1371 bp, Artificial Sequence
  Description of Artificial Sequence: Synthetic coding sequence
atgcccccagctgtgggcggccctgtgggctacaccccaccagatggcggctggggctgggccgtggtgattggagccttcatcagcatcggcttctcctatgccttccccaagagcatcaccgtcttcttcaaggagattgagggcatcttccacgccaccaccagcgaggtgtcctggatcagcagcatcatgctggccgtgatgtatggaggcggccccatcagcagcatcctggtgaacaagtatggcagcagaattgtgatgattgtgggcggctgcctgagcggctgcggcctgattgctgccagcttctgcaacacagtgcagcagctgtatgtgtgcatcggcgtgattggaggcctgggcctggccttcaacctgaacccagccctgaccatgattggcaagtacttctacaagaggcggcccctggccaacggcctggccatggccggcagccctgtgttcctgtgcaccctggcccccctgaaccaggtgttcttcggcatcttcggctggaggggcagcttcctgatcctgggcggcctgctgctgaactgctgcgtggccggggccctgatgaggcccatcggccccaagcccaccaaggccggcaaggacaagagcaaggccagcctggagaaggccggcaagagcggcgtgaagaaggacctgcatgatgccaacacagacctgattggccgccaccccaagcaggagaagaggagcgtcttccagaccatcaaccagttcctggacctgaccctcttcacccaccggggcttcctgctgtacctgtctggaaatgtcatcatgttcttcggcctgtttgcccccctggtgttcctgagcagctatggcaagagccagcactacagcagcgagaagagcgccttcctgctgagcatcctggcctttgtggacatggtggcccggcccagcatgggcctggtggccaacaccaagcccatccggccccgcatccagtacttctttgctgcctctgtggtggccaacggggtgtgccacatgctggcccccctgagcaccacctacgtgggcttctgtgtgtatgccggcttctttggatttgccttcggctggctgagctctgtgctgtttgagaccctgatggacctggtgggcccccagcgcttcagcagcgctgtgggcctggtgaccatcgtggagtgctgccctgtgctgctgggcccccccctgctgggccgcctgaatgacatgtacggggactacaagtacacctactgggcctgtggggtggtgctgatcatcagcggcatctacctgttcatcggcatgggcatcaactaccgcctgctggccaaggagcagaaggccaatgaatag

SEQ ID NO: 170238 - DNA, 1503 bp, Artificial Sequence; identical to SEQ ID NO: 170233
  Description of Artificial Sequence: Synthetic coding sequence

SEQ ID NO: 170239 - DNA, 606 bp, Artificial Sequence
  Description of Artificial Sequence: Synthetic coding sequence
atgaagcacgtgaatgaacgcttccaggatgagaagaacaaggaggtggtgctgatgtgcattggagtgaccagcggcgtgggccgcctgctgtttggaagaattgctgactatgtgcctggggtgaagaaggtgtacctgcaggtgctgtccttcttcttcatcggcctgatgtccatgatgatccccctgtgcagcatctttggagccctgattgctgtgtgcctgatcatgggcctgtttgatggctgcttcatcagcatcatggcccccatcgcctttgagctggtgggcgcccaggatgtgtcccaggccatcggcttcctgctgggcttcatgagcatccccatgacagtgggcccccccatcgccggcctgctgcgggacaagctgggcagctatgatgtggccttctacctggccggcgtgccccccctgattggaggagctgtgctgtgcttcatcccctggatccacagcaagaagcagcgggagatcagcaagaccaccgggaaggagaagatggagaagatgctggagaaccagaacagcctgctgagcagcagcagcggcatgttcaagaaggagagtgacagcatcatctag

SEQ ID NO: 170240 - DNA, 1548 bp, Artificial Sequence
  Description of Artificial Sequence: Synthetic coding sequence
atggtgctgagccaggaggagccagacagcgcccggggcaccagcgaggcccagcccctgggccctgcccccactggagctgcccctcctcctggccctggccccagcgacagccctgaggccgctgtggagaaggtggaggtggagctggccggccctgccacagctgagccccatgagcccccagagcccccagagggcggctggggctggctggtgatgctggccgccatgtggtgcaatggatctgtgtttggcatccagaatgcctgtggggtgctgtttgtgtccatgctggagaccttcggcagcaaggatgatgacaagatggtgttcaagacagcctgggtgggcagcctgtccatgggcatgatcttcttctgctgccccatcgtgtctgtgttcacagacctgtttggctgcaggaagacagctgtggtgggcgctgctgtgggctttgtgggcctgatgagcagcagctttgtgagcagcattgagcccctgtacctgacctacggcatcatctttgcctgtggctgcagctttgcctaccagcccagcctggtgatcctgggccactacttcaagaagaggctgggcctggtgaatggaattgtgacagctggcagctctgtgttcaccatcctgctgcccctgctgctgcgggtgctgattgattctgtgggcctcttctacaccctgcgggtgctgtgcatcttcatgtttgtgctcttcctggccggcttcacctaccggcccctggccaccagcaccaaggacaaggagagcggcggcagcggcagcagcctcttcagcaggaagaagttcagcccccccaagaagatcttcaactttgccatcttcaaggtgacagcctatgctgtgtgggccgtgggcatccccctggccctgtttggctactttgtgccctacgtgcacctgatgaagcacgtgaatgaacgcttccaggatgagaagaacaaggaggtggtgctgatgtgcattggagtgaccagcggcgtgggccgcctgctgtttggaagaattgctgactatgtgcctggggtgaagaaggtgtacctgcaggtgctgtccttcttcttcatcggcctgatgtccatgatgatccccctgtgcagcatctttggagccctgattgctgtgtgcctgatcatgggcctgtttgatggctgcttcatcagcatcatggcccccatcgcctttgagctggtgggcgcccaggatgtgtcccaggccatcggcttcctgctgggcttcatgagcatccccatgacagtgggcccccccatcgccggcctgctgcgggacaagctgggcagctatgatgtggccttctacctggccggcgtgccccccctgattggaggagctgtgctgtgcttcatcccctggatccacagcaagaagcagcgggagatcagcaagaccaccgggaaggagaagatggagaagatgctggagaaccagaacagcctgctgagcagcagcagcggcatgttcaagaaggagagtgacagcatcatctag

SEQ ID NO: 170241 - DNA, 651 bp, Artificial Sequence
  Description of Artificial Sequence: Synthetic coding sequence
atggtgttcaagacagcctgggtgggcagcctgtccatgggcatgatcttcttctgctgccccatcgtgtctgtgttcacagacctgtttggctgcaggaagacagctgtggtgggcgctgctgtgggctttgtgggcctgatgagcagcagctttgtgagcagcattgagcccctgtacctgacctacggcatcatctttgcctgtggctgcagctttgcctaccagcccagcctggtgatcctgggccactacttcaagaagaggctgggcctggtgaatggcatcgtgacagctggcagcagcgtcttcaccatcctgctgcccctgctgctgcgggtgctgattgacagcgtgggcctcttctacaccctgcgggtgctgtgcatcttcatgtttgtgctcttcctggccggcttcacctaccggcccctggccaccagcaccaaggacaaggagagcggcggcagcggcagcagcctcttcagcaggaagaagttcagcccccccaagaagatcttcaactttgccatcttcaaggtgacagcctatgctgtgtgggccgtgggcatccccctggccctgtttggctactttgtgccctacgtgcacctggccaagttctcctttgtgatcctgaagtatgaatag

SEQ ID NO: 170242 - DNA, 636 bp, Artificial Sequence
  Description of Artificial Sequence: Synthetic coding sequence
tgatgggtgggcagcctgtccatgggcatgatcttcttctgctgccccatcgtgtctgtgttcacagacctgtttggctgcaggaagacagctgtggtgggcgctgctgtgggctttgtgggcctgatgagcagcagctttgtgagcagcattgagcccctgtacctgacctacggcatcatctttgcctgtggctgcagctttgcctaccagcccagcctggtgatcctgggccactacttcaagaagaggctgggcctggtgaatggaattgtgacagctggcagctctgtgttcaccatcctgctgcccctgctgctgcgggtgctgattgattctgtgggcctcttctacaccctgcgggtgctgtgcatcttcatgtttgtgctcttcctggccggcttcacctaccggcccctggccaccagcaccaaggacaaggagagcggcggcagcggcagcagcctcttcagcaggaagaagttcagcccccccaagaagatcttcaactttgccatcttcaaggtgacagcctatgctgtgtgggccgtgggcatccccctggccctgtttggctactttgtgccctacgtgcacctggccaagttctcctttgtgatcctgaagtatgaatag

SEQ ID NO: 170243 - DNA, 621 bp, Artificial Sequence
  Description of Artificial Sequence: Synthetic coding sequence
tgatgggtgggcagcctgtccatgggcatgatcttcttctgctgccccatcgtgtctgtgttcacagacctgtttggctgcaggaagacagctgtggtgggcgctgctgtgggctttgtgggcctgatgagcagcagctttgtgagcagcattgagcccctgtacctgacctacggcatcatctttgcctgtggctgcagctttgcctaccagcccagcctggtgatcctgggccactacttcaagaagaggctgggcctggtgaatggaattgtgacagctggcagctctgtgttcaccatcctgctgcccctgctgctgcgggtgctgattgattctgtgggcctcttctacaccctgcgggtgctgtgcatcttcatgtttgtgctcttcctggccggcttcacctaccggcccctggccaccagcaccaaggacaaggagagcggcggcagcggcagcagcctcttcagcaggaagaagttcagcccccccaagaagatcttcaactttgccatcttcaaggtgacagcctatgctgtgtgggccgtgggcatccccctggccctgtttggctactttgtgccctacgtgcacctggtgtccatgctgctgcactag

SEQ ID NO: 170244 - DNA, 981 bp, Artificial Sequence
  Description of Artificial Sequence: Synthetic coding sequence
atggtgctgagccaggaggagccagacagcgcccggggcaccagcgaggcccagcccctgggccctgcccccactggagctgcccctcctcctggccctggccccagcgacagccctgaggccgctgtggagaaggtggaggtggagctggccggccctgccacagctgagccccatgagcccccagagcccccagagggcggctggggctggctggtgatgctggccgccatgtggtgcaatggatctgtgtttggcatccagaatgcctgtggggtgctgtttgtgtccatgctggagaccttcggcagcaaggatgatgacaagatggtgttcaagacagcctgggtgggcagcctgtccatgggcatgatcttcttctgctgccccatcgtgtctgtgttcacagacctgtttggctgcaggaagacagctgtggtgggcgctgctgtgggctttgtgggcctgatgagcagcagctttgtgagcagcattgagcccctgtacctgacctacggcatcatctttgcctgtggctgcagctttgcctaccagcccagcctggtgatcctgggccactacttcaagaagaggctgggcctggtgaatggaattgtgacagctggcagctctgtgttcaccatcctgctgcccctgctgctgcgggtgctgattgattctgtgggcctcttctacaccctgcgggtgctgtgcatcttcatgtttgtgctcttcctggccggcttcacctaccggcccctggccaccagcaccaaggacaaggagagcggcggcagcggcagcagcctcttcagcaggaagaagttcagcccccccaagaacttccagttctgccacctgcagggcgacagcctgtgcagcgtgggctcctggaacaccacctgcaccttctggatcctgtgtgccctgtgcagcctgggggagtatgcccccagcctcatcatgaacatcaccatctag

SEQ ID NO: 170245 - DNA, 1461 bp, Artificial Sequence
  Description of Artificial Sequence: Synthetic coding sequence
atggccaaggtgaacagagcccggagcaccagccccccagatggcggctggggctggatgattgtggccggctgcttcctggtgaccatctgcaccagggctgtgacccgctgcatcagcatcttctttgtggagttccagacctacttcacccaggactatgcccagacagcctggatccacagcatcgtggactgtgtgaccatgctgtgtgcccccctgggctctgtggtgagcaaccacctgagctgccaggtgggcatcatgctgggcggcctgctggccagcacaggcctcatcctgagcagctttgccaccagcctgaagcacctgtacctgaccctgggcgtgctgaccggcctgggctttgccctgtgctacagccctgccatcgccatggtgggcaagtacttcagcaggaggaaggccctggcctacggcatcgccatgagcggcagcggcatcggcaccttcatcctggcccctgtggtgcagctgctgattgagcagttctcctggaggggggccctgctgatcctgggcggctttgtgctgaacctgtgtgtgtgtggggccctgatgaggcccatcaccctgaaggaggaccacaccaccccagagcagaaccacgtgtgcaggacccagaaggaggacatcaagagggtgagcccctacagcagcctgaccaaggagtgggcccagacctgcctgtgctgctgcctgcagcaggagtacagcttcctgctgatgtctgactttgtggtgctggccgtgtctgtgctcttcatggcctacggctgcagccccctgtttgtgtacctggtgccctatgccctgtctgtgggcgtgagccaccagcaggccgccttcctgatgagcatcctgggcgtcatcgacatcatcggcaacatcaccttcggctggctgacagaccggcgctgcctgaagaactaccagtatgtgtgctacctgtttgctgtgggcatggatggcctgtgctacctgtgcctgcccatgctgcagagcctgcccctgctggtgcccttcagctgcaccttcggctactttgatggagcctacgtgaccctcatccctgtggtgaccacagaaattgtgggcaccaccagcctgagcagcgccctgggcgtggtgtacttcctgcatgctgtgccctacctggtgagcccccccatcgccggccgcctggtggacaccaccggcagctacacagctgccttcctgctgtgtggcttctccatgatcttcagctctgtgctgctgggctttgcccggctcatcaagaggatgaggaagacccagctgcagttcatcgccaaggagagtgaccccaagctgcagctgtggaccaatggatctgtggcctacagcgtggcccgggagctggaccagaagcacggggagcctgtggccacagctgtgcccggctacagcctgacctag

SEQ ID NO: 170246 - DNA, 1551 bp, Artificial Sequence
  Description of Artificial Sequence: Synthetic coding sequence
atgcccagcggcagccactggacagccaacagcagcaagatcatcacctggctgctggagcagcccgggaaggaggagaagaggaagaccatggccaaggtgaacagagcccggagcaccagccccccagatggcggctggggctggatgattgtggccggctgcttcctggtgaccatctgcaccagggctgtgacccgctgcatcagcatcttctttgtggagttccagacctacttcacccaggactatgcccagacagcctggatccacagcatcgtggactgtgtgaccatgctgtgtgcccccctgggctctgtggtgagcaaccacctgagctgccaggtgggcatcatgctgggcggcctgctggccagcacaggcctcatcctgagcagctttgccaccagcctgaagcacctgtacctgaccctgggcgtgctgaccggcctgggctttgccctgtgctacagccctgccatcgccatggtgggcaagtacttcagcaggaggaaggccctggcctacggcatcgccatgagcggcagcggcatcggcaccttcatcctggcccctgtggtgcagctgctgattgagcagttctcctggaggggggccctgctgatcctgggcggctttgtgctgaacctgtgtgtgtgtggggccctgatgaggcccatcaccctgaaggaggaccacaccaccccagagcagaaccacgtgtgcaggacccagaaggaggacatcaagagggtgagcccctacagcagcctgaccaaggagtgggcccagacctgcctgtgctgctgcctgcagcaggagtacagcttcctgctgatgtctgactttgtggtgctggccgtgtctgtgctcttcatggcctacggctgcagccccctgtttgtgtacctggtgccctatgccctgtctgtgggcgtgagccaccagcaggccgccttcctgatgagcatcctgggcgtcatcgacatcatcggcaacatcaccttcggctggctgacagaccggcgctgcctgaagaactaccagtatgtgtgctacctgtttgctgtgggcatggatggcctgtgctacctgtgcctgcccatgctgcagagcctgcccctgctggtgcccttcagctgcaccttcggctactttgatggagcctacgtgaccctcatccctgtggtgaccacagaaattgtgggcaccaccagcctgagcagcgccctgggcgtggtgtacttcctgcatgctgtgccctacctggtgagcccccccatcgccggccgcctggtggacaccaccggcagctacacagctgccttcctgctgtgtggcttctccatgatcttcagctctgtgctgctgggctttgcccggctcatcaagaggatgaggaagacccagctgcagttcatcgccaaggagagtgaccccaagctgcagctgtggaccaatggatctgtggcctacagcgtggcccgggagctggaccagaagcacggggagcctgtggccacagctgtgcccggctacagcctgacctag

SEQ ID NO: 170247 - DNA, 78 bp, Artificial Sequence
  Description of Artificial Sequence: Synthetic coding sequence
atgcccagcggcagccactggacagccaacagcagcaagatcatcacctggctgctggagcagcccgggaaggagtag

SEQ ID NO: 170248 - DNA, 453 bp, Artificial Sequence
  Description of Artificial Sequence: Synthetic coding sequence
atgaggcccatcaccctgaaggaggaccacaccaccccagagcagaaccacgtgtgcaggacccagaaggaggacatcaagagggtgagcccctacagcagcctgaccaaggagtgggcccagacctgcctgtgctgctgcctgcagcaggagtacagcttcctgctgatgtctgactttgtggtgctggccgtgtctgtgctcttcatggcctacggctgcagccccctgtttgtgtacctggtgccctatgccctgtctgtgggcgtgagccaccagcaggccgccttcctgatgagcatcctgggcgtgattgacatcatcggcaacatcaccttcggctggctgacagaccggcgcttctgcatcaagaccttcggcatcttcaggaagtctgtgaggaagatgtacatcctgcggagcaccatcctgcacttctacacagagttctag

SEQ ID NO: 170249 - DNA, 1842 bp, Artificial Sequence
  Description of Artificial Sequence: Synthetic coding sequence
atgggccggggcggcggcggcctggatgtgggcggcggcggggagggcagccgggaccggctgagcagagatggcctggcctcctggggcgctgagcccggcggcggcggcagcggcagcggcagcagcagcccccccagcagcagcagctgcagcagcaggaacaagtaccagccccagagcggcagcagcggccccagcagccacagccccccagctgccatggccctgcagagccaggccagcgaggaggccaagggcccctggcaggaggccgaccaggagcagcaggagcctgtgggcagccctgagcctgagagcgagcctgagcctgagcctgagcctgagcctgtgcctgtgcccccacctgagccccagcctgagccccagcccctgcctgaccctgcccccctgcctgagctggagtttgaaagtgagcgggtgcatgagcctgagcccacccccaccgtggagacccggggcacagcccggggcttccagcccccagagggcggcttcggctgggtggtggtgtttgctgccacctggtgcaatggcagcatcttcggcatccacaacagcgtgggcatcctgtacagcatgctgctggaggaggagaaggagaagaaccggcaggtggagttccaggccgcctgggtgggcgccctggccatgggcatgatcttcttctgcagccccatcgtgtccatcttcacagaccggctgggctgccgcatcacagccacagctggagctgctgtggccttcatcggcctgcacaccagcagcttcaccagcagcctgagcctgcgctacttcacctacggcatcctgtttggctgcggctgcagctttgccttccagcccagcctggtgatcctgggccactacttccagaggcggctgggcctggccaacggggtggtgtctgctggcagcagcatcttctccatgtccttccccttcctgatccgcatgctgggggacaagatcaagctggcccagaccttccaggtgctgagcaccttcatgtttgtgctgatgctgctgagcctgacctaccggcccctgctgcccagcagccaggacacccccagcaagaggggcgtgaggaccctgcaccagcgcttcctggcccagctgaggaagtacttcaacatgagggtcttccggcagaggacctaccgcatctgggccttcggcattgctgctgctgccctgggctactttgtgccctacgtgcacctgatgaagtatgtggaggaggagttcagcgagatcaaggagacctgggtgctgctggtgtgcattggagccaccagcggcctgggccgcctggtgtctggccacatcagtgacagcatccctggcctgaagaagatctacctgcaggtgctgtccttcctgctgctgggcctgatgtccatgatgatccccctgtgccgggactttggaggcctcatcgtggtgtgcctcttcctgggcctgtgtgatggcttcttcatcaccatcatggcccccatcgcctttgagctggtgggccccatgcaggccagccaggccatcggctacctgctgggcatgatggccctgcccatgattgctggcccccccatcgccggcctgctgaggaactgctttggagactaccacgtggccttctactttgctggggtgccccccatcattggagctgtgatcctcttctttgtgcccctgatgcaccagaggatgttcaagaaggagcagagggacagcagcaaggacaagatgctggccccagaccctgaccccaatggagagctgctgcccggcagccccaaccctgaggagcccatctag

SEQ ID NO: 170250 - DNA, 1437 bp, Artificial Sequence
  Description of Artificial Sequence: Synthetic coding sequence
atgccacccatgcccagcgcccctcctgtgcaccccccaccagatggcggctggggctggatcgtggtgggcgccgccttcatcagcatcggcttctcctatgccttccccaaggctgtgacagtgttcttcaaggagatccagcagatcttccacaccacctacagcgagatcgcctggatcagcagcatcatgctggccgtgatgtatgccggcggccctgtgtcctctgtgctggtgaacaagtatggcagcaggcctgtggtgattgctgggggcctgctgtgctgcctgggcatggtgctggccagcttcagcagctctgtggtgcagctgtacctgaccatgggcttcatcaccggcctgggcctggccttcaacctgcagcctgccctgaccatcatcggcaagtacttctacaggaagaggcccatggccaacggcctggccatggccggcagccctgtgttcctgagcagcctggcccccttcaaccagtacctgttcaacaccttcggctggaagggcagcttcctgatcctgggcagcctgctgctgaatgcctgtgtggccggcagcctgatgaggcccctgggccccaaccagaccaccagcaagagcaagaacaagacaggcaagacagaagatgacagcagccccaagaagatcaagaccaagaagagcacctgggagaaggtgaacaagtacctggacttcagcctcttcaagcaccggggcttcctgatctacctgtctggaaatgtcatcatgttcctgggcttctttgcccccatcatcttcctggccccctatgccaaggaccagggcattgatgagtacagcgctgccttcctgctgtctgtgatggcctttgtggacatgtttgcccggcccagcgtgggcctgattgccaacagcaagtacatccggccccgcatccagtacttcttctcctttgccatcatgttcaacggggtgtgccacctgctgtgccccctggcccaggactacaccagcctggtgctgtatgctgtgttcttcggcctgggctttggatctgtgtcctctgtgctgtttgagaccctgatggacctggtgggcgccccccgcttcagcagcgctgtgggcctggtgaccatcgtggagtgtggccctgtgctgctgggcccccccctggccggcaagctggtggacctgaccggggagtacaagtacatgtacatgagctgtggggccatcgtggtggccgcctctgtgtggctgctgattggaaatgccatcaactaccgcctgctggccaaggagaggaaggaggagaatgcccggcagaagacccgggagagcgagcccctgagcaagagcaagcacagtgaagatgtgaatgtgaaggtgtccaatgcccagagcgtgaccagcgagcgggagaccaacatctag

SEQ ID NO: 170251 - DNA, 1140 bp, Artificial Sequence
  Description of Artificial Sequence: Synthetic coding sequence
atggtgctggccagcttcagcagctctgtggtgcagctgtacctgaccatgggcttcatcaccggcctgggcctggccttcaacctgcagcctgccctgaccatcatcggcaagtacttctacaggaagaggcccatggccaacggcctggccatggccggcagccctgtgttcctgagcagcctggcccccttcaaccagtacctgttcaacaccttcggctggaagggcagcttcctgatcctgggcagcctgctgctgaatgcctgtgtggccggcagcctgatgaggcccctgggccccaaccagaccaccagcaagagcaagaacaagacaggcaagacagaagatgacagcagccccaagaagatcaagaccaagaagagcacctgggagaaggtgaacaagtacctggacttcagcctcttcaagcaccggggcttcctgatctacctgtctggaaatgtcatcatgttcctgggcttctttgcccccatcatcttcctggccccctatgccaaggaccagggcattgatgagtacagcgctgccttcctgctgtctgtgatggcctttgtggacatgtttgcccggcccagcgtgggcctcatcgccaacagcaagtacatccggccccgcatccagtacttcttctcctttgccatcatgtttaatggagtgtgccacctgctgtgccccctggcccaggactacaccagcctggtgctgtatgctgtgttcttcggcctgggcttcggctctgtgtcctctgtgctgtttgagaccctgatggacctggtgggcgccccccgcttcagcagcgctgtgggcctggtgaccatcgtggagtgtggccctgtgctgctgggcccccccctggccggcaagctggtggacctgactggagagtacaagtacatgtacatgagctgtggggccatcgtggtggccgcctctgtgtggctgctgattggaaatgccatcaactaccgcctgctggccaaggagaggaaggaggagaatgcccggcagaagacccgggagagcgagcccctgagcaagagcaagcacagtgaagatgtgaatgtgaaggtgtccaatgcccagagcgtgaccagcgagcgggagaccaacatctag

SEQ ID NO: 170252 - DNA, 1437 bp, Artificial Sequence; identical to SEQ ID NO: 170250
  Description of Artificial Sequence: Synthetic coding sequence

SEQ ID NO: 170253 - DNA, 1437 bp, Artificial Sequence; identical to SEQ ID NO: 170250
  Description of Artificial Sequence: Synthetic coding sequence

SEQ ID NO: 170254 - DNA, 1437 bp, Artificial Sequence; identical to SEQ ID NO: 170250
  Description of Artificial Sequence: Synthetic coding sequence

SEQ ID NO: 170255 - DNA, 1530 bp, Artificial Sequence
  Description of Artificial Sequence: Synthetic coding sequence
atggagctgaagaagagcccagatggcggctggggctgggtgattgtgtttgtgtccttcctgacccagttcctgtgctacggcagccccctggccgtgggcgtgctgtacatcgagtggctggatgccttcggggagggcaagggcaagacagcctgggtgggcagcctggccagcggcgtgggcctgctggccagccctgtgtgcagcctgtgtgtgtcctcctttggagcccggcctgtgaccatcttcagcggcttcatggtggccggcggcctgatgctgagcagctttgcccccaacatctacttcctgttcttctcctatggaattgtggtgggcctgggctgcggcctgctgtacacagccaccgtgaccatcacctgccagtactttgatgacagaagaggcctggccctgggcctcatcagcacaggcagctctgtgggcctcttcatctatgctgccctgcagaggatgctggtggagttctacggcctggatggctgcctgctgattgtgggcgccctggccctgaacatcctggcctgtggcagcctgatgaggcccctgcagagcagtgactgccccctgcccaagaagatcgcccctgaggacctgcctgacaagtacagcatctacaatgagaagggcaagaacctggaggagaacatcaacatcctggacaagagctacagcagcgaggagaagtgccgcatcaccctggccaacggggactggaagcaggacagcctgctgcacaagaaccccaccgtgacccacaccaaggagcctgagacctacaagaagaaggtggccgagcagacctacttctgcaagcagctggccaagaggaagtggcagctgtacaagaactactgtggggagaccgtggccctcttcaagaacaaggtgttttctgccctcttcatcgccatcctgctgtttgacatcggcggcttcccccccagcctgctgatggaggatgtggcccggagcagcaatgtgaaggaggaggagttcatcatgcccctcatcagcatcatcggcatcatgacagctgtgggcaagctgctgctgggcatcctggccgacttcaagtggatcaacaccctgtacctgtatgtggccaccctcatcatcatgggcctggccctgtgtgccatcccctttgccaagagctatgtgaccctggccctgctgagcggcatcctgggcttcctgactggaaactggagcatcttcccctacgtgaccaccaagacagtgggcatcgagaagctggcccacgcctacggcatcctgatgttctttgctggcctgggcaacagcctgggcccccccatcgtgggctggttctatgactggacccagacctatgacatcgccttctacttcagcggcttctgtgtgctgctgggcggcttcatcctgctgctggccgccctgcccagctgggacacctgcaacaagcagctgcccaagccagcccccaccaccttcctgtacaaggtggccagcaatgtgtag

SEQ ID NO: 170256 - DNA, 1530 bp, Artificial Sequence; identical to SEQ ID NO: 170255
  Description of Artificial Sequence: Synthetic coding sequence

SEQ ID NO: 170257 - DNA, 198 bp, Artificial Sequence
  Description of Artificial Sequence: Synthetic coding sequence
atggagctgaagaagagcccagatggcggctggggctgggtgattgtgtttgtgtccttcctgacccagttcctgtgctacggcagccccctggccgtgggcgtgctgtacatcgagtggctggatgccttcggggagggcaagggcaagacagcctgggtgggcagcctggccagcggcgtgggcctgctggcctag

SEQ ID NO: 170258 - DNA, 1488 bp, Artificial Sequence
  Description of Artificial Sequence: Synthetic coding sequence
atgaggagccctgtgcgggacctggccagaaatgatggagaggagagcacagacaggacccccctgctgcccggggcccccagggctgaggccgcccctgtgtgctgcagcgcccgctacaacctggccatcctggccttcttcggcttcttcatcgtgtatgccctgcgggtgaacctgtctgtggccctggtggacatggtggacagcaacaccaccctggaggacaacagaaccagcaaggcctgcccagagcacagcgcccccatcaaggtgcaccacaaccagacaggcaagaagtaccagtgggatgctgagacccagggctggatcctgggcagcttcttctacggctacatcatcacccagatccctgggggctacgtggccagcaagattggaggcaagatgctgctgggcttcggcatcctgggcacagctgtgctgaccctcttcacccccatcgctgctgacctgggcgtgggccccctgattgtgctgcgggccctggagggcctgggggagggcgtgaccttccctgccatgcacgccatgtggagctcctgggccccacccctggagaggagcaagctgctgagcatctcctatgctggggcccagctgggcaccgtcatcagcctgcccctgagcggcatcatctgctactacatgaactggacctacgtgttctacttcttcggcaccatcggcatcttctggttcctgctgtggatctggctggtgtctgacaccccccagaagcacaagaggatcagccactatgagaaggagtacatcctgagcagcctgaggaaccagctgagcagccagaagtctgtgccctgggtgcccatcctgaagagcctgcccctgtgggccatcgtggtggcccacttctcctacaactggaccttctacaccctgctgaccctgctgcccacctacatgaaggagatcctgcgcttcaacgtgcaggagaatggcttcctgagcagcctgccctacctgggctcctggctgtgcatgatcctgagcggccaggccgctgacaacctgcgggccaagtggaacttcagcaccctgtgtgtgcggcgcatcttcagcctcatcggcatgattggccctgctgtgttcctggtggccgccggcttcatcggctgtgactacagcctggccgtggccttcctgaccatcagcaccaccctgggcggcttctgcagcagcggcttcagcatcaaccacctggacatcgcccccagctatgccggcatcctgctgggcatcaccaacacctttgccaccatccctggcatggtgggccctgtgattgccaagagcctgaccccagacaacacagtgggggagtggcagaccgtcttctacatcgccgccgccatcaacgtgtttggagccatcttcttcaccctgtttgccaagggggaggtgcagaactgggccctgaatgaccaccacggccaccgccactag

SEQ ID NO: 170259 - DNA, 546 bp, Artificial Sequence
  Description of Artificial Sequence: Synthetic coding sequence
atgaggagccctgtgcgggacctggccagaaatgatggagaggagagcacagacaggacccccctgctgcccggggcccccagggctgaggccgcccctgtgtgctgcagcgcccgctacaacctggccatcctggccttcttcggcttcttcatcgtgtatgccctgcgggtgaacctgtctgtggccctggtggacatggtggacagcaacaccaccctggaggacaacagaaccagcaaggcctgcccagagcacagcgcccccatcaaggtgcaccacaaccagacaggcaagaagtaccagtgggatgctgagacccagggctggatcctgggcagcttcttctacggctacatcatcacccagatccctgggggctacgtggccagcaagattggaggcaagatgctgctgggcttcggcatcctgggcacagctgtgctgaccctcttcacccccatcgctgctgacctgggcgtgggccccctgattgtgctgcgggccctggagggcctgggggaggagcacagcctgggccagtag

SEQ ID NO: 170260 - DNA, 1404 bp, Artificial Sequence
  Description of Artificial Sequence: Synthetic coding sequence
atgcagatggacaaccggctgccccccaagaaggtgcccggcttctgcagcttccgctatggcctgtccttcctggtgcactgctgcaacgtcatcatcacagcccagagggcctgcctgaacctgaccatggtggtgatggtgaacagcacagacccccacggcctgcccaacaccagcaccaagaagctgctggacaacatcaagaaccccatgtacaactggagcccagacatccagggcatcatcctgagcagcaccagctatggagtcatcatcatccaggtgcctgtgggctacttcagcggcatctacagcaccaagaagatgattggatttgccctgtgcctgagctctgtgctgagcctgctgatccccccagctgctggcattggagtggcctgggtggtggtgtgcagagctgtgcagggcgccgcccagggcatcgtggccacagcccagtttgagatctacgtgaagtgggccccacccctggagcggggccgcctgacctccatgagcaccagcggcttcctgctgggccccttcatcgtgctgctggtgactggagtcatctgtgagagcctgggctggcccatggtgttctacatctttggagcctgtggctgtgctgtgtgcctgctgtggtttgtgctcttctatgatgaccccaaggaccacccctgcatcagcatcagcgagaaggagtacatcaccagcagcctggtgcagcaggtgagcagcagccggcagagcctgcccatcaaggccatcctgaagagcctgcctgtgtgggccatcagcacaggcagcttcaccttcttctggagccacaacatcatgaccctgtacacccccatgttcatcaacagcatgctgcacgtgaacatcaaggaaaatggcttcctgagcagcctgccctacctgtttgcctggatctgtggcaacctggccggccagctgagtgacttcttcctgaccaggaacatcctgtctgtgattgctgtgaggaagctgttcaccgctgctggcttcctgctgcctgccatctttggagtgtgcctgccctacctgagcagcaccttctacagcatcgtcatcttcctgatcctggccggggccaccggcagcttctgcctgggcggcgtcttcatcaatggcctggacatcgccccccgctacttcggcttcatcaaggcctgcagcaccctgaccggcatgattggaggcctcatcgccagcaccctgaccggcctcatcctgaagcaggaccctgagagcgcctggttcaagaccttcatcctgatggccgccatcaacgtgacaggcctcatcttctacctgattgtggccacagctgagatccaggactgggccaaggagaagcagcacacccggctgtag

SEQ ID NO: 170261 - DNA, 630 bp, Artificial Sequence
  Description of Artificial Sequence: Synthetic coding sequence
atgcagatggacaaccggctgccccccaagaaggtgcccggcttctgcagcttccgctatggcctgtccttcctggtgcactgctgcaacgtcatcatcacagcccagagggcctgcctgaacctgaccatggtggtgatggtgaacagcacagacccccacggcctgcccaacaccagcaccaagaagctgctggacaacatcaagaaccccatgtacaactggagcccagacatccagggcatcatcctgagcagcaccagctatggagtcatcatcatccaggtgcctgtgggctacttcagcggcatctacagcaccaagaagatgattggatttgccctgtgcctgagctctgtgctgagcctgctgatccccccagctgctggcattggagtggcctgggtggtggtgtgcagagctgtgcagggcgccgcccagggcatcgtggccacagcccagtttgagatctacgtgaagtgggccccacccctggagcggggccgcctgacctccatgagcaccagcggcttcctgctgggccccttcatcgtgctgctggtgactggagtcatctgtgagagcctgggctggcccatggtgttctacatcttcggccagttcaagtag

SEQ ID NO: 170262 - DNA, 1242 bp, Artificial Sequence
  Description of Artificial Sequence: Synthetic coding sequence
atgcagatggacaaccggctgccccccaagaaggtgcccggcttctgcagcttccgctatggcctgtccttcctggtgcactgctgcaacgtcatcatcacagcccagagggcctgcctgaacctgaccatggtggtgatggtgaacagcacagacccccacggcctgcccaacaccagcaccaagaagctgctggacaacatcaagaaccccatgtacaactggagcccagacatccagggcatcatcctgagcagcaccagctatggagtcatcatcatccaggtgcctgtgggctacttcagcggcatctacagcaccaagaagatgattggatttgccctgtgcctgagctctgtgctgagcctgctgatccccccagctgctggcattggagtggcctgggtggtggtgtgcagagctgtgcagggcgccgcccagggcatcgtggccacagcccagtttgagatctacgtgaagtgggccccacccctggagcggggccgcctgacctccatgagcaccagcggcttcctgctgggccccttcatcgtgctgctggtgactggagtcatctgtgagagcctgggctggcccatggtgttctacatctttggagcctgtggctgtgctgtgtgcctgctgtggtttgtgctcttctatgatgaccccaaggaccacccctgcatcagcatcagcgagaaggagtacatcaccagcagcctggtgcagcagaatggcttcctgagcagcctgccctacctgtttgcctggatctgtggcaacctggccggccagctgagtgacttcttcctgaccaggaacatcctgtctgtgattgctgtgaggaagctgttcaccgctgctggcttcctgctgcctgccatctttggagtgtgcctgccctacctgagcagcaccttctacagcatcgtcatcttcctgatcctggccggggccaccggcagcttctgcctgggcggcgtcttcatcaatggcctggacatcgccccccgctacttcggcttcatcaaggcctgcagcaccctgaccggcatgattggaggcctcatcgccagcaccctgaccggcctcatcctgaagcaggaccctgagagcgcctggttcaagaccttcatcctgatggccgccatcaacgtgacaggcctcatcttctacctgattgtggccacagctgagatccaggactgggccaaggagaagcagcacacccggctgtag

SEQ ID NO: 170263 - DNA, 1242 bp, Artificial Sequence; identical to SEQ ID NO: 170262
  Description of Artificial Sequence: Synthetic coding sequence

SEQ ID NO: 170264 - DNA, 1404 bp, Artificial Sequence; identical to SEQ ID NO: 170260
  Description of Artificial Sequence: Synthetic coding sequence

SEQ ID NO: 170265 - DNA, 1320 bp, Artificial Sequence
  Description of Artificial Sequence: Synthetic coding sequence
atggatggcaagccagccaccaggaaaggaccagacttctgcagcctgcgctatggcctggccctgatcatgcacttcagcaacttcaccatgatcacccagagggtgtccctgagcatcgccatcatcgccatggtgaacaccacccagcagcagggcctgagcaatgccagcacagagggccctgtggctgatgccttcaacaacagcagcatcagcatcaaggagtttgacaccaaggcctctgtgtaccagtggagccctgagacccagggcatcatcttcagcagcatcaactacggcatcatcctgaccctcatccccagcggctacctggccggcatctttggagccaagaagatgctgggcgccggcctgctgatcagcagcctgctgaccctcttcacccccctggccgctgactttggagtcatcctggtgatcatggtgaggacagtgcagggcatggcccagggcatggcctggacaggccagttcaccatctgggccaagtgggccccacccctggagaggagcaagctgaccaccatcgccggcagcggcagcgccttcggcagcttcatcatcctgtgtgtgggcggcctcatcagccaggccctgtcctggcccttcatcttctacatcttcggcagcacaggctgtgtgtgctgcctgctgtggttcaccgtcatctatgatgaccccatgcaccacccctgcatctctgtgcgggagaaggagcacatcctgagcagcctggcccagcagcccagcagccctggccgggctgtgcccatcaaggccatggtgacctgcctgcccctgtgggccatcttcctgggcttcttcagccacttctggctgtgcaccatcatcctgacctacctgcccacctacatcagcaccctgctgcacgtgaacatccgggacagcggcgtgctgagcagcctgcccttcatcgccgccgccagctgcaccatcctgggcggccagctggccgacttcctgctgagcaggaacctgctgcggctcatcaccgtgaggaagctgttcagcagcctgggcctgctgctgcccagcatctgtgctgtggccctgccctttgtggccagcagctatgtgatcaccatcatcctgctgatcctgatccctggcaccagcaacctgtgtgacagcggcttcatcatcaacaccctggacatcgcccccaggtatgccagcttcctgatgggcatcagccggggcttcggcctgattgctggcatcatcagcagcacagccaccggcttcctgatcagccaggtgggccctgtgtactag

SEQ ID NO: 170266 - DNA, 1311 bp, Artificial Sequence
  Description of Artificial Sequence: Synthetic coding sequence
atggatggcaagccagccaccaggaaaggaccagacttctgcagcctgcgctatggcctggccctgatcatgcacttcagcaacttcaccatgatcacccagagggtgtccctgagcatcgccatcatcgccatggtgaacaccacccagcagcagggcctgagcaatgccagcacagagggccctgtggctgatgccttcaacaacagcagcatcagcatcaaggagtttgacaccaaggcctctgtgtaccagtggagccctgagacccagggcatcatcttcagcagcatcaactacggcatcatcctgaccctcatccccagcggctacctggccggcatctttggagccaagaagatgctgggcgccggcctgctgatcagcagcctgctgaccctcttcacccccctggccgctgactttggagtcatcctggtgatcatggtgaggacagtgcagggcatggcccagggcatggcctggacaggccagttcaccatctgggccaagtgggccccacccctggagaggagcaagctgaccaccatcgccggcagcggcagcgccttcggcagcttcatcatcctgtgtgtgggcggcctcatcagccaggccctgtcctggcccttcatcttctacatcttcggcagcacaggctgtgtgtgctgcctgctgtggttcaccgtcatctatgatgaccccatgcaccacccctgcatctctgtgcgggagaaggagcacatcctgagcagcctggcccagcagcccagcagccctggccgggctgtgcccatcaaggccatggtgacctgcctgcccctgtgggccatcttcctgggcttcttcagccacttctggctgtgcaccatcatcctgacctacctgcccacctacatcagcaccctgctgcacgtgaacatccgggacagcggcgtgctgagcagcctgcccttcatcgccgccgccagctgcaccatcctgggcggccagctggccgacttcctgctgagcaggaacctgctgcggctcatcaccgtgaggaagctgttcagcagcctggacatgcaggtgtcctcctgggagagccagggcgacctgggcagcagccaggagagcagcctgcccctgcccctggacagcagctctgtgcgcatcctgagcctggtgggcggcatgtccttcagctgcctgctgcagagcacctgcctggcctggagcttcaccagccggctggacaagcagaacttcaagacaggccccaagaggggccccctgcctgccagcgaggacatcaagctgcagacctag

SEQ ID NO: 170267 - DNA, 1437 bp, Artificial Sequence
  Description of Artificial Sequence: Synthetic coding sequence
atggatggcaagccagccaccaggaaaggaccagacttctgcagcctgcgctatggcctggccctgatcatgcacttcagcaacttcaccatgatcacccagagggtgtccctgagcatcgccatcatcgccatggtgaacaccacccagcagcagggcctgagcaatgccagcacagagggccctgtggctgatgccttcaacaacagcagcatcagcatcaaggagtttgacaccaaggcctctgtgtaccagtggagccctgagacccagggcatcatcttcagcagcatcaactacggcatcatcctgaccctcatccccagcggctacctggccggcatctttggagccaagaagatgctgggcgccggcctgctgatcagcagcctgctgaccctcttcacccccctggccgctgactttggagtcatcctggtgatcatggtgaggacagtgcagggcatggcccagggcatggcctggacaggccagttcaccatctgggccaagtgggccccacccctggagaggagcaagctgaccaccatcgccggcagcggcagcgccttcggcagcttcatcatcctgtgtgtgggcggcctcatcagccaggccctgtcctggcccttcatcttctacatcttcggcagcacaggctgtgtgtgctgcctgctgtggttcaccgtcatctatgatgaccccatgcaccacccctgcatctctgtgcgggagaaggagcacatcctgagcagcctggcccagcagcccagcagccctggccgggctgtgcccatcaaggccatggtgacctgcctgcccctgtgggccatcttcctgggcttcttcagccacttctggctgtgcaccatcatcctgacctacctgcccacctacatcagcaccctgctgcacgtgaacatccgggacagcggcgtgctgagcagcctgcccttcatcgccgccgccagctgcaccatcctgggcggccagctggccgacttcctgctgagcaggaacctgctgcggctcatcaccgtgaggaagctgttcagcagcctgggcctgctgctgcccagcatctgtgctgtggccctgccctttgtggccagcagctatgtgatcaccatcatcctgctgatcctgatccctggcaccagcaacctgtgtgacagcggcttcatcatcaacaccctggacatcgcccccaggtatgccagcttcctgatgggcatcagccggggcttcggcctgattgctggcatcatcagcagcacagccaccggcttcctgatcagccaggactttgagagcggctggagaaatgtgttcttcctgtctgctgctgtgaacatgtttggcctggtgttctacctgaccttcggccaggccgagctgcaggactgggccaaggagaggaccctgacccggctgtag

SEQ ID NO: 170268 - DNA, 1263 bp, Artificial Sequence
  Description of Artificial Sequence: Synthetic coding sequence
atggccaccaagacagagctgagccccacagcccgggagagcaagaatgcccaggacatgcaggtggatgagaccctcatccccaggaaggtgcccagcctgtgcagcgcccgctatggaattgccctggtgctgcacttctgcaacttcaccaccatcgcccagaatgtcatcatgaacatcaccatggtggccatggtgaacagcaccagcccccagagccagctgaatgacagcagcgaggtgctgcctgtggacagctttggaggcctgagcaaggcccccaagagcctgcctgccaagagcagcatcctgggcggccagtttgccatctgggagaagtggggccccccccaggagaggagccggctgtgcagcatcgccctgagcggcatgctgctgggctgcttcaccgccatcctgattggaggcttcatcagcgagaccctgggctggccctttgtgttctacatctttggaggagtgggctgtgtgtgctgcctgctgtggtttgtggtgatctatgatgatcctgtgtcctacccctggatcagcaccagcgagaaggagtacatcatcagcagcctgaagcagcaggtgggcagcagcaagcagcccctgcccatcaaggccatgctgcggagcctgcccatctggagcatctgcctgggctgcttcagccaccagtggctggtgtccaccatggtggtgtacatccccacctacatcagctctgtgtaccacgtgaacatccgggacaatggcctgctgagcgccctgcccttcatcgtggcctgggtgattggcatggtgggcggctacctggccgacttcctgctgaccaagaagttccgcctcatcaccgtgaggaagatcgccaccatcctgggcagcctgcccagcagcgccctgattgtgtccctgccctacctgaacagcggctacatcacagccacagccctgctgaccctgagctgtggcctgagcaccctgtgccagagcggcatctacatcaacgtgctggacatcgccccccgctacagcagcttcctgatgggcgccagccggggcttcagcagcatcgcccctgtgattgtgcccaccgtgtctggcttcctgctgagccaggaccctgagtttggctggagaaatgtgttcttcctgctgtttgctgtgaacctgctgggcctgctcttctacctgatctttggagaggctgatgtgcaggagtgggccaaggagaggaagctgacccggctgtag

SEQ ID NO: 170269 - DNA, 1263 bp, Artificial Sequence; identical to SEQ ID NO: 170268
  Description of Artificial Sequence: Synthetic coding sequence

SEQ ID NO: 170270 - DNA, 1497 bp, Artificial Sequence
  Description of Artificial Sequence: Synthetic coding sequence
atggccaccaagacagagctgagccccacagcccgggagagcaagaatgcccaggacatgcaggtggatgagaccctcatccccaggaaggtgcccagcctgtgcagcgcccgctatggaattgccctggtgctgcacttctgcaacttcaccaccatcgcccagaatgtcatcatgaacatcaccatggtggccatggtgaacagcaccagcccccagagccagctgaatgacagcagcgaggtgctgcctgtggacagctttggaggcctgagcaaggcccccaagagcctgcctgccaaggcccctgtgtatgactggagcccccagatccagggcatcatctttggagctgtgggctatggaggcatcctgaccatggcccccagcggctacctggccggccgggtgggcaccaagagggtggtgggcatcagcctgtttgccaccagcttcctgaccctgtgcatccccctggccacagactttggaattgtgctgctgattgtgaccagaattgtgcagggcctgagccagagcagcatcctgggcggccagtttgccatctgggagaagtggggccccccccaggagaggagccggctgtgcagcatcgccctgagcggcatgctgctgggctgcttcaccgccatcctgattggaggcttcatcagcgagaccctgggctggccctttgtgttctacatctttggaggagtgggctgtgtgtgctgcctgctgtggtttgtggtgatctatgatgatcctgtgtcctacccctggatcagcaccagcgagaaggagtacatcatcagcagcctgaagcagcaggtgggcagcagcaagcagcccctgcccatcaaggccatgctgcggagcctgcccatctggagcatctgcctgggctgcttcagccaccagtggctggtgtccaccatggtggtgtacatccccacctacatcagctctgtgtaccacgtgaacatccgggacaatggcctgctgagcgccctgcccttcatcgtggcctgggtgattggcatggtgggcggctacctggccgacttcctgctgaccaagaagttccgcctcatcaccgtgaggaagatcgccaccatcctgggcagcctgcccagcagcgccctgattgtgtccctgccctacctgaacagcggctacatcacagccacagccctgctgaccctgagctgtggcctgagcaccctgtgccagagcggcatctacatcaacgtgctggacatcgccccccgctacagcagcttcctgatgggcgccagccggggcttcagcagcatcgcccctgtgattgtgcccaccgtgtctggcttcctgctgagccaggaccctgagtttggctggagaaatgtgttcttcctgctgtttgctgtgaacctgctgggcctgctcttctacctgatctttggagaggctgatgtgcaggagtgggccaaggagaggaagctgacccggctgtag

SEQ ID NO: 170271 - DNA, 300 bp, Artificial Sequence
  Description of Artificial Sequence: Synthetic coding sequence
tgaaccctgagctgtggcctgagcaccctgtgccagagcggcatctacatcaacgtgctggacatcgccccccgctacagcagcttcctgatgggcgccagccggggcttcagcagcatcgcccctgtgattgtgcccaccgtgtctggcttcctgctgagccaggaccctgagtttggctggagaaatgtgttcttcctgctgtttgctgtgaacctgctgggcctgctcttctacctgatctttggagaggctgatgtgcaggagtgggccaaggagaggaagctgacccggctgtag

SEQ ID NO: 170272 - DNA, 156 bp, Artificial Sequence
  Description of Artificial Sequence: Synthetic coding sequence
tctggcttcctgctgagccaggaccctgagtttggctggagaaatgtgttcttcctgctgtttgctgtgaacctgctgggcctgctcttctacctgatctttggagaggctgatgtgcaggagtgggccaaggagaggaagctgacccggctgtag

SEQ ID NO: 170273 - DNA, 1494 bp, Artificial Sequence
  Description of Artificial Sequence: Synthetic coding sequence
atgagcactggaccagatgtgaaggccaccgtgggggacatcagcagtgatggcaacctgaatgtggcccaggaggagtgcagcaggaagggcttctgcagcgtgagacatggcctggccctgatcctgcagctgtgcaacttcagcatctacacccagcagatgaacctgagcatcgccatcccagccatggtgaacaacacagccccacccagccagcccaatgccagcacagagcggcccagcacagacagccagggctactggaatgagaccctgaaggagttcaaggccatggccccagcctatgactggagccctgagatccagggcatcatcctgagcagcctgaactacggcagcttcctggcccccatccccagcggctacgtggccggcatctttggagccaagtatgtggtgggcgccggcctcttcatcagcagcttcctgaccctcttcatccccctggccgccaatgccggcgtggccctgctgattgtgctgagaattgtgcagggcatcgcccaggtgatggtgctgaccggccagtacagcatctgggtgaagtgggccccacccctggagaggagccagctgaccaccatcgccggcagcggctccatgctgggcagcttcatcgtgctgctggccggcggcctgctgtgccagaccatcggctggccctacgtgttctacatctttggaggcatcggctgtgcctgctgccccctgtggttccccctcatctatgatgatcctgtgaaccaccccttcatctctgctggggagaagcgctacatcgtgtgcagcctggcccagcaggactgcagccctggctggagcctgcccatccgggccatgatcaagagcctgcccctgtgggccatcctggtgtcctacttctgtgagtactggctgttctacaccatcatggcctacacccccacctacatcagctctgtgctgcaggccaacctgcgggacagcggcatcctgagcgccctgccctttgtggtgggctgcatctgcatcatcctgggcggcctgctggccgacttcctgctgagcaggaagatcctgcggctcatcaccatcaggaagctgttcaccgccatcggcgtgctcttccccagcgtcatcctggtgtccctgccctgggtgcgcagcagccacagcatgaccatgaccttcctggtgctgagcagcgccatcagcagcttctgtgagagcggggccctggtgaacttcctggacatcgccccccgctacacaggcttcctgaagggcctgctgcaggtgtttgcccacatcgccggggccatcagccccacagctgctggcttcttcatcagccaggacagcgagtttggctggagaaatgtgttcctgctgtctgctgctgtgaacatcagcggcctggtgttctacctgatcttcggccgggcagatgtgcaggactgggccaaggagcagaccttcacccacctgtag

SEQ ID NO: 170274 - DNA, 666 bp, Artificial Sequence
  Description of Artificial Sequence: Synthetic coding sequence
atgaacctgagcatcgccatcccagccatggtgaacaacacagccccacccagccagcccaatgccagcacagagcggcccagcacagacagccagggctactggaatgagaccctgaaggagttcaaggccatggactgcagccctggctggagcctgcccatccgggccatgatcaagagcctgcccctgtgggccatcctggtgtcctacttctgtgagtactggctgttctacaccatcatggcctacacccccacctacatcagctctgtgctgcaggccaacctgcgggacagcggcatcctgagcgccctgccctttgtggtgggctgcatctgcatcatcctgggcggcctgctggccgacttcctgctgagcaggaagatcctgcggctcatcaccatcaggaagctgttcaccgccatcggcaaaggagagaccggccacagaggagagcggggcaagctgcgggccgccttcagcctgctgtgtgtgtgcccccccaccccaggagtgctcttccccagcgtcatcctggtgtccctgccctgggtgcgcagcagccacagcatgaccatgaccttcctggtgctgagcagcgccatcagcagcttctgtgagagcggggccctggtgaacttcctggacatcgcccccaggtag

SEQ ID NO: 170275 - DNA, 804 bp, Artificial Sequence
  Description of Artificial Sequence: Synthetic coding sequence
atgagcactggaccagatgtgaaggccaccgtgggggacatcagcagtgatggcaacctgaatgtggcccaggaggagtgcagcaggaagggcttctgcagcgtgagacatggcctggccctgatcctgcagctgtgcaacttcagcatctacacccagcagatgaacctgagcatcgccatcccagccatggtgaacaacacagccccacccagccagcccaatgccagcacagagcggcccagcacagacagccagggctactggaatgagaccctgaaggagttcaaggccatgagcggcatcctgagcgccctgccctttgtggtgggctgcatctgcatcatcctgggcggcctgctggccgacttcctgctgagcaggaagatcctgcggctcatcaccatcaggaagctgttcaccgccatcggcgtgctcttccccagcgtcatcctggtgtccctgccctgggtgcgcagcagccacagcatgaccatgaccttcctggtgctgagcagcgccatcagcagcttctgtgagagcggggccctggtgaacttcctggacatcgccccccgctacacaggcttcctgaagggcctgctgcaggtgtttgcccacatcgccggggccatcagccccacagctgctggcttcttcatcagccaggacagcgagtttggctggagaaatgtgttcctgctgtctgctgctgtgaacatcagcggcctggtgttctacctgatcttcggccgggcagatgtgcaggactgggccaaggagcagaccttcacccacctgtag

SEQ ID NO: 170276 - DNA, 1749 bp, Artificial Sequence
  Description of Artificial Sequence: Synthetic coding sequence
atggagagcgtgaagcagaggatcctggcccctgggaaggagggcctgaagaactttgctgggaagagcctgggccagatctacagagtgctggagaagaagcaggacacaggagagaccatcgagctgacagaagatggcaagcccctggaggtgcctgagaggaaggcccccctgtgtgactgcacctgcttcggcctgccccggcgctacatcatcgccatcatgagcggcctgggcttctgcatcagctttggcatccgctgcaacctgggcgtggccatcgtggacatggtgaacaacagcaccatccacagaggaggcaaggtgatcaaggagaaggccaagttcaactgggaccctgagaccgtgggcatgatccacggcagcttcttctggggctacatcatcacccagatccctgggggctacatcgccagccggctggccgccaacagagtgtttggagctgccatcctgctgaccagcaccctgaacatgctgatccccagcgctgcccgggtgcactacggctgtgtgatctttgtgcgcatcctgcagggcctggtggagggcgtgacctacccagcctgccacggcatctggagcaagtgggccccacccctggagaggagccggctggccaccaccagcttctgtggcagctatgctggggccgtcatcgccatgcccctggccggcatcctggtgcagtacacaggctggagcagcgtcttctacgtgtatggcagctttggcatggtgtggtacatgttctggctgctggtgtcctatgagagccctgccaagcaccccaccatcacagatgaggagcggcgctacatcgaggagagcatcggggagagcgccaacctgctgggcgccatggagaagttcaagaccccctggaggaagttcttcacctccatgcctgtgtatgccatcatcgtggccaacttctgccgctcctggaccttctacctgctgctgatcagccagcctgcctactttgaggaggtgtttggatttgagatcagcaaggtgggcatgctgtctgctgtgccccacctggtgatgaccatcatcgtgcccatcggcggccagattgctgacttcctgcggagcaagcagatcctgagcaccaccaccgtgaggaagatcatgaactgtggcggcttcggcatggaggccaccctgctgctggtggtgggctacagccacacccggggcgtggccatctccttcctggtgctggccgtgggcttcagcggctttgccatcagcggcttcaacgtgaaccacctggacatcgcccccaggtatgccagcatcctgatgggcatcagcaatggagtgggcaccctgagcggcatggtgtgccccatcatcgtgggcgccatgaccaagaacaagagccgggaggagtggcagtatgtgttcctgattgctgccctggtgcactacggcggcgtcatcttctacgccatctttgccagcggggagaagcagccctgggccgaccctgaggagaccagcgaggagaagtgtggcttcatccatgaagatgagctggatgaggagaccggggacatcacccagaactacatcaactacggcaccaccaagagctatggagccaccacccaggccaatggaggctggcccagcggctgggagaagaaggaggagtttgtgcagggcgaggtgcaggacagccacagctacaaggacagagtggactacagctag

SEQ ID NO: 170277 - DNA, 1413 bp, Artificial Sequence
  Description of Artificial Sequence: Synthetic coding sequence
atgaaggccaagttcaactgggaccctgagaccgtgggcatgatccacggcagcttcttctggggctacatcatcacccagatccctgggggctacatcgccagccggctggccgccaacagagtgtttggagctgccatcctgctgaccagcaccctgaacatgctgatccccagcgctgcccgggtgcactacggctgtgtgatctttgtgcgcatcctgcagggcctggtggagggcgtgacctacccagcctgccacggcatctggagcaagtgggccccacccctggagaggagccggctggccaccaccagcttctgtggcagctatgctggggccgtcatcgccatgcccctggccggcatcctggtgcagtacacaggctggagcagcgtcttctacgtgtatggcagctttggcatggtgtggtacatgttctggctgctggtgtcctatgagagccctgccaagcaccccaccatcacagatgaggagcggcgctacatcgaggagagcatcggggagagcgccaacctgctgggcgccatggagaagttcaagaccccctggaggaagttcttcacctccatgcctgtgtatgccatcatcgtggccaacttctgccgctcctggaccttctacctgctgctgatcagccagcctgcctactttgaggaggtgtttggatttgagatcagcaaggtgggcatgctgtctgctgtgccccacctggtgatgaccatcatcgtgcccatcggcggccagattgctgacttcctgcggagcaagcagatcctgagcaccaccaccgtgaggaagatcatgaactgtggcggcttcggcatggaggccaccctgctgctggtggtgggctacagccacacccggggcgtggccatctccttcctggtgctggccgtgggcttcagcggctttgccatcagcggcttcaacgtgaaccacctggacatcgcccccaggtatgccagcatcctgatgggcatcagcaatggagtgggcaccctgagcggcatggtgtgccccatcatcgtgggcgccatgaccaagaacaagagccgggaggagtggcagtatgtgttcctgattgctgccctggtgcactacggcggcgtcatcttctacgccatctttgccagcggggagaagcagccctgggccgaccctgaggagaccagcgaggagaagtgtggcttcatccatgaagatgagctggatgaggagaccggggacatcacccagaactacatcaactacggcaccaccaagagctatggagccaccacccaggccaatggaggctggcccagcggctgggagaagaaggaggagtttgtgcagggcgaggtgcaggacagccacagctacaaggacagagtggactacagctag

SEQ ID NO: 170278 - DNA, 5223 bp, Artificial Sequence
  Description of Artificial Sequence: Synthetic coding sequence
atgggagagaagctggagctgcggctgaagagccctgtgggcgctgagcctgctgtgtacccctggcccctgcctgtgtatgacaagcaccatgatgctgcccacgagatcatcgagaccatccgctgggtgtgtgaggagatcccagacctgaagctggccatggagaactacgtgctgattgattatgacaccaagagctttgagagcatgcagaggctgtgtgacaagtacaacagagccatcgacagcatccaccagctgtggaagggcaccacccagcccatgaagctgaacacccggcccagcacaggcctgctgcggcacatcctgcagcaggtgtacaaccacagcgtgacagatcctgagaagctgaacaactatgagcccttcagccctgaggtgtatggagagaccagctttgacctggtggcccagatgattgatgagatcaagatgacagatgatgacctgtttgtggacctgggcagcggcgtgggccaggtggtgctgcaggtggccgccgccaccaactgcaagcaccactatggagtggagaaggctgacatcccagccaagtatgcagagaccatggaccgggagttcaggaagtggatgaagtggtacggcaagaagcacgccgagtacaccctggagcggggggacttcctgtctgaggagtggagggagcgcatcgccaacaccagcgtcatctttgtgaacaactttgcctttggacctgaggtggaccaccagctgaaggagagatttgccaacatgaaggagggcggccgcatcgtgagcagcaagccctttgcccccctgaacttccgcatcaacagcaggaacctgagtgacatcggcaccatcatgagggtggtggagctgagccccctgaagggctctgtgtcctggacaggcaagcctgtgtcctactacctgcacaccatcgacaggaccatcctggagaactacttcagcagcctgaagaaccccaagctgcgggaggagcaggaggccgcccggcggcggcagcagcgggagagcaagagcaatgctgccacccccaccaagggccctgagggcaaggtggccggccctgcagatgcccccatggacagcggggctgaggaggagaaggccggggccgccaccgtgaagaagcccagccccagcaaggccaggaagaagaagctgaacaagaagggcaggaagatggccggcaggaagaggggccggcccaagaagatgaacacagccaaccctgagaggaagcccaagaagaaccagacagccctggatgccctgcacgcccagacagtgtcccagacagctgccagcagcccccaggatgcctaccgcagcccccacagccccttctaccagctgccccccagcgtgcagaggcacagccccaaccccctgctggtggcccccaccccaccagccctgcagaagctgctggagagcttcaagatccagtacctgcagttcctggcctacaccaagaccccccagtacaaggccagcctgcaggagctgctgggccaggagaaggagaagaatgcccagctgctgggcgccgcccagcagctgctgagccactgccaggcccagaaggaggagatccggcggctcttccagcagaagctggatgagctgggcgtgaaggccctgacctacaatgacctgatccaggcccagaaggagatcagcgcccacaaccagcagctgcgggagcagagcgagcagctggagcaggacaacagagccctgcggggccagagcctgcagctgctgaaggcccgctgtgaggagctgcagctggactgggccaccctgagcctggagaagctgctgaaggagaagcaggccctgaagagccagatcagcgagaagcagaggcactgcctggagctgcagatcagcatcgtggagctggagaagagccagaggcagcaggagctgctgcagctgaagagctgtgtgcccccagatgatgccctgagcctgcacctgcggggcaagggggccctgggccgggagctggagccagatgccagccggctgcacctggagctggactgcaccaagttcagcctgccccacctgagctccatgagccctgagctgtccatgaatggccaggccgccggctatgagctgtgtggggtgctgagccggcccagcagcaagcagaacaccccccagtacctggccagccccctggaccaggaggtggtgccctgcacccccagccacgtgggccggccccggctggagaagctgagcggcctggccgccccagactacacccggctgagccctgccaagatcgtgctgcggcggcacctgagccaggaccacacagtgcccggccggcctgctgccagcgagctgcacagcagagctgagcacaccaaggaaaatggcctgccctaccagagccccagcgtgcccggctccatgaagctgagcccccaggacccccggcccctgagccctggggccctgcagctggccggggagaagagcagcgagaagggcctgcgggagcgggcctacggcagcagcggggagctgatcaccagcctgcccatcagcatccccctgagcacagtgcagcccaacaagctgcctgtgtccatccccctggcctctgtggtgctgcccagcagagctgagcgggcccggagcacccccagccctgtgctgcagccccgggaccccagcagcaccctggagaagcagatcggggccaatgcccatggagctggcagccgcagcctggccctggccccagctggcttctcctatgccggctctgtggccatcagcggggccctggccggcagccctgccagcctgaccccaggagctgagcccgccaccctggatgagagcagcagcagcggcagcctgtttgccaccgtgggcagccgcagcagcaccccccagcaccccctgctgctggcccagcccaggaacagcctgcctgccagccctgcccaccagctgagcagcagcccccggctgggcggggccgcccagggccccctgcctgaggccagcaaaggagacctgcccagcgacagcggcttcagtgaccctgagagcgaggccaagagaagaattgtgttcaccatcaccactggagctggcagcgccaagcagagccccagcagcaagcacagccccctgacagccagcgcccggggggactgtgtgcccagccacggccaggacagcagaagaagaggccgcaggaagagggccagcgctggcacccccagcctgtctgctggggtgagccccaagagaagagccctgcccagcgtggccggcctcttcacccagcccagcggcagccccctgaacctgaacagcatggtgagcaacatcaaccagcccctggagatcacagccatcagcagccctgagaccagcctgaagagcagccctgtgccctaccaggaccatgaccagccccctgtgctgaagaaggagcggcccctgagccagaccaacggggcccactacagccccctgaccagtgatgaggagcccggctctgaagatgagcccagcagcgcccgcatcgagaggaagatcgccaccatcagcctggagagcaagagcccccccaagaccctggagaatggaggcggcctggccggcaggaagccagccccagctggggagcctgtgaacagcagcaagtggaagagcaccttcagccccatcagtgacatcggcctggccaagtctgctgacagccccctgcaggccagcagcgccctgagccagaacagcctcttcaccttccggcctgccctggaggagcccagcgcagatgccaagctggccgcccaccccaggaagggcttccctggcagcctgtctggagcagatggcctgagccctggcaccaacccagccaacggctgcaccttcggcggcggcctggccgctgacctgagcctgcacagcttcagtgatggagccagcctgccccacaagggccctgaggccgccggcctgagcagccccctgtccttccccagccagaggggcaaggagggcagtgatgccaaccccttcctgagcaagaggcagctggatggcctggccggcctgaagggggagggcagccggggcaaggaggccggggagggcggcctgcccctgtgtggccccacagacaagacccccctgctgagcggcaaggccgccaaggcccgggaccgggaggtggacctgaagaatggccacaacctcttcatctctgctgctgctgtgcccccaggcagcctgctgagcggccctggcctggccccagctgccagcagcgctggaggagctgccagcagcgcccagacccaccgctccttcctgggccccttccccccaggcccccagtttgccctgggccccatgagcctgcaggccaacctgggctctgtggccggcagctctgtgctgcagagcctcttcagctctgtgcctgctgctgctggcctggtgcacgtgagcagcgctgccacccggctgaccaacagccacgccatgggcagcttctctggagtggccggcggcaccgtgggcgctgggggcgtcttcaaccacgctgtgcccagcgccagcgcccacccctttggagcccgggtgggccgcggggccgcctgtggcagcgccaccctgggccccagccccctgcaggccgccgccagcgccagcgccagcagcttccaggccccagcctctgtggagaccaggcctcctcctcctcctcctcctcctcctccacccctgcccccaccagcccacctgggccgcagccctgctggcccccctgtgctgcacgcccctcctcctccaaatgctgccctgcccccaccacccaccctgctggccagcaaccctgagcccgccctgctgcagagcctggccagcctgccccccaaccaggccttcctgccccccaccagcgctgccagcctgcccccagccaatgccagcctgagcatcaagctgaccagcctgccccacaagggggcccggcccagcttcaccgtgcaccaccagcccctgccccggctggccctggcccaggccgcccctggcatcccccaggccagcgccaccggccccagcgctgtgtgggtgtccctgggcatgcccccaccctatgctgcccacctgtctggagtgaagcccaggtag

SEQ ID NO: 170279 - DNA, 1647 bp, Artificial Sequence
  Description of Artificial Sequence: Synthetic coding sequence
atgggcagccagctggccctggccggcctgctggagaagaggcaggagggcgctgagaccctggagctgtctgcagatggccggcctgtgaccacccagacccgggacccccctgtggtggactgcacctgcttcggcctgccccggcgctacatcatcgccatcatgagcggcctgggcttctgcatcagctttggcatccgctgcaacctgggcgtggccatcgtgtccatggtgaacaacagcaccacccacagaggaggccacgtggtggtgcagaaggcccagttctcctgggaccctgagaccgtgggcctcatccacggcagcttcttctggggctacatcgtgacccagatccctgggggcttcatctgccagaagtttgctgccaacagagtgtttggatttgccatcgtggccaccagcaccctgaacatgctgatccccagcgctgcccgggtgcactacggctgtgtgatctttgtgcgcatcctgcagggcctggtggagggcgtgacctacccagcctgccacggcatctggagcaagtgggccccacccctggagaggagccggctggccaccacagccttctgtggcagctatgctggagctgtggtggccatgcccctggccggcgtgctggtgcagtacagcggctggagcagcgtcttctacgtgtatggcagctttggcatcttctggtacctgttctggctgctggtgtcctatgagagccctgccctgcaccccagcatcagcgaggaggagaggaagtacattgaagatgccatcggggagagcgccaagctgatgaaccccctgaccaagttcagcaccccctggaggcgcttcttcacctccatgcctgtgtatgccatcatcgtggccaacttctgccgctcctggaccttctacctgctgctgatcagccagcctgcctactttgaggaggtgtttggatttgagatcagcaaggtgggcctggtgtctgccctgccccacctggtgatgaccatcatcgtgcccatcggcggccagattgctgacttcctgcggagccgccgcatcatgagcaccaccaacgtgaggaagctgatgaactgtggcggcttcggcatggaggccaccctgctgctggtggtgggctacagccacagcaaaggagtggccatctccttcctggtgctggccgtgggcttcagcggctttgccatcagcggcttcaacgtgaaccacctggacatcgcccccaggtatgccagcatcctgatgggcatcagcaatggagtgggcaccctgagcggcatggtgtgccccatcatcgtgggcgccatgaccaagcacaagacccgggaggagtggcagtatgtgttcctgattgccagcctggtgcactacggcggcgtcatcttctacggcgtgtttgccagcggggagaagcagccctgggccgagcctgaggagatgtctgaggagaagtgtggctttgtgggccatgaccagctggccggcagtgatgacagcgagatggaggatgaggccgagcccccaggggcccccccagcccccccacccagctatggagccacccacagcaccttccagccccccaggcctcctcctcctgtgcgggactactag

SEQ ID NO: 170280 - DNA, 1770 bp, Artificial Sequence
  Description of Artificial Sequence: Synthetic coding sequence
atgcccttcaaggcctttgacaccttcaaggagaagatcctgaagccaggcaaggagggcgtgaagaatgctgtgggggacagcctgggcatcctgcagaggaagattgatggcaccacagaggaggaggacaacatcgagctgaatgaggagggccggcctgtgcagaccagccggcccagcccccccctgtgtgactgccactgctgcggcctgcccaagcgctacatcatcgccatcatgagcggcctgggcttctgcatcagctttggcatccgctgcaacctgggcgtggccatcgtggagatggtgaacaacagcacagtgtatgtggatggcaagccagagatccagacagcccagttcaactgggaccctgagaccgtgggcctcatccacggcagcttcttctggggctacatcatgacccagatccctgggggcttcatcagcaacaagtttgctgccaacagagtgtttggagctgccatcttcctgaccagcaccctgaacatgttcatccccagcgctgcccgggtgcactacggctgtgtgatgtgtgtgcgcatcctgcagggcctggtggagggcgtgacctacccagcctgccacggcatgtggagcaagtgggccccacccctggagaggagccggctggccaccaccagcttctgtggcagctatgctggagctgtggtggccatgcccctggccggcgtgctggtgcagtacatcggctggagctctgtgttctacatctacggcatgtttggcatcatctggtacatgttctggctgctgcaggcctatgaatgtcctgctgcccaccccaccatcagcaatgaggagaagacctacatcgagaccagcattggagagggcgccaacgtggtgtccctgagcaagttcagcaccccctggaagcgcttcttcaccagcctgcctgtgtatgccatcatcgtggccaacttctgccgctcctggaccttctacctgctgctgatcagccagcctgcctactttgaggaggtgtttggatttgccatcagcaaggtgggcctgctgtctgctgtgccccacatggtgatgaccatcgtggtgcccatcggcggccagctggccgactacctgcggagccggcagatcctgaccaccacagctgtgaggaagatcatgaactgtggcggcttcggcatggaggccaccctgctgctggtggtgggcttcagccacaccaagggcgtggccatctccttcctggtgctggccgtgggcttcagcggctttgccatcagcggcttcaacgtgaaccacctggacatcgcccccaggtatgccagcatcctgatgggcatcagcaatggagtgggcaccctgagcggcatggtgtgccccctgattgtgggcgccatgaccaggcacaagacccgggaggagtggcagaatgtgttcctgattgctgccctggtgcactacagcggggtcatcttctacggcgtgtttgccagcggggagaagcaggagtgggccgaccctgagaacctgtctgaggagaagtgtggcatcatcgaccaggatgagctggccgaggagattgagctgaaccacgagagctttgccagccccaagaagaagatgtcctatggagccaccagccagaactgtgaggtgcagaagaaggagtggaagggccagagaggagccaccctggatgaggaggagctgaccagctaccagaatgaggagaggaacttcagcaccatctcctag

SEQ ID NO: 170281 - DNA, 1620 bp, Artificial Sequence
  Description of Artificial Sequence: Synthetic coding sequence
atgcccttcaaggcctttgacaccttcaaggagaagatcctgaagccaggcaaggagggcgtgaagaatgctgtgggggacagcctgggcatcctgcagaggaagattgatggcaccacagaggaggaggacaacatcgagctgaatgaggagggccggcctgtgcagaccagccggcccagcccccccctgtgtgactgccactgctgcggcctgcccaagcgctacatcatcgccatcatgagcggcctgggcttctgcatcagctttggcatccgctgcaacctgggcgtggccatcgtggagatggtgaacaacagcacagtgtatgtggatggcaagccagagatccagacagcccagttcaactgggaccctgagaccgtgggcctcatccacggcagcttcttctggggctacatcatgacccagatccctgggggcttcatcagcaacaagtttgctgccaacagagtgtttggagctgccatcttcctgaccagcaccctgaacatgttcatccccagcgctgcccgggtgcactacggctgtgtgatgtgtgtgcgcatcctgcagggcctggtggagggcgtgacctacccagcctgccacggcatgtggagcaagtgggccccacccctggagaggagccggctggccaccaccagcttctgtggcagctatgctggagctgtggtggccatgcccctggccggcgtgctggtgcagtacatcggctggagctctgtgttctacatctacggcatgtttggcatcatctggtacatgttctggctgctgcaggcctatgaatgtcctgctgcccaccccaccatcagcaatgaggagaagacctacatcgagaccagcattggagagggcgccaacgtggtgtccctgtctgtgggcctgctgtctgctgtgccccacatggtgatgaccatcgtggtgcccatcggcggccagctggccgactacctgcggagccggcagatcctgaccaccacagctgtgaggaagatcatgaactgtggcggcttcggcatggaggccaccctgctgctggtggtgggcttcagccacaccaagggcgtggccatctccttcctggtgctggccgtgggcttcagcggctttgccatcagcggcttcaacgtgaaccacctggacatcgcccccaggtatgccagcatcctgatgggcatcagcaatggagtgggcaccctgagcggcatggtgtgccccctgattgtgggcgccatgaccaggcacaagacccgggaggagtggcagaatgtgttcctgattgctgccctggtgcactacagcggggtcatcttctacggcgtgtttgccagcggggagaagcaggagtgggccgaccctgagaacctgtctgaggagaagtgtggcatcatcgaccaggatgagctggccgaggagattgagctgaaccacgagagctttgccagccccaagaagaagatgtcctatggagccaccagccagaactgtgaggtgcagaagaaggagtggaagggccagagaggagccaccctggatgaggaggagctgaccagctaccagaatgaggagaggaacttcagcaccatctcctag

SEQ ID NO: 170282 - DNA, 1293 bp, Artificial Sequence
  Description of Artificial Sequence: Synthetic coding sequence
atgaccctgaccagccggcggcaggacagccaggaggcccggcctgagtgccaggcctggacaggcaccctgctgctgggcacctgcctgctgtactgtgcccggagctccatgcccatctgcaccgtgtccatgagccaggactttggctggaacaagaaggaggccggcatcgtgctgagcagcttcttctggggctactgcctgacccaggtggtgggcggccacctgggggacagaattggaggagagaaggtgatcctgctgagcgccagcgcctggggcagcatcacagctgtgacccccctgctggcccacctgagcagcgcccacctggccttcatgaccttcagccgcatcctgatgggcctgctgcagggcgtgtacttccctgccctgaccagcctgctgagccagaaggtgcgggagagcgagcgggccttcacctacagcatcgtgggcgccggcagccagtttggcaccctgctgaccggggctgtgggcagcctgctgctggagtggtacggctggcagagcatcttctacttcagcggcggcctgaccctgctgtgggtgtggtacgtgtaccgctacctgctgtctgagaaggacctgatcctggccctgggcgtgctggcccagagcaggcctgtgagccgccacaacagagtgccctggaggaggctcttcaggaagccagctgtgtgggccgctgtggtgtcccagctgtctgctgcctgcagcttcttcatcctgctgtcctggctgcccaccttctttgaggagaccttcccagatgccaagggctggatcttcaacgtggtgccctggctggtggccatcccagccagcctcttcagcggcttcctgagtgaccacctgatcaaccagggctaccgggccatcaccgtgaggaagctgatgcagggcatgggcctgggcctgagctctgtgtttgccctgtgcctgggccacaccagcagcttctgtgagagcgtggtgtttgccagcgccagcatcggcctgcagaccttcaaccacagcggcatctctgtgaacatccaggacctggcccccagctgtgccggcttcctgtttggagtggccaacacagctggggccctggccggcgtggtgggcgtgtgcctgggcggctacctgatggagaccaccggctcctggacctgcctcttcaacctggtggccatcatcagcaacctgggcctgtgcaccttcctggtgtttggccaggcccagagggtggacctgagcagcacccatgaggacctgtag

SEQ ID NO: 170283 - DNA, 1311 bp, Artificial Sequence
  Description of Artificial Sequence: Synthetic coding sequence
atgcagcccccaccagatgaggcccggcgggacatggccggggacacccagtggagcaggcctgagtgccaggcctggacaggcaccctgctgctgggcacctgcctgctgtactgtgcccggagctccatgcccatctgcaccgtgtccatgagccaggactttggctggaacaagaaggaggccggcatcgtgctgagcagcttcttctggggctactgcctgacccaggtggtgggcggccacctgggggacagaattggaggagagaaggtgatcctgctgagcgccagcgcctggggcagcatcacagctgtgacccccctgctggcccacctgagcagcgcccacctggccttcatgaccttcagccgcatcctgatgggcctgctgcagggcgtgtacttccctgccctgaccagcctgctgagccagaaggtgcgggagagcgagcgggccttcacctacagcatcgtgggcgccggcagccagtttggcaccctgctgaccggggctgtgggcagcctgctgctggagtggtacggctggcagagcatcttctacttcagcggcggcctgaccctgctgtgggtgtggtacgtgtaccgctacctgctgtctgagaaggacctgatcctggccctgggcgtgctggcccagagcaggcctgtgagccgccacaacagagtgccctggaggaggctcttcaggaagccagctgtgtgggccgctgtggtgtcccagctgtctgctgcctgcagcttcttcatcctgctgtcctggctgcccaccttctttgaggagaccttcccagatgccaagggctggatcttcaacgtggtgccctggctggtggccatcccagccagcctcttcagcggcttcctgagtgaccacctgatcaaccagggctaccgggccatcaccgtgaggaagctgatgcagggcatgggcctgggcctgagctctgtgtttgccctgtgcctgggccacaccagcagcttctgtgagagcgtggtgtttgccagcgccagcatcggcctgcagaccttcaaccacagcggcatctctgtgaacatccaggacctggcccccagctgtgccggcttcctgtttggagtggccaacacagctggggccctggccggcgtggtgggcgtgtgcctgggcggctacctgatggagaccaccggctcctggacctgcctcttcaacctggtggccatcatcagcaacctgggcctgtgcaccttcctggtgtttggccaggcccagagggtggacctgagcagcacccatgaggacctgtag

SEQ ID NO: 170284 - DNA, 459 bp, Artificial Sequence
  Description of Artificial Sequence: Synthetic coding sequence
atgttccccaggcctggggccctgtcctggacagtgagaagacacaccccccggcaggtggagcccccctgtgtgtgcatgaccctgaccagccggcggcaggacagccaggaggcccggcctgagtgccaggcctggacaggcaccctgctgctgggcacctgcctgctgtactgtgcccggagctccatgcccatctgcaccgtgtccatgagccaggactttggctggaacaagaaggaggccggcatcgtgctgagcagcttcttctggggctactgcctgacccaggtggtgggcggccacctgggggacagaattggaggagagaaggtgatcctgctgagcgccagcgcctggggcagcatcacagctgtgacccccctgctggcccacctgagcagcgcccacctggccttcatgaccttcagccgcatcctgatgggcctgctgcagtag

SEQ ID NO: 170285 - DNA, 1599 bp, Artificial Sequence
  Description of Artificial Sequence: Synthetic coding sequence
atggagagcgctgagcctgctggccaggcccgggctgctgccaccaagctgtctgaggccgtgggcgccgccctgcaggagccccggcggcagaggcggctggtgctggtgattgtgtgtgtggccctgctgctggacaacatgctgtacatggtgattgtgcccatcgtgcctgactacatcgcccacatgaggggcggcggggagggccccaccaggaccccagaggtgtgggagcccaccctgcccctgcccaccccagccaatgccagcgcctacacagccaacaccagcgccagccccacagctgcctggccagctggcagcgccctgcggccccgctaccccacagaaagtgaagatgtgaagattggagtgctgtttgccagcaaggccatcctgcagctgctggtgaaccccctgagcggccccttcatcgacaggatgtcctatgatgtgcccctgctgattggcctgggcgtgatgtttgccagcacagtgctgtttgcctttgctgaagattatgccaccctgtttgctgcccggagcctgcagggcctgggcagcgcctttgctgacaccagcggcatcgccatgattgctgacaagtacccagaggagcctgagaggagccgggccctgggcgtggccctggccttcatcagctttggcagcctggtggcccccccatttggaggcatcctgtatgaatttgctgggaagagggtgcccttcctggtgctggccgctgtgtccctgtttgatgccctgctgctgctggccgtggccaagcccttctctgctgctgcccgggcccgggccaacctgcctgtgggcacccccatccaccggctgatgctggacccctacatcgctgtggtggccggggccctgaccacctgcaacatccccctggccttcctggagcccaccatcgccacctggatgaagcacaccatggccgccagcgagtgggagatgggcatggcctggctgcctgcctttgtgccccacgtgctgggcgtgtacctgactgtgcggctggccgcccgctacccccacctgcagtggctgtatggagccctgggcctggccgtgattggagccagcagctgcatcgtgcctgcctgccgcagctttgcccccctggtggtgtccctgtgtggcctgtgcttcggcatcgccctggtggacacagccctgctgcccaccctggccttcctggtggatgtgagacatgtgtctgtgtatggctctgtgtatgccatcgctgacatctcctacagcgtggcctatgccctgggccccatcgtggccggccacatcgtgcacagcctgggctttgagcagctgagcctgggcatgggcctggccaacctgctgtatgcccctgtgctgctgctgctgagaaatgtgggcctgctgaccaggagccgctcagaaagagatgtgctgctggatgagcccccccagggcctgtatgatgctgtgcggctgcgggagaggcctgtgtctggccaggatggagagcccaggagccccccaggcccctttgatgcctgtgaagatgactacaactactactacaccaggagctag

SEQ ID NO: 170286 - DNA, 1482 bp, Artificial Sequence
  Description of Artificial Sequence: Synthetic coding sequence
atgctgcggaccatcctggatgccccccagaggctgctgaaggagggccgggccagccggcagctggtgctggtggtggtgtttgtggccctgctgctggacaacatgctgttcaccgtggtggtgcccatcgtgcccaccttcctgtatgacatggagttcaaggaggtgaacagcagcctgcacctgggccacgccggcagcagcccccacgccctggccagccctgccttcagcaccatcttctccttcttcaacaacaacacagtggccgtggaggagagcgtgcccagcggcatcgcctggatgaatgacacagccagcaccatccccccaccagccacagaggccatcagcgcccacaagaacaactgcctgcagggcaccggcttcctggaggaggagatcaccagggtgggcgtgctgtttgccagcaaggctgtgatgcagctgctggtgaacccctttgtgggccccctgaccaaccgcatcggctaccacatccccatgtttgctggcttcgtcatcatgttcctgagcacagtgatgtttgccttcagcggcacctacaccctgctgtttgtggcccggaccctgcagggcatcggcagcagcttcagctctgtggccggcctgggcatgctggcctctgtgtacacagatgaccacgagcggggccgggccatgggcacagccctgggcggcctggccctgggcctgctggtgggcgcccccttcggctctgtgatgtatgaatttgtgggcaagagcgcccccttcctgatcctggccttcctggccctgctggatggagccctgcagctgtgcatcctgcagcccagcaaggtgtccccagagagcgccaagggcacccccctcttcatgctgctgaaggacccctacatcctggtggccgccggcctggccttcctgcctgcctctgtgtcctacctgattggcaccaacctgtttggagtgctggccaacaagatgggccgctggctgtgcagcctgattggcatgctggtggtgggcaccagcctgctgtgtgtgcccctggcccacaacatcttcggcctgattggccccaatgccggcctgggcctggccatcggcatggtggacagctccatgatgcccatcatgggccacctggtggacctgcggcacacctctgtgtatggctctgtgtatgccatcgcagatgtggccttctgcatgggctttgccatcggccccagcactggaggagccatcgtgaaggccatcggcttcccctggctgatggtgatcaccggggtcatcaacatcgtgtatgcccccctgtgctactacctgcggagccccccagccaaggaggagaagctggccatcctgagccaggactgccccatggagaccaggatgtatgccacccagaagcccaccaaggagttccccctgggagaagattctgatgaggagccagaccacgaggagtag

SEQ ID NO: 170287 - DNA, 1578 bp, Artificial Sequence
  Description of Artificial Sequence: Synthetic coding sequence
atgctgcggaccatcctggatgccccccagaggctgctgaaggagggccgggccagccggcagctggtgctggtggtggtgtttgtggccctgctgctggacaacatgctgttcaccgtggtggtgcccatcgtgcccaccttcctgtatgacatggagttcaaggaggtgaacagcagcctgcacctgggccacgccggcagcagcccccacgccctggccagccctgccttcagcaccatcttctccttcttcaacaacaacacagtggccgtggaggagagcgtgcccagcggcatcgcctggatgaatgacacagccagcaccatccccccaccagccacagaggccatcagcgcccacaagaacaactgcctgcagggcaccggcttcctggaggaggagatcaccagggtgggcgtgctgtttgccagcaaggctgtgatgcagctgctggtgaacccctttgtgggccccctgaccaaccgcatcggctaccacatccccatgtttgctggcttcgtcatcatgttcctgagcacagtgatgtttgccttcagcggcacctacaccctgctgtttgtggcccggaccctgcagggcatcggcagcagcttcagctctgtggccggcctgggcatgctggcctctgtgtacacagatgaccacgagcggggccgggccatgggcacagccctgggcggcctggccctgggcctgctggtgggcgcccccttcggctctgtgatgtatgaatttgtgggcaagagcgcccccttcctgatcctggccttcctggccctgctggatggagccctgcagctgtgcatcctgcagcccagcaaggtgtccccagagagcgccaagggcacccccctcttcatgctgctgaaggacccctacatcctggtggccgccggcagcatctgctttgccaacatgggcgtggccatcctggagcccaccctgcccatctggatgatgcagaccatgtgcagccccaagtggcagctgggcctggccttcctgcctgcctctgtgtcctacctgattggcaccaacctgtttggagtgctggccaacaagatgggccgctggctgtgcagcctgattggcatgctggtggtgggcaccagcctgctgtgtgtgcccctggcccacaacatcttcggcctgattggccccaatgccggcctgggcctggccatcggcatggtggacagctccatgatgcccatcatgggccacctggtggacctgcggcacacctctgtgtatggctctgtgtatgccatcgcagatgtggccttctgcatgggctttgccatcggccccagcactggaggagccatcgtgaaggccatcggcttcccctggctgatggtgatcaccggggtcatcaacatcgtgtatgcccccctgtgctactacctgcggagccccccagccaaggaggagaagctggccatcctgagccaggactgccccatggagaccaggatgtatgccacccagaagcccaccaaggagttccccctgggagaagattctgatgaggagccagaccacgaggagtag

SEQ ID NO: 170288 - DNA, 1419 bp, Artificial Sequence
  Description of Artificial Sequence: Synthetic coding sequence
atgctgcggaccatcctggatgccccccagaggctgctgaaggagggccgggccagccggcagctggtgctggtggtggtgtttgtggccctgctgctggacaacatgctgttcaccgtggtggtgcccatcgtgcccaccttcctgtatgacatggagttcaaggaggtgaacagcagcctgcacctgggccacgccggcagcagcccccacgccctggccagccctgccttcagcaccatcttctccttcttcaacaacaacacagtggccgtggaggagagcgtgcccagcggcatcgcctggatgaatgacacagccagcaccatccccccaccagccacagaggccatcagcgcccacaagaacaactgcctgcagggcaccggcttcctggaggaggagatcaccagggtgggcgtgctgtttgccagcaaggctgtgatgcagctgctggtgaacccctttgtgggccccctgaccaaccgcatcggctaccacatccccatgtttgctggcttcgtcatcatgttcctgagcacagtgatgtttgccttcagcggcacctacaccctgctgtttgtggcccggaccctgcagggcatcggcagcagcttcagctctgtggccggcctgggcatgctggcctctgtgtacacagatgaccacgagcggggccgggccatgggcacagccctgggcggcctggccctgggcctgctggtgggcgcccccttcggctctgtgatgtatgaatttgtgggcaagagcgcccccttcctgatcctggccttcctggccctgctggatggagccctgcagctgtgcatcctgcagcccagcaaggtgtccccagagagcgccaagggcacccccctcttcatgctgctgaaggacccctacatcctggtggccgccggcagcatctgctttgccaacatgggcgtggccatcctggagcccaccctgcccatctggatgatgcagaccatgtgcagccccaagtggcagctgggcctggccttcctgcctgcctctgtgtcctacctgattggcaccaacctgtttggagtgctggccaacaagatgggccgctggctgtgcagcctgattggcatgctggtggtgggcaccagcctgctgtgtgtgcccctggcccacaacatcttcggcctgattggccccaatgccggcctgggcctggccatcggcatggtggacagctccatgatgcccatcatgggccacctggtggacctgcggcacacctctgtgtatggctctgtgtatgccatcgcagatgtggccttctgcatgggctttgccatcggctacagcgagagcggcctgccccacggggaccctgatgtgtgcaaccctgaggcccacgagggcatcagcagcggcggcggccagtag

SEQ ID NO: 170289 - DNA, 1578 bp, Artificial Sequence; identical to SEQ ID NO: 170287
  Description of Artificial Sequence: Synthetic coding sequence

SEQ ID NO: 170290 - DNA, 1158 bp, Artificial Sequence
  Description of Artificial Sequence: Synthetic coding sequence
atgctgcggaccatcctggatgccccccagaggctgctgaaggagggccgggccagccggcagctggtgctggtggtggtgtttgtggccctgctgctggacaacatgctgttcaccgtggtggtgcccatcgtgcccaccttcctgtatgacatggagttcaaggaggtgaacagcagcctgcacctgggccacgccggcagcagcccccacgccctggccagccctgccttcagcaccatcttctccttcttcaacaacaacacagtggccgtggaggagagcgtgcccagcggcatcgcctggatgaatgacacagccagcaccatccccccaccagccacagaggccatcagcgcccacaagaacaactgcctgcagggcaccggcttcctggaggaggagatcaccagggtgggcgtgctgtttgccagcaaggctgtgatgcagctgctggtgaacccctttgtgggccccctgaccaaccgcatcggctaccacatccccatgtttgctggcttcgtcatcatgttcctgagcacagtgatgtttgccttcagcggcacctacaccctgctgtttgtggcccggaccctgcagggcatcggcagcagcttcagctctgtggccggcctgggcatgctggcctctgtgtacacagatgaccacgagcggggccgggccatgggcacagccctgggcggcctggccctgggcctgctggtgggcgcccccttcggctctgtgatgtatgaatttgtgggcaagagcgcccccttcctgatcctggccttcctggccctgctggatggagccctgcagctgtgcatcctgcagcccagcaaggtgtccccagagagcgccaagggcacccccctcttcatgctgctgaaggacccctacatcctggtggccgccggcagcatctgctttgccaacatgggcgtggccatcctggagcccaccctgcccatctggatgatgcagaccatgtgcagccccaagtggcagctgggcctggccttcctgcctgcctctgtgtcctacctgattggcaccaacctgtttggagtgctggccaacaagatgggccgctggctgtgcagcctgattggcatgctggtggtgggcaccagcctgctgtgcctgcccagctag

SEQ ID NO: 170291 - DNA, 1482 bp, Artificial Sequence; identical to SEQ ID NO: 170286
  Description of Artificial Sequence: Synthetic coding sequence

SEQ ID NO: 170292 - DNA, 1545 bp, Artificial Sequence
  Description of Artificial Sequence: Synthetic coding sequence
atggccctgtctgagctggccctggtgcgctggctgcaggagagccgccgcagcaggaagctgatcctcttcatcgtgttcctggccctgctgctggacaacatgctgctgactgtggtggtgcccatcatccccagctacctgtacagcatcaagcatgagaagaatgccacagagatccagacagcccggcctgtgcacacagccagcatcagtgacagcttccagagcatcttctcctactatgacaacagcaccatggtgactggaaatgccacccgggacctgaccctgcaccagacagccacccagcacatggtgaccaatgccagcgctgtgcccagcgactgccccagcgaggacaaggacctgctgaatgaaaatgtgcaggtgggcctgctgtttgccagcaaggccaccgtgcagctgatcaccaaccccttcatcggcctgctgaccaaccgcatcggctaccccatccccatctttgctggcttctgcatcatgtttgtgtccaccatcatgtttgccttcagcagcagctatgccttcctgctgattgcccggagcctgcagggcatcggcagcagctgcagctctgtggccggcatgggcatgctggcctctgtgtacacagatgatgaggagagaggaaatgtgatgggcatcgccctgggcggcctggccatgggcgtgctggtgggcccccccttcggctctgtgctgtatgaatttgtgggcaagacagcccccttcctggtgctggccgccctggtgctgctggatggagccatccagctgtttgtgctgcagcccagccgggtgcagcctgagagccagaagggcacccccctgaccaccctgctgaaggacccctacatcctgattgctgctggcagcatctgctttgccaacatgggcatcgccatgctggagcccgccctgcccatctggatgatggagaccatgtgcagcaggaagtggcagctgggcgtggccttcctgcctgccagcatctcctacctgattggcaccaacatcttcggcatcctggcccacaagatgggccgctggctgtgtgccctgctgggcatgatcatcgtgggcgtgtccatcctgtgcatcccctttgccaagaacatctacggcctgattgcccccaactttggagtgggctttgccatcggcatggtggacagctccatgatgcccatcatgggctacctggtggacctgcggcacgtgtctgtgtatggctctgtgtatgccatcgcagatgtggccttctgcatgggctacgccatcggccccagcgctggaggagccatcgccaaggccatcggcttcccctggctgatgaccatcatcggcatcatcgacatcctgtttgcccccctgtgcttcttcctgcggagccccccagccaaggaggagaagatggccatcctgatggaccacaactgccccatcaagaccaagatgtacacccagaacaacatccagagctaccccatcggagaagatgaggagagcgagagtgactag

SEQ ID NO: 170293 - DNA, 1494 bp, Artificial Sequence
  Description of Artificial Sequence: Synthetic coding sequence
atggatgtgcccggccctgtgtccagaagagctgctgctgctgctgccaccgtgctgctgaggacagcccgggtgcggcgggagtgctggttcctgcccacagccctgctgtgtgcctacggcttctttgccagcctgcggcccagcgagcccttcctgaccccctacctgctgggccctgacaagaacctgacagagcgggaggtgttcaatgagatctaccctgtgtggacctacagctacctggtgctgctcttccctgtgttcctggccacagactacctgcgctacaagcctgtggtgctgctgcagggcctgagcctgattgtgacctggttcatgctgctgtatgcccagggcctgctggccatccagttcctggagttcttctatggaattgccacagccacagaaattgcctactacagctacatctacagcgtggtggacctgggcatgtaccagaaggtgaccagctactgccgcagcgccaccctggtgggcttcaccgtgggctctgtgctgggccagatcctggtgtctgtggccggctggagcctcttcagcctgaatgtcatcagcctgacctgtgtgtctgtggcctttgctgtggcctggttcctgcccatgccccagaagagcctcttcttccaccacatccccagcacctgccagagggtgaatggcatcaaggtgcagaatggaggcatcgtgacagacaccccagccagcaaccacctgcccggctgggaggacatcgagagcaagatccccctgaacatggaggagccccctgtggaggagcctgagcccaagccagaccggctgctggtgctgaaggtgctgtggaatgacttcctgatgtgctacagcagccggcccctgctgtgctggagcgtgtggtgggccctgagcacctgtggctacttccaggtggtgaactacacccagggcctgtgggagaaggtgatgcccagccgctatgctgccatctacaatggaggagtggaggccgtgtccaccctgctgggcgctgtggccgtgtttgctgtgggctacatcaagatctcctggagcacctggggcgagatgaccctgagcctcttcagcctgctgattgctgctgctgtgtacatcatggacacagtgggcaacatctgggtgtgctacgccagctatgtggtgttccgcatcatctacatgctgctgatcaccatcgccaccttccagattgctgccaacctgtccatggagagatatgccctggtgtttggagtgaacaccttcatcgccctggccctgcagaccctgctgaccctgattgtggtggatgccagcggcctgggcctggagatcaccacccagttcctgatctatgccagctactttgccctgattgctgtggtgttcctggccagcggggctgtgtctgtgatgaagaagtgcaggaagctggaggacccccagagcagcagccaggtgaccaccagctag

SEQ ID NO: 170294 - DNA, 1380 bp, Artificial Sequence
  Description of Artificial Sequence: Synthetic coding sequence
atggatgtgcccggccctgtgtccagaagagctgctgctgctgctgccaccgtgctgctgaggacagcccgggtgcggcgggagtgctggttcctgcccacagccctgctgtgtgcctacggcttctttgccagcctgcggcccagcgagcccttcctgaccccctacctgctgggccctgacaagaacctgacagagcgggaggtgttcaatgagatctaccctgtgtggacctacagctacctggtgctgctcttccctgtgttcctggccacagactacctgcgctacaagcctgtggtgctgctgcagggcctgagcctgattgtgacctggttcatgctgctgtatgcccagggcctgctggccatccagttcctggagttcttctatggaattgccacagccacagaaattgcctactacagctacatctacagcgtggtggacctgggcatgtaccagaaggtgaccagctactgccgcagcgccaccctggtgggcttcaccgtgggctctgtgctgggccagatcctggtgtctgtggccggctggagcctcttcagcctgaatgtcatcagcctgacctgtgtgtctgtggcctttgctgtggcctggttcctgcccatgccccagaagagcctcttcttccaccacatccccagcacctgccagagggtgaatggcatcaaggagcccaagccagaccggctgctggtgctgaaggtgctgtggaatgacttcctgatgtgctacagcagccggcccctgctgtgctggagcgtgtggtgggccctgagcacctgtggctacttccaggtggtgaactacacccagggcctgtgggagaaggtgatgcccagccgctatgctgccatctacaatggaggagtggaggccgtgtccaccctgctgggcgctgtggccgtgtttgctgtgggctacatcaagatctcctggagcacctggggcgagatgaccctgagcctcttcagcctgctgattgctgctgctgtgtacatcatggacacagtgggcaacatctgggtgtgctacgccagctatgtggtgttccgcatcatctacatgctgctgatcaccatcgccaccttccagattgctgccaacctgtccatggagagatatgccctggtgtttggagtgaacaccttcatcgccctggccctgcagaccctgctgaccctgattgtggtggatgccagcggcctgggcctggagatcaccacccagttcctgatctatgccagctactttgccctgattgctgtggtgttcctggccagcggggctgtgtctgtgatgaagaagtgcaggaagctggaggacccccagagcagcagccaggtgaccaccagctag

SEQ ID NO: 170295 - DNA, 891 bp, Artificial Sequence
  Description of Artificial Sequence: Synthetic coding sequence
atggatgtgcccggccctgtgtccagaagagctgctgctgctgctgccaccgtgctgctgaggacagcccgggtgcggcgggagtgctggttcctgcccacagccctgctgtgtgcctacggcttctttgccagcctgcggcccagcgagcccttcctgaccccctacctgctgggccctgacaagaacctgacagagcgggaggagcccaagccagaccggctgctggtgctgaaggtgctgtggaatgacttcctgatgtgctacagcagccggcccctgctgtgctggagcgtgtggtgggccctgagcacctgtggctacttccaggtggtgaactacacccagggcctgtgggagaaggtgatgcccagccgctatgctgccatctacaacggcggcgtggaggccgtgtccaccctgctgggcgctgtggccgtgtttgctgtgggctacatcaagatctcctggagcacctggggcgagatgaccctgagcctcttcagcctgctgattgctgctgctgtgtacatcatggacacagtgggcaacatctgggtgtgctacgccagctatgtggtgttccgcatcatctacatgctgctgatcaccatcgccaccttccagattgctgccaacctgtccatggagagatatgccctggtgtttggagtgaacaccttcatcgccctggccctgcagaccctgctgaccctcatcgtggtggatgccagcggcctgggcctggagatcaccacccagttcctgatctatgccagctactttgccctgattgctgtggtgttcctggccagcggggctgtgtctgtgatgaagaagtgcaggaagctggaggacccccagagcagcagccaggtgaccaccagctag

SEQ ID NO: 170296 - DNA, 1491 bp, Artificial Sequence
  Description of Artificial Sequence: Synthetic coding sequence
atggactgctaccgcaccagcctgagcagctcctggatctaccccaccgtcatcctgtgcctgtttggcttcttctccatgatgaggccttctgagcccttcctgatcccctacctgagcggccctgacaagaacctgaccagcgctgagatcaccaatgagatcttccctgtgtggacctacagctacctggtgctgctgctgcctgtgtttgtgctgacagattatgtgcgctacaagcctgtgatcatcctgcagggcatctccttcatcatcacctggctgctgctgctgtttggccagggcgtgaagaccatgcaggtggtggagttcttctacggcatggtgacagctgctgaggtggcctactatgcctacatctacagcgtggtgtccccagagcactaccagagggtgtctggctactgccgctctgtgaccctggccgcctacacagctggctctgtgctggcccagctgctggtgtccctggccaacatgagctacttctacctgaatgtcatcagcctggcctctgtgtctgtggccttcctgttcagcctcttcctgcccatgcccaagaagtccatgttcttccacgccaagcccagccgggagatcaagaagagcagctctgtgaaccctgtgctggaggagacccatgaaggagaggcccctggctgtgaggagcagaagcccaccagcgagatcctgagcaccagcggcaagctgaacaagggccagctgaacagcctgaagcccagcaatgtgacagtggatgtgtttgtgcagtggttccaggacctgaaggagtgctacagcagcaagaggctcttctactggagcctgtggtgggcctttgccacagctggcttcaaccaggtgctgaactacgtgcagatcctgtgggactacaaggcccccagccaggacagcagcatctacaacggggctgtggaggccatcgccacctttggaggagctgtggccgcctttgctgtgggctacgtgaaggtgaactgggacctgctgggggagctggccctggtggtgttttctgtggtgaatgccggcagcctcttcctgatgcactacacagccaacatctgggcctgctacgccggctacctgatcttcaagagcagctacatgctgctgatcaccatcgctgtgttccagattgctgtgaacctgaatgtggagagatatgccctggtgtttggcatcaacaccttcatcgccctggtgatccagaccatcatgaccgtcatcgtggtggaccagaggggcctgaacctgcctgtgtccatccagttcctggtgtatggcagctactttgctgtgattgctggcatcttcctgatgaggtccatgtacatcacctacagcaccaagagccagaaggatgtgcagagccctgcccccagtgaaaatccagatgtgagccaccctgaggaggagagcaacatcatcatgagcaccaagctgtag

SEQ ID NO: 170297 - DNA, 165 bp, Artificial Sequence
  Description of Artificial Sequence: Synthetic coding sequence
atggactgctaccgcaccagcctgagcagctcctggatctaccccaccgtcatcctgtgcctgtttggcttcttctccatgatgaggccttctgagcccttcctgatcccctacctgagcggccctgacaagaacctgaccagcgctgagatcaccaatgaatag

SEQ ID NO: 170298 - DNA, 195 bp, Artificial Sequence
  Description of Artificial Sequence: Synthetic coding sequence
atggactgctaccgcaccagcctgagcagctcctggatctaccccaccgtcatcctgtgcctgtttggcttcttctccatgatgaggccttctgagcccttcctgatcccctacctgagcggccctgacaagaacctgaccagcgctgagatcaccaatgagatcttccctgtgtggacctacagctacctgtag

SEQ ID NO: 170299 - DNA, 1491 bp, Artificial Sequence; identical to SEQ ID NO: 170296
  Description of Artificial Sequence: Synthetic coding sequence

SEQ ID NO: 170300 - DNA, 399 bp, Artificial Sequence
  Description of Artificial Sequence: Synthetic coding sequence
atggactgctaccgcaccagcctgagcagctcctggatctaccccaccgtcatcctgtgcctgtttggcttcttctccatgatgaggccttctgagcccttcctgatcccctacctgagcggccctgacaagaacctgaccagcgctgagatcaccaatgagatcttccctgtgtggacctacagctacctggtgctgctgctgcctgtgtttgtgctgacagattatgtgcgctacaagcctgtgatcatcctgcagggcatctccttcatcatcacctggctgctgctgctgtttggccagggcgtgaagaccatgcaggtggtggagttcttctacggcatggtgacagctgctgaggtggcctactatgcctacatctacagcgtggtgtcctag

SEQ ID NO: 170301 - DNA, 1479 bp, Artificial Sequence
  Description of Artificial Sequence: Synthetic coding sequence
atgaaccccctgggcagcgccagccgggccaccgtggaccagctgacagacctgcccagcaaggagcagctgagctgtgtggtgtttgccctgtggcccccagccttcagcagcaacctgagtgaccccggggtgaagatcaccaatgagatcttccctgtgtggacctacagctacctggtgctgctgctgcctgtgtttgtgctgacagattatgtgcgctacaagcctgtgatcatcctgcagggcatctccttcatcatcacctggctgctgctgctgtttggccagggcgtgaagaccatgcaggtggtggagttcttctacggcatggtgacagctgctgaggtggcctactatgcctacatctacagcgtggtgtccccagagcactaccagagggtgtctggctactgccgctctgtgaccctggccgcctacacagctggctctgtgctggcccagctgctggtgtccctggccaacatgagctacttctacctgaatgtcatcagcctggcctctgtgtctgtggccttcctgttcagcctcttcctgcccatgcccaagaagtccatgttcttccacgccaagcccagccgggagatcaagaagagcagctctgtgaaccctgtgctggaggagacccatgaaggagaggcccctggctgtgaggagcagaagcccaccagcgagatcctgagcaccagcggcaagctgaacaagggccagctgaacagcctgaagcccagcaatgtgacagtggatgtgtttgtgcagtggttccaggacctgaaggagtgctacagcagcaagaggctcttctactggagcctgtggtgggcctttgccacagctggcttcaaccaggtgctgaactacgtgcagatcctgtgggactacaaggcccccagccaggacagcagcatctacaacggggctgtggaggccatcgccacctttggaggagctgtggccgcctttgctgtgggctacgtgaaggtgaactgggacctgctgggggagctggccctggtggtgttttctgtggtgaatgccggcagcctcttcctgatgcactacacagccaacatctgggcctgctacgccggctacctgatcttcaagagcagctacatgctgctgatcaccatcgctgtgttccagattgctgtgaacctgaatgtggagagatatgccctggtgtttggcatcaacaccttcatcgccctggtgatccagaccatcatgaccgtcatcgtggtggaccagaggggcctgaacctgcctgtgtccatccagttcctggtgtatggcagctactttgctgtgattgctggcatcttcctgatgaggtccatgtacatcacctacagcaccaagagccagaaggatgtgcagagccctgcccccagtgaaaatccagatgtgagccaccctgaggaggagagcaacatcatcatgagcaccaagctgtag

SEQ ID NO: 170302 - DNA, 1626 bp, Artificial Sequence
  Description of Artificial Sequence: Synthetic coding sequence
atgggccacagcccccctgtgctgcccctgtgtgcctctgtgtccctgctgggcggcctgaccttcggctatgagctggccgtcatcagcggggccctgctgcccctgcagctggactttggcctgagctgcctggagcaggagttcctggtgggcagcctgctgctgggcgccctgctggccagcctggtgggcggcttcctgattgactgctacggcaggaagcaggccatcctgggcagcaacctggtgctgctggccggcagcctgaccctgggcctggccggcagcctggcctggctggtgctgggccgggctgtggtgggctttgccatcagcctgagctccatggcctgctgcatctacgtgtctgagctggtgggcccccggcagaggggcgtgctggtgtccctgtatgaagctggcatcaccgtgggcatcctgctgtcctatgccctgaactatgccctggccggcaccccctggggctggaggcacatgtttggctgggccacagccccagctgtgctgcagagcctgagcctgctcttcctgcctgctggaacagatgaaacagccacccacaaggacctgatccccctgcagggcggggaggcccccaagctgggccctggccggccccgctacagcttcctggacctcttccgggcccgggacaacatgaggggccgcaccaccgtgggcctgggcctggtgctcttccagcagctgaccggccagcccaacgtgctgtgctacgccagcaccatcttcagctctgtgggcttccacggcggcagcagcgctgtgctggcctctgtgggcctgggcgctgtgaaggtggccgccaccctgacagccatgggcctggtggaccgggccggccggcgggccctgctgctggccggctgtgccctgatggccctgtctgtgtctggcatcggcctggtgtcctttgctgtgcccatggattctggccccagctgcctggccgtgcccaatgccaccggccagacaggcctgcccggggacagcggcctgctgcaggacagcagcctgccccccatccccaggaccaatgaagaccagcgggagcccatcctgagcacagccaagaagaccaagccccaccccaggtctggggaccccagcgccccaccccggctggccctgagcagcgccctgcccggcccccccctgcctgcccggggccacgccctgctgcgctggacagccctgctgtgcctgatggtgtttgtgtctgccttctcctttggatttggacctgtgacctggctggtgctgtctgagatctaccctgtggagatccggggccgggcctttgccttctgcaacagcttcaactgggccgccaacctcttcatcagcctgtccttcctggacctgattggcaccatcggcctgtcctggaccttcctgctgtatggcctgacagctgtgctgggcctgggcttcatctacctgtttgtgcctgagaccaagggccagagcctggccgagattgaccagcagttccagaagaggcgcttcaccctgagctttggccaccggcagaacagcacaggcatcccctacagcagaattgagatctctgctgccagctag

SEQ ID NO: 170303 - DNA, 1947 bp, Artificial Sequence
  Description of Artificial Sequence: Synthetic coding sequence
atgagcaggaaggcctctgaaaatgtggagtacaccctgcggagcctgagcagcctgatgggagagaggaggaggaagcagcctgagccagatgctgccagcgctgctggggagtgcagcctgctggccgctgctgagagcagcaccagcctgcagagcgctggggccggcggcggcggcgtgggggacctggagagagctgcccggcggcagttccagcaggatgagaccccagcctttgtgtatgtggtggccgtgttcagcgccctgggcggcttcctgtttggctatgacacaggagtggtgtctggggccatgctgctgctgaagaggcagctgagcctggatgccctgtggcaggagctgctggtgagcagcacagtgggcgctgctgctgtgtctgccctggccggcggggccctgaatggagtgtttggaagaagagctgccatcctgctggccagcgccctcttcaccgctggcagcgctgtgctggccgccgccaacaacaaggagaccctgctggccggccgcctggtggtgggcctgggcattggaattgcctccatgacagtgcctgtgtacatcgccgaggtgtccccacccaacctgcggggccgcctggtgaccatcaacaccctcttcatcactggaggccagttctttgcctctgtggtggatggagccttctcctacctgcagaaggatggctggagatacatgctgggcctggccgctgtgcctgctgtgatccagttcttcggcttcctgttcctgcctgagagcccccgctggctgatccagaagggccagacccagaaggcccggcgcatcctgagccagatgaggggcaaccagaccattgatgaggagtatgacagcatcaagaacaacatcgaggaggaggagaaggaggtgggcagcgctggccctgtgatctgcaggatgctgagctacccacccacccggcgggccctgattgtgggctgcggcctgcagatgttccagcagctgagcggcatcaacaccatcatgtactacagcgccaccatcctgcagatgtctggagtggaggatgaccggctggccatctggctggcctctgtgacagccttcaccaacttcatcttcaccctggtgggcgtgtggctggtggagaaggtgggccgcaggaagctgaccttcggcagcctggccggcaccaccgtggccctgatcatcctggccctgggctttgtgctgagcgcccaggtgagcccccgcatcaccttcaagcccatcgcccccagcggccagaatgccacctgcacccgctacagctactgcaatgaatgcatgctggaccctgactgtggcttctgctacaagatgaacaagagcacagtgattgacagcagctgtgtgcctgtgaacaaggccagcaccaatgaggccgcctggggccgctgtgaaaatgagaccaagttcaagacagaggacatcttctgggcctacaacttctgccccaccccctacagctggacagccctgctgggcctcatcctgtacctggtgttctttgcccctggcatgggccccatgccctggacagtgaacagcgagatctaccccctgtgggcccggagcactggaaatgcctgcagcagcggcatcaactggatcttcaacgtgctggtgtccctgaccttcctgcacacagctgagtacctgacctactatggagccttcttcctgtatgccggctttgctgctgtgggcctgctcttcatctacggctgcctgcctgagaccaagggcaagaagctggaggagattgagagcctgtttgacaaccggctgtgcacctgtggcaccagtgacagtgatgagggccgctacatcgagtacatccgggtgaagggcagcaactaccacctgagtgacaatgatgccagtgatgtggagtag

SEQ ID NO: 170304 - DNA, 1074 bp, Artificial Sequence
  Description of Artificial Sequence: Synthetic coding sequence
atgagcaggaaggcctctgaaaatgtggagtacaccctgcggagcctgagcagcctgatgggagagaggaggaggaagcagcctgagccagatgctgccagcgctgctggggagtgcagcctgctggccgctgctgagagcagcaccagcctgcagagcgctggggccggcggcggcggcgtgggggacctggagagagctgcccggcggcagttccagcaggatgagaccccagcctttgtgtatgtggtggccgtgttcagcgccctgggcggcttcctgtttggctatgacacaggagtggtgtctggggccatgctgctgctgaagaggcagctgagcctggatgccctgtggcaggagctgctggtgagcagcacagtgggcgctgctgctgtgtctgccctggccggcggggccctgaatggagtgtttggaagaagagctgccatcctgctggccagcgccctcttcaccgctggcagcgctgtgctggccgccgccaacaacaaggagaccctgctggccggccgcctggtggtgggcctgggcattggaattgcctccatgacagtgcctgtgtacatcgccgaggtgtccccacccaacctgcggggccgcctggtgaccatcaacaccctcttcatcactggaggccagttctttgcctctgtggtggatggagccttctcctacctgcagaaggatggctggagatacatgctgggcctggccgctgtgcctgctgtgatccagttcttcggcttcctgttcctgcctgagagcccccgctggctgatccagaagggccagacccagaaggcccggcgcatcctgagccagatgaggggcaaccagaccattgatgaggagtatgacagcatcaagaacaacatcgaggaggaggagaaggaggtgggcagcgctggccctgtgatctgcaggatgctgagctacccacccacccggcgggccctgattgtgggctgcggcctgcagatgttccagcagctgagcggcatcaacaccatcatgtatgtgttcctgagcggcttcctgctgaagaggctgtag

SEQ ID NO: 170305 - DNA, 1494 bp, Artificial Sequence
  Description of Artificial Sequence: Synthetic coding sequence
atggacaaccggcagaatgtgaccccagccctgatctttgccatcaccgtggccaccatcggcagcttccagtttggctacaacacaggagtcatcaatgcccctgagaccatcatcaaggagttcatcaacaagaccctgacagacaaggccaatgccccacccagcgaggtgctgctgaccaacctgtggagcctgtctgtggccatcttctctgtgggcggcatgattggcagcttctctgtgggcctgtttgtgaacagatttggaagaagaaacagcatgctgattgtgaacctgctggccgccaccggcggctgcctgatgggcctgtgcaagattgctgagagcgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtgattggcatcctggtggcccagatcttcggcctggagctgatcctgggcagcgaggagctgtggcctgtgctgctgggcttcaccatcctgcctgccatcctgcagagcgctgccctgccctgctgcccagagagcccccgcttcctgctgatcaacaggaagaaggaggagaatgccacccgcatcctgcagaggctgtggggcacccaggatgtgtcccaggacatccaggagatgaaggatgaaagtgccaggatgagccaggagaagcaggtgacagtgctggagctgttccgggtgagcagctaccggcagcccatcatcatcagcatcgtgctgcagctgagccagcagctgagcggcatcaatgctgtgttctactacagcacaggcatcttcaaggatgctggggtgcagcagcccatctatgccaccatctctgctggggtggtgaacaccatcttcaccctgctgagcctcttcctggtggagcgggccggccgccgcaccctgcacatgattggcctgggcggcatggccttctgcagcaccctgatgacagtgtccctgctgctgaagaaccactacaacggcatgagctttgtgtgcatcggggccatcctggtgtttgtggcctgctttgagatcggccctggccccatcccctggttcatcgtggccgagctgttcagccagggccccaggcctgctgccatggctgtggccggctgcagcaactggaccagcaacttcctggtgggcctgctcttccccagcgctgcctactacctgggcgcctacgtgttcatcatcttcaccggcttcctgatcaccttcctggccttcaccttcttcaaggtgcctgagacccggggccgcacctttgaggacatcacccgggcctttgagggccaggcccatggagctgacagaagtggcaaggatggagtgatgggcatgaacagcattgaaccagccaaggagaccaccaccaacgtgtag

SEQ ID NO: 170306 - DNA, 1563 bp, Artificial Sequence
  Description of Artificial Sequence: Synthetic coding sequence
atggagttccacaatggaggccacgtgtctggcatcggcggcttcctggtgtccctgaccagcaggatgaagccccacaccctggccgtgaccccagccctgatctttgccatcaccgtggccaccatcggcagcttccagtttggctacaacacaggagtcatcaatgcccctgagaccatcatcaaggagttcatcaacaagaccctgacagacaaggccaatgcccctccttctgaggtgctgctgaccaacctgtggagcctgtctgtggccatcttctctgtgggcggcatgattggcagcttctctgtgggcctgtttgtgaaccgcttcggcagaagaaattccatgctgattgtgaacctgctggccgccactggaggctgcctgatgggcctgtgcaagattgctgagagcgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtcatcggcatcctggtggcccagatcttcggcctggagctgatcctgggcagcgaggagctgtggcctgtgctgctgggcttcaccatcctgcctgccatcctgcagagcgctgccctgccctgctgcccagagagcccccgcttcctgctgatcaacaggaagaaggaggagaatgccacccgcatcctgcagaggctgtggggcacccaggatgtgtcccaggacatccaggagatgaaggatgagagcgccaggatgagccaggagaagcaggtgacagtgctggagctgttccgggtgtcctcctaccggcagcccatcatcatcagcatcgtgctgcagctgagccagcagctgagcggcatcaatgctgtgttctactacagcacaggcatcttcaaggatgctggggtgcagcagcccatctatgccaccatctctgctggggtggtgaacaccatcttcaccctgctgagcctcttcctggtggagagagctggaagaaggaccctgcacatgattggcctgggcggcatggccttctgcagcaccctgatgacagtgtccctgctgctgaagaaccactacaacggcatgagctttgtgtgcattggagccatcctggtgtttgtggcctgctttgaaattggccctggccccatcccctggttcatcgtggccgagctgttcagccagggccccaggcctgctgccatggctgtggccggctgcagcaactggaccagcaacttcctggtgggcctgctcttccccagcgctgcctactacctgggcgcctacgtgttcatcatcttcaccggcttcctgatcaccttcctggccttcaccttcttcaaggtgcctgagacccggggccgcacctttgaggacatcacccgggcctttgagggccaggcccacggggctgacagaagtggcaaggatggagtgatgggcatgaacagcattgagcccgccaaggagaccaccaccaacgtgtag

SEQ ID NO: 170307 - DNA, 1494 bp, Artificial Sequence; identical to SEQ ID NO: 170305
  Description of Artificial Sequence: Synthetic coding sequence

SEQ ID NO: 170308 - DNA, 363 bp, Artificial Sequence
  Description of Artificial Sequence: Synthetic coding sequence
atggagttccacaatggaggccacgtgtctggcatcggcggcttcctggtgtccctgaccagcaggatgaagccccacaccctggccgtgaccccagccctgatctttgccatcaccgtggccaccatcggcagcttccagtttggctacaacacaggagtcatcaatgcccctgagaccatcatcaaggagttcatcaacaagaccctgacagacaaggccaatgcccctccttctgaggtgctgctgaccaacctgtggagcctgtctgtggccatcttctctgtgggcggcatgattggcagcttctctgtgggcctgtttgtgaaccgcttcggcagaagaaattccatgctgatctag

SEQ ID NO: 170309 - DNA, 1236 bp, Artificial Sequence
  Description of Artificial Sequence: Synthetic coding sequence
atgctgctgcggcggaggaacagcatgctgattgtgaacctgctggccgccaccggcggctgcctgatgggcctgtgcaagattgctgagagcgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtgattggcatcctggtggcccagatcttcggcctggagctgatcctgggcagcgaggagctgtggcctgtgctgctgggcttcaccatcctgcctgccatcctgcagagcgctgccctgccctgctgcccagagagcccccgcttcctgctgatcaacaggaagaaggaggagaatgccacccgcatcctgcagaggctgtggggcacccaggatgtgtcccaggacatccaggagatgaaggatgaaagtgccaggatgagccaggagaagcaggtgacagtgctggagctgttccgggtgagcagctaccggcagcccatcatcatcagcatcgtgctgcagctgagccagcagctgagcggcatcaatgctgtgttctactacagcacaggcatcttcaaggatgctggggtgcagcagcccatctatgccaccatctctgctggggtggtgaacaccatcttcaccctgctgagcctcttcctggtggagcgggccggccgccgcaccctgcacatgattggcctgggcggcatggccttctgcagcaccctgatgacagtgtccctgctgctgaagaaccactacaacggcatgagctttgtgtgcatcggggccatcctggtgtttgtggcctgctttgagatcggccctggccccatcccctggttcatcgtggccgagctgttcagccagggccccaggcctgctgccatggctgtggccggctgcagcaactggaccagcaacttcctggtgggcctgctcttccccagcgctgcctactacctgggcgcctacgtgttcatcatcttcaccggcttcctgatcaccttcctggccttcaccttcttcaaggtgcctgagacccggggccgcacctttgaggacatcacccgggcctttgagggccaggcccatggagctgacagaagtggcaaggatggagtgatgggcatgaacagcattgaaccagccaaggagaccaccaccaacgtgtag

SEQ ID NO: 170310 - DNA, 426 bp, Artificial Sequence
  Description of Artificial Sequence: Synthetic coding sequence
atggacaaccggcagaatgtgaccccagccctgatctttgccatcaccgtggccaccatcggcagcttccagtttggctacaacacaggagtcatcaatgcccctgagaccatcatcaaggagttcatcaacaagaccctgacagacaaggccaatgccccacccagcgaggtgctgctgaccaacctgtggagcctgtctgtggccatcttctctgtgggcggcatgattggcagcttctctgtgggcctgtttgtgaacagatttggaagaagaaacagcatgctgattgtgaacctgctggccgccaccggcggctgcctgatgggcctgtgcaagattgctgagagcgtggagatgctgatcctgggccgcctggtgattggcctcttctgtggcctgtgcaccggctttgtgcccatgtag

SEQ ID NO: 170311 - DNA, 144 bp, Artificial Sequence
  Description of Artificial Sequence: Synthetic coding sequence
atggacaaccggcagaatgtgaccccagccctgatctttgccatcaccgtggccaccatcggcagcttccagtttggctacaacacaggagtcatcaatgcccctgagaccatcatcaaggagttcatcaacaagaccctgtag

SEQ ID NO: 170312 - DNA, 69 bp, Artificial Sequence
  Description of Artificial Sequence: Synthetic coding sequence
atggacaaccggcagaatgtgaccccagccctgatctttgccatcaccgtggccaccatcggcagctag

SEQ ID NO: 170313 - DNA, 426 bp, Artificial Sequence
  Description of Artificial Sequence: Synthetic coding sequence
atggagttccacaatggaggccacgtgtctggcatcggcggcttcctggtgtccctgaccagcaggatgaagccccacaccctggccgtgaccccagccctgatctttgccatcaccgtggccaccatcggcagcttccagtttggctacaacacaggagtcatcaatgcccctgagaccatcatcaaggagttcatcaacaagaccctgacagacaaggccaatgcccctccttctgaggtgctgctgaccaacctgtggagcctgtctgtggccatcttctctgtgggcggcatgattggcagcttctctgtgggcctgtttgtgaaccgcttcggcagaagaaattccatgctgattgtgaacctgctggccgccactggaggctgcctgatgggcctgtgcaagattgctgagagcgtgtag

SEQ ID NO: 170314 - DNA, 1608 bp, Artificial Sequence
  Description of Artificial Sequence: Synthetic coding sequence
atgcagaggctgcagctgctgcgggtggaggtgctgctgggcgtgaagcagggagatgagatgaggcacttcttcttcagcagccagaccagcaccctggagaagagccagaatggaggagtgggggaggaggtgaccccagccctgatctttgccatcaccgtggccaccatcggcagcttccagtttggctacaacacaggagtcatcaatgcccctgagaccatcatcaaggagttcatcaacaagaccctgacagacaaggccaatgccccacccagcgaggtgctgctgaccaacctgtggagcctgtctgtggccatcttctctgtgggcggcatgattggcagcttctctgtgggcctgtttgtgaacagatttggaagaagaaacagcatgctgattgtgaacctgctggccgccaccggcggctgcctgatgggcctgtgcaagattgctgagagcgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtgattggcatcctggtggcccagatcttcggcctggagctgatcctgggcagcgaggagctgtggcctgtgctgctgggcttcaccatcctgcctgccatcctgcagagcgctgccctgccctgctgcccagagagcccccgcttcctgctgatcaacaggaagaaggaggagaatgccacccgcatcctgcagaggctgtggggcacccaggatgtgtcccaggacatccaggagatgaaggatgaaagtgccaggatgagccaggagaagcaggtgacagtgctggagctgttccgggtgagcagctaccggcagcccatcatcatcagcatcgtgctgcagctgagccagcagctgagcggcatcaatgctgtgttctactacagcacaggcatcttcaaggatgctggggtgcagcagcccatctatgccaccatctctgctggggtggtgaacaccatcttcaccctgctgagcctcttcctggtggagcgggccggccgccgcaccctgcacatgattggcctgggcggcatggccttctgcagcaccctgatgacagtgtccctgctgctgaagaaccactacaacggcatgagctttgtgtgcatcggggccatcctggtgtttgtggcctgctttgagatcggccctggccccatcccctggttcatcgtggccgagctgttcagccagggccccaggcctgctgccatggctgtggccggctgcagcaactggaccagcaacttcctggtgggcctgctcttccccagcgctgcctactacctgggcgcctacgtgttcatcatcttcaccggcttcctgatcaccttcctggccttcaccttcttcaaggtgcctgagacccggggccgcacctttgaggacatcacccgggcctttgagggccaggcccatggagctgacagaagtggcaaggatggagtgatgggcatgaacagcattgaaccagccaaggagaccaccaccaacgtgtag

SEQ ID NO: 170315 - DNA, 486 bp, Artificial Sequence
  Description of Artificial Sequence: Synthetic coding sequence
atgattggcctgggcggcatggccttctgcagcaccctgatgacagtgtccctgctgctgaagaaccactacaacggcatgagctttgtgtgcatcggggccatcctggtgtttgtggcctgctttgagatcggccctggccccatcccctggttcatcgtggccgagctgttcagccagggccccaggcctgctgccatggctgtggccggctgcagcaactggaccagcaacttcctggtgggcctgctcttccccagcgctgcctactacctgggcgcctacgtgttcatcatcttcaccggcttcctgatcaccttcctggccttcaccttcttcaaggtgcctgagacccggggccgcacctttgaggacatcacccgggcctttgagggccaggcccatggagctgacagaagtggcaaggatggagtgatgggcatgaacagcattgaaccagccaaggagaccaccaccaacgtgtag

SEQ ID NO: 170316 - DNA, 1236 bp, Artificial Sequence; identical to SEQ ID NO: 170309
  Description of Artificial Sequence: Synthetic coding sequence

SEQ ID NO: 170317 - DNA, 459 bp, Artificial Sequence
  Description of Artificial Sequence: Synthetic coding sequence
atggacaaccggcagaatgtgaccccagccctgatctttgccatcaccgtggccaccatcggcagcttccagtttggctacaacacaggagtcatcaatgcccctgagaccatcatcaaggagttcatcaacaagaccctgacagacaaggccaatgccccacccagcgaggtgctgctgaccaacctgtggagcctgtctgtggccatcttctctgtgggcggcatgattggcagcttctctgtgggcctgtttgtgaacagatttggaagaagaaacagcatgctgattgtgaacctgctggccgccaccggcggctgcctgatgggcctgtgcaagattgctgagagcgtggagatgctgatcctgggccgcctggtgattggcctcttctgtggcctgtgcaccggctttgtgcccatgtacatcggggagatcagccccacagccctgaggtag

SEQ ID NO: 170318 - DNA, 255 bp, Artificial Sequence
  Description of Artificial Sequence: Synthetic coding sequence
atggacaaccggcagaatgtgaccccagccctgatctttgccatcaccgtggccaccatcggcagcttccagtttggctacaacacaggagtcatcaatgcccctgagaccatcatcaaggagttcatcaacaagaccctgacagacaaggccaatgccccacccagcgaggtgctgctgaccaacctgtggagcctgtctgtggccatcttctctgtgggcggcatgattggcagcttctctgtgggcctgtag

SEQ ID NO: 170319 - DNA, 1563 bp, Artificial Sequence; identical to SEQ ID NO: 170306
  Description of Artificial Sequence: Synthetic coding sequence

SEQ ID NO: 170320 - DNA, 510 bp, Artificial Sequence
  Description of Artificial Sequence: Synthetic coding sequence
atggacaaccggcagaatgtgaccccagccctgatctttgccatcaccgtggccaccatcggcagcttccagtttggctacaacacaggagtcatcaatgcccctgagaccatcatcaaggagttcatcaacaagaccctgacagacaaggccaatgccccacccagcgaggtgctgctgaccaacctgtggagcctgtctgtggccatcttctctgtgggcggcatgattggcagcttctctgtgggcctgtttgtgaacagatttggaagaagaaacagcatgctgattgtgaacctgctggccgccaccggcggctgcctgatgggcctgtgcaagattgctgagagcgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtgattggcatcctggtgtag

SEQ ID NO: 170321 - DNA, 1491 bp, Artificial Sequence
  Description of Artificial Sequence: Synthetic coding sequence
atgggcacccagaaggtgaccccagccctgatctttgccatcaccgtggccaccatcggcagcttccagtttggctacaacacaggagtcatcaatgcccctgagaagatcatcaaggagttcatcaacaagaccctgacagacaagggaaatgcccctccttctgaggtgctgctgaccagcctgtggagcctgtctgtggccatcttctctgtgggcggcatgattggcagcttctctgtgggcctgtttgtgaaccgcttcggcagaagaaattccatgctgattgtgaacctgctggccgtgactggaggctgcttcatgggcctgtgcaaggtggccaagtctgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtggtgggcatcctggtggcccagatcttcggcctggagttcatcctgggcagcgaggagctgtggcccctgctgctgggcttcaccatcctgcctgccatcctgcagagcgctgccctgcccttctgcccagagagcccccgcttcctgctgatcaacaggaaggaggaggagaatgccaagcagatcctgcagaggctgtggggcacccaggatgtgtcccaggacatccaggagatgaaggatgagagcgccaggatgagccaggagaagcaggtgacagtgctggagctgttccgggtgtcctcctaccggcagcccatcatcatcagcatcgtgctgcagctgagccagcagctgagcggcatcaatgctgtgttctactacagcacaggcatcttcaaggatgctggggtgcaggagcccatctatgccaccatcggggccggcgtggtgaacaccatcttcaccgtggtgtccctcttcctggtggagagagctggaagaaggaccctgcacatgattggcctgggcggcatggccttctgcagcaccctgatgacagtgtccctgctgctgaaggacaactacaacggcatgagctttgtgtgcattggagccatcctggtgtttgtggccttctttgaaattggccctggccccatcccctggttcatcgtggccgagctgttcagccagggccccaggcctgctgccatggctgtggccggctgcagcaactggaccagcaacttcctggtgggcctgctcttccccagcgctgcccactacctgggcgcctacgtgttcatcatcttcaccggcttcctgatcaccttcctggccttcaccttcttcaaggtgcctgagacccggggccgcacctttgaggacatcacccgggcctttgagggccaggcccacggggctgacagaagtggcaaggatggagtgatggagatgaacagcattgagcccgccaaggagaccaccaccaacgtgtag

SEQ ID NO: 170322 - DNA, 1269 bp, Artificial Sequence
  Description of Artificial Sequence: Synthetic coding sequence
atgattggcagcttctctgtgggcctgtttgtgaaccgcttcggcagaagaaattccatgctgattgtgaacctgctggccgtgactggaggctgcttcatgggcctgtgcaaggtggccaagtctgtggagatgctgatcctgggccgcctggtgattggcctcttctgtggcctgtgcaccggctttgtgcccatgtacatcggggagatcagccccacagccctgcggggggccttcggcaccctgaaccagctgggcatcgtggtgggcatcctggtggcccagatcttcggcctggagttcatcctgggcagcgaggagctgtggcccctgctgctgggcttcaccatcctgcctgccatcctgcagagcgctgccctgcccttctgcccagagagcccccgcttcctgctgatcaacaggaaggaggaggagaatgccaagcagatcctgcagaggctgtggggcacccaggatgtgtcccaggacatccaggagatgaaggatgagagcgccaggatgagccaggagaagcaggtgacagtgctggagctgttccgggtgtcctcctaccggcagcccatcatcatcagcatcgtgctgcagctgagccagcagctgagcggcatcaatgctgtgttctactacagcacaggcatcttcaaggatgctggggtgcaggagcccatctatgccaccatcggggccggcgtggtgaacaccatcttcaccgtggtgtccctcttcctggtggagagagctggaagaaggaccctgcacatgattggcctgggcggcatggccttctgcagcaccctgatgacagtgtccctgctgctgaaggacaactacaacggcatgagctttgtgtgcattggagccatcctggtgtttgtggccttctttgaaattggccctggccccatcccctggttcatcgtggccgagctgttcagccagggccccaggcctgctgccatggctgtggccggctgcagcaactggaccagcaacttcctggtgggcctgctcttccccagcgctgcccactacctgggcgcctacgtgttcatcatcttcaccggcttcctgatcaccttcctggccttcaccttcttcaaggtgcctgagacccggggccgcacctttgaggacatcacccgggcctttgagggccaggcccacggggctgacagaagtggcaaggatggagtgatggagatgaacagcattgagcccgccaaggagaccaccaccaacgtgtag

SEQ ID NO: 170323 - DNA, 1530 bp, Artificial Sequence
  Description of Artificial Sequence: Synthetic coding sequence
atgcccagcggcttccagcagatcggctctgaagatggagagcccccccagcagagggtgacaggcaccctggtgctggccgtgttttctgctgtgctgggcagcctgcagtttggctacaacatcggggtcatcaatgccccccagaaggtgattgagcagagctacaatgagacctggctgggccggcagggccctgagggccccagcagcatccccccaggcaccctgaccaccctgtgggccctgtctgtggccatcttctctgtgggcggcatgatcagcagcttcctgattggcatcatcagccagtggctgggcaggaagagggccatgctggtgaacaacgtgctggccgtgctgggcggcagcctgatgggcctggccaatgctgctgccagctatgagatgctgatcctgggccgcttcctgattggagcctacagcggcctgaccagcggcctggtgcccatgtatgtgggggagatcgcccccacccacctgcggggggccctgggcaccctgaaccagctggccatcgtcatcggcatcctgattgcccaggtgctgggcctggagagcctgctgggcacagccagcctgtggcccctgctgctgggcctgactgtgctgcctgccctgctgcagctggtgctgctgcccttctgcccagagagcccccgctacctgtacatcatccagaacctggagggccctgccaggaagagcctgaagaggctgaccggctgggcagatgtgtctggagtgctggccgagctgaaggatgagaagaggaagctggagcgggagcggcccctgagcctgctgcagctgctgggcagcaggacccaccggcagcccctcatcatcgctgtggtgctgcagctgagccagcagctgagcggcatcaatgctgtgttctactacagcaccagcatctttgaaacagctggggtgggccagcctgcctatgccaccatcggggccggcgtggtgaacacagtgttcaccctggtgtctgtgctgctggtggagagagctggaagaaggaccctgcacctgctgggcctggccggcatgtgtggctgtgccatcctgatgacagtggccctgctgctgctggagcgggtgcctgccatgtcctatgtgtccatcgtggccatctttggatttgtggccttctttgaaattggccctggccccatcccctggttcatcgtggccgagctgttcagccagggccccaggcctgctgccatggctgtggccggcttcagcaactggaccagcaacttcatcatcggcatgggcttccagtatgtggccgaggccatgggcccctacgtgttcctgctgtttgctgtgctgctgctgggcttcttcatcttcaccttcctgcgggtgcctgagacccggggccgcacctttgaccagatctctgctgccttccacaggacccccagcctgctggagcaggaggtgaagcccagcacagagctggagtacctgggcccagatgaaaatgactag

SEQ ID NO: 170324 - DNA, 1356 bp, Artificial Sequence
  Description of Artificial Sequence: Synthetic coding sequence
atggatggagagcccccccagcagagggtgacaggcaccctggtgctggccgtgttttctgctgtgctgggcagcctgcagtttggctacaacatcggggtcatcaatgccccccagaaggtgattgagcagagctacaatgagacctggctgggccggcagggccctgagggccccagcagcatccccccaggcaccctgaccaccctgtgggccctgtctgtggccatcttctctgtgggcggcatgatcagcagcttcctgattggcatcatcagccagtggctgggcaggaagagggccatgctggtgaacaacgtgctggccgtgctgggcggcagcctgatgggcctggccaatgctgctgccagctatgagatgctgatcctgggccgcttcctgattggagcctacagcggcctgaccagcggcctggtgcccatgtatgtgggggagatcgcccccacccacctgcggggggccctgggcaccctgaaccagctggccatcgtcatcggcatcctgattgcccaggtgctgggcctggagagcctgctgggcacagccagcctgtggcccctgctgctgggcctgactgtgctgcctgccctgctgcagctggtgctgctgcccttctgcccagagagcccccgctacctgtacatcatccagaacctggagggccctgccaggaagagcctgaagaggctgaccggctgggcagatgtgtctggagtgctggccgagctgaaggatgagaagaggaagctggagcgggagcggcccctgagcctgctgcagctgctgggcagcaggacccaccggcagcccctcatcatcgctgtggtgctgcagctgagccagcagctgagcggcatcaatgctgtgttctactacagcaccagcatctttgaaacagctggggtgggccagcctgcctatgccaccatcggggccggcgtggtgaacacagtgttcaccctggtgtctgtgctgctggtggagagagctggaagaaggaccctgcacctgctgggcctggccggcatgtgtggctgtgccatcctgatgacagtggccctgctgctgctggagcgggtgcctgccatgtcctatgtgtccatcgtggccatctttggatttgtggccttctttgaaattggccctggccccatcccctggttcatcgtggccgagctgttcagccagggccccaggcctgctgccatggctgtggccggcttcagcaactggaccagcaacttcatcatcggcatgggcttccagtatgtggccgtgggccccccagccccagccagccacacagtgggccagcgctgggccagccacagctag

SEQ ID NO: 170325 - DNA, 1338 bp, Artificial Sequence
  Description of Artificial Sequence: Synthetic coding sequence
atgcaggagcccctgctgggcgctgagggccctgactatgacaccttccctgagaagcccccacccagccctggggaccgggcccgggtgggcaccctgcagaacaagagggtcttcctggccacctttgctgctgtgctgggcaacttctcctttggctacgccctggtgtacaccagccctgtgatcccagccctggagaggagcctggaccctgacctgcacctgaccaagagccaggcctcctggtttggcagcgtcttcaccctgggcgctgctgctgggggcctgagcgccatgatcctgaatgacctgctgggcaggaagctgagcatcatgttttctgctgtgcccagcgctgctggctacgccctgatggccggggcccacggcctgtggatgctgctgctgggccgcaccctgaccggctttgctgggggcctgacagctgcctgcatccctgtgtatgtgtctgagatcgcccctcctggggtgcggggggccctgggcgccaccccccagctgatggctgtgtttggcagcctgagcctgtatgccctgggcctgctgctgccctggcgctggctggccgtggccggggaggcccctgtgctgatcatgatcctgctgctgtccttcatgcccaacagcccccgcttcctgctgagccggggcagagatgaggaggccctgcgggccctggcctggctgcggggcacagatgtggatgtgcactgggagtttgagcagatccaggacaacgtgcggcggcagagcagccgggtgtcctgggccgaggcccgggcccctcatgtgtgccggcccatcaccgtggccctgctgatgaggctgctgcagcagctgaccggcatcacccccatcctggtgtacctgcagagcatctttgacagcacagctgtgctgctgccccccaaggatgatgctgccatcgtgggcgctgtgcggctgctgtctgtgctgattgctgccctgaccatggacctggccggcaggaaggtgctgctgtttgtgtctggctatgctgtgggctggggccccatcacctggctgctgatgtctgaggtgctgcccctgcgggcccggggcgtggccagcggcctgtgtgtgctggcctcctggctgacagcctttgtgctgaccaagagcttcctgcctgtggtgtccaccttcggcctgcaggtgcccttcttcttctttgctgccatctgcctggtgtccctggtgttcaccggctgctgcgtgcctgagaccaagggccgcagcctggagcagatcgagagcttcttcagaacaggccgccgctccttcctgaggtag

SEQ ID NO: 170326 - DNA, 1524 bp, Artificial Sequence
  Description of Artificial Sequence: Synthetic coding sequence
atgcaggagcccctgctgggcgctgagggccctgactatgacaccttccctgagaagcccccacccagccctggggaccgggcccgggtgggcaccctgcagaacaagagggtcttcctggccacctttgctgctgtgctgggcaacttctcctttggctacgccctggtgtacaccagccctgtgatcccagccctggagaggagcctggaccctgacctgcacctgaccaagagccaggcctcctggtttggcagcgtcttcaccctgggcgctgctgctgggggcctgagcgccatgatcctgaatgacctgctgggcaggaagctgagcatcatgttttctgctgtgcccagcgctgctggctacgccctgatggccggggcccacggcctgtggatgctgctgctgggccgcaccctgaccggctttgctgggggcctgacagctgcctgcatccctgtgtatgtgtctgagatcgcccctcctggggtgcggggggccctgggcgccaccccccagctgatggctgtgtttggcagcctgagcctgtatgccctgggcctgctgctgccctggcgctggctggccgtggccggggaggcccctgtgctgatcatgatcctgctgctgtccttcatgcccaacagcccccgcttcctgctgagccggggcagagatgaggaggccctgcgggccctggcctggctgcggggcacagatgtggatgtgcactgggagtttgagcagatccaggacaacgtgcggcggcagagcagccgggtgtcctgggccgaggcccgggcccctcatgtgtgccggcccatcaccgtggccctgctgatgaggctgctgcagcagctgaccggcatcacccccatcctggtgtacctgcagagcatctttgacagcacagctgtgctgctgccccccaaggatgatgctgccatcgtgggcgctgtgcggctgctgtctgtgctgattgctgccctgaccatggacctggccggcaggaaggtgctgctgtttgtgtctgctgccatcatgtttgctgccaacctgaccctgggcctgtacatccacttcggcccccggcccctgagccccaacagcacagctggcctggagagcgagagctggggagacctggcccagcccctggccgccccagctggctacctgaccctggtgcccctgctggccaccatgctgttcatcatgggctatgctgtgggctggggccccatcacctggctgctgatgtctgaggtgctgcccctgcgggcccggggcgtggccagcggcctgtgtgtgctggcctcctggctgacagcctttgtgctgaccaagagcttcctgcctgtggtgtccaccttcggcctgcaggtgcccttcttcttctttgctgccatctgcctggtgtccctggtgttcaccggctgctgcgtgcctgagaccaagggccgcagcctggagcagatcgagagcttcttcagaacaggccgccgctccttcctgaggtag

SEQ ID NO: 170327 - DNA, 441 bp, Artificial Sequence
  Description of Artificial Sequence: Synthetic coding sequence
atgatcctgaatgacctgctgggcaggaagctgagcatcatgttttctgctgtgcccagcgctgctggctacgccctgatggccggggcccacggcctgtggatgctgctgctgggccgcaccctgactggatttgctgggggcctgacagctgcctgcatccctggcctgaccctgcccagcaggcctggcctgggcaccagcatcttcagcaagacctggtgtggcggctgtgtgctgcaggtgtatgtgtctgaaattgcccctcctggggtgcggggggccctgggcgccaccccccagctgatggctgtgtttggcagcctgagcctgtatgccctgggcaaggatgaggaggccctgcgggccctggcctggctgcggggcacagatgtggatgtgcactgggagtttgagcagatccaggacaacgtgaggtag

SEQ ID NO: 170328 - DNA, 660 bp, Artificial Sequence
  Description of Artificial Sequence: Synthetic coding sequence
atgcaggagcccctgctgggcgctgagggccctgactatgacaccttccctgagaagcccccacccagccctggggaccgggcccgggtgggcaccctgcagaacaagagggtcttcctggccacctttgctgctgtgctgggcaacttctcctttggctacgccctggtgtacaccagccctgtgatcccagccctggagaggagcctggaccctgacctgcacctgaccaagagccaggcctcctggtttggcagcgtcttcaccctgggcgctgctgctgggggcctgagcgccatgatcctgaatgacctgctgggcaggaagctgagcatcatgttttctgctgtgcccagcgctgctggctacgccctgatggccggggcccacggcctgtggatgctgctgctgggccgcaccctgaccggctttgctgggggcctgacagctgcctgcatccctgtgtatgtgtctgagatcgcccctcctggggtgcggggggccctgggcgccaccccccagctgatggctgtgtttggcagcctgagcctgtatgccctgggcaccaagaggccctgtggccgctggccaggctgtgtgggccgcacctccatgagcacaggcagcagcagccgcagcaggaccaccagcggggactag

SEQ ID NO: 170329 - DNA, 1539 bp, Artificial Sequence
  Description of Artificial Sequence: Synthetic coding sequence
atggagaacaaggaggccggcaccccaccacccatccccagccgggagggccgcctgcagcccaccctgctgctggccaccctgtctgctgccttcggcagcgccttccagtatggctacaacctgtctgtggtgaacaccccccacaaggtgttcaagagcttctacaatgagacctactttgaaagacatgccaccttcatggatggcaagctgatgctgctgctgtggagctgcaccgtgtccatgttccccctgggcggcctgctgggcagcctgctggtgggcctgctggtggacagctgtggcaggaagggcaccctgctgatcaacaacatctttgccatcatcccagccatcctgatgggcgtgtccaaggtggccaaggcctttgagctgattgtgttcagccgggtggtgctgggcgtgtgtgccggcatctcctacagcgccctgcccatgtacctgggggagctggcccccaagaacctgcggggcatggtgggcaccatgacagaggtgtttgtgattgtgggcgtcttcctggcccagatcttcagcctgcaggccatcctgggcaacccagctggctggcctgtgctgctggccctgactggagtgcctgccctgctgcagctgctgaccctgcccttcttccctgagagcccccgctacagcctcatccagaagggagatgaggccacagcccggcaggccctgcggcggctgcggggccacacagacatggaggccgagctggaggacatgagagctgaggcccgggcagagagagctgagggccacctgtctgtgctgcacctgtgtgccctgcggagcctgcgctggcagctgctgagcatcatcgtgctgatggccggccagcagctgagcggcatcaatgccatcaactactatgctgacaccatctacaccagcgctggggtggaggccgcccacagccagtatgtgacagtgggcagcggcgtggtgaacatcgtgatgaccatcaccagcgctgtgctggtggagcggctgggcagaagacacctgctgctggccggctacggcatctgtggcagcgcctgcctggtgctgactgtggtgctgctcttccagaacagagtgcctgagctgagctacctgggcatcatctgtgtgtttgcctacatcgccggccacagcatcggccccagccctgtgcccagcgtggtgaggacagagatcttcctgcagagcagccggcgggccgccttcatggtggatggagctgtgcactggctgaccaacttcatcatcggcttcctgttccccagcatccaggaggccatcggggcctacagcttcatcatctttgctggcatctgcctgctgacagccatctacatctacgtggtgattcctgagaccaagggcaagacctttgtggagatcaaccgcatctttgccaagaggaacagagtgaagctgcctgaggagaaggaggagaccattgatgctggccccccaacagccagccctgccaaggagaccagcttctag

SEQ ID NO: 170330 - DNA, 804 bp, Artificial Sequence
  Description of Artificial Sequence: Synthetic coding sequence
atgacctgcagcctgggcaaggtgtacatcagcgagatcgcctacccagctgtgcggggcctgctgggcagctgtgtgcagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagagcttccacctggccctgctgcggcagcccggcatctacaagcccttcatcatcggcgtgtccctgatggccttccagcagctgtctggagtgaatgctgtgatgttttatgcagagaccatctttgaggaggccaagttcaaggacagcagcctggcctctgtggtggtgggcgtcatccaggtgctcttcaccgctgtggccgccctgatcatggacagagctggaagaaggctgctgctggtgctgagcggcgtggtgatggtgttcagcaccagcgcctttggagcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggctttgctgtgggctggggccccatcccctggctgctgatgtctgagatcttcccctag

SEQ ID NO: 170331 - DNA, 645 bp, Artificial Sequence
  Description of Artificial Sequence: Synthetic coding sequence
atggccttccagcagctgtctggagtgaatgctgtgatgttttatgcagagaccatctttgaggaggccaagttcaaggacagcagcctggcctctgtggtggtgggcgtcatccaggtgctcttcaccgctgtggccgccctgatcatggacagagctggaagaaggctgctgctggtgctgagcggcgtggtgatggtgttcagcaccagcgcctttggagcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggctttgctgtgggctggggccccatcccctggctgctgatgtctgagatcttccccctgcacgtgaagggcgtggccaccggcatctgtgtgctgaccaactggctgatggccttcctggtgaccaaggagttcagcagcctgatggaggtgctgcggccctatggagccttctggctggccagcgccttctgcatcttctctgtgctcttcaccctcttctgtgtgcctgagaccaagggcaagaccctggagcagatcacagcccactttgagggccgctag

SEQ ID NO: 170332 - DNA, 1236 bp, Artificial Sequence
  Description of Artificial Sequence: Synthetic coding sequence
atgaccccagaggaccctgaggagacccagcccctgctgggccccccaggcggcagcgccccccggggccggcgggtcttcctggccgcctttgctgctgccctgggccccctgagctttggatttgccctgggctacagcagccctgccatccccagcctgcagagagctgcccccccagccccccggctggatgatgctgctgcctcctggtttggagctgtggtgaccctgggcgctgctgctgggggcgtgctgggcggctggctggtggaccgggccggcaggaagctgagcctgctgctgtgcagcgtgccctttgtggccggctttgctgtgatcacagctgcccaggatgtgtggatgctgctgggcggccgcctgctgaccggcctggcctgtggggtggccagcctggtggcccctgtgtacatcagcgagatcgcctacccagctgtgcggggcctgctgggcagctgtgtgcagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagagcttccacctggccctgctgcggcagcccggcatctacaagcccttcatcattggagtgtccctgatggccttccagcagctgagcggcgtgaatgctgtgatgttttatgcagagaccatctttgaggaggccaagttcaaggacagcagcctggcctctgtggtggtgggcgtcatccaggtgctcttcaccgctgtggccgccctgatcatggaccgggccggccggcggctgctgctggtgctgtctggagtggtgatggtgttcagcaccagcgccttcggggcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggcggcccccaggccctgtggagcctgctggcctgcctgcgcttcctgcacctgcagtgccccttccactttgtgctgtgcccctag

SEQ ID NO: 170333 - DNA, 1434 bp, Artificial Sequence
  Description of Artificial Sequence: Synthetic coding sequence
atgaccccagaggaccctgaggagacccagcccctgctgggccccccaggcggcagcgccccccggggccggcgggtcttcctggccgcctttgctgctgccctgggccccctgagctttggatttgccctgggctacagcagccctgccatccccagcctgcagagagctgcccccccagccccccggctggatgatgctgctgcctcctggtttggagctgtggtgaccctgggcgctgctgctgggggcgtgctgggcggctggctggtggaccgggccggcaggaagctgagcctgctgctgtgcagcgtgccctttgtggccggctttgctgtgatcacagctgcccaggatgtgtggatgctgctgggcggccgcctgctgaccggcctggcctgtggggtggccagcctggtggcccctgtgtacatcagcgagatcgcctacccagctgtgcggggcctgctgggcagctgtgtgcagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagagcttccacctggccctgctgcggcagcccggcatctacaagcccttcatcattggagtgtccctgatggccttccagcagctgagcggcgtgaatgctgtgatgttttatgcagagaccatctttgaggaggccaagttcaaggacagcagcctggcctctgtggtggtgggcgtcatccaggtgctcttcaccgctgtggccgccctgatcatggaccgggccggccggcggctgctgctggtgctgtctggagtggtgatggtgttcagcaccagcgccttcggggcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggctttgctgtgggctggggccccatcccctggctgctgatgtctgagatcttccccctgcacgtgaagggcgtggccaccggcatctgtgtgctgaccaactggctgatggccttcctggtgaccaaggagttcagcagcctgatggaggtgctgcggccctacggggccttctggctggccagcgccttctgcatcttctctgtgctcttcaccctcttctgtgtgcctgagaccaagggcaagaccctggagcagatcacagcccactttgagggccgctag

SEQ ID NO: 170334 - DNA, 510 bp, Artificial Sequence
  Description of Artificial Sequence: Synthetic coding sequence
tgaggaagaagagtcttcctggccgcctttgctgctgccctgggccccctgagctttggatttgccctgggctacagcagccctgccatccccagcctgcagagagctgcccccccagccccccggctggatgatgctgctgcctcctggtttggagtgtacatcagcgagatcgcctacccagctgtgcggggcctgctgggcagctgtgtgcagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagcagctgagcggcgtgaatgctgtgatgttttatgcagagaccatctttgaggagtag

SEQ ID NO: 170335 - DNA, 771 bp, Artificial Sequence
  Description of Artificial Sequence: Synthetic coding sequence
atgaccccagaggaccctgaggagacccagcccctgctgggccccccaggcggcagcgccccccggggccggcgggtcttcctggccgcctttgctgctgccctgggccccctgagctttggatttgccctgggctacagcagccctgccatccccagcctgcagagagctgcccccccagccccccggctggatgatgctgctgcctcctggtttggagtgtacatcagcgagatcgcctacccagctgtgcggggcctgctgggcagctgtgtgcagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagagcttccacctggccctgctgcggcagcccggcatctacaagcccttcatcatcggcgtgtccctgatggccttccagcagctgtctggagtgaatgctgtgatgttttatgcagagaccatctttgaggaggccaagttcaaggacagcagcctggcctctgtggtggtgggcgtcatccaggtgctcttcaccgctgtggccgccctgatcatggacagagctggaagaaggctgctgctggtgctgtcctag

SEQ ID NO: 170336 - DNA, 804 bp, Artificial Sequence; identical to SEQ ID NO: 170330
  Description of Artificial Sequence: Synthetic coding sequence

SEQ ID NO: 170337 - DNA, 831 bp, Artificial Sequence
  Description of Artificial Sequence: Synthetic coding sequence
cagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagagcttccacctggccctgctgcggcagcccggcatctacaagcccttcatcatcggcgtgtccctgatggccttccagcagctgtctggagtgaatgctgtgatgttttatgcagagaccatctttgaggaggccaagttcaaggacagcagcctggcctctgtggtggtgggcgtcatccaggtgctcttcaccgctgtggccgccctgatcatggacagagctggaagaaggctgctgctggtgctgagcggcgtggtgatggtgttcagcaccagcgcctttggagcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggctttgctgtgggctggggccccatcccctggctgctgatgtctgagatcttccccctgcacgtgaagggcgtggccaccggcatctgtgtgctgaccaactggctgatggccttcctggtgaccaaggagttcagcagcctgatgctgctgctgctgctgtag

SEQ ID NO: 170338 - DNA, 726 bp, Artificial Sequence
  Description of Artificial Sequence: Synthetic coding sequence
atgacctgcagcctgggcaaggtgtacatcagcgagatcgcctacccagctgtgcggggcctgctgggcagctgtgtgcagctgatggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagcagctgtctggagtgaatgctgtgatgttttatgcagagaccatctttgaggaggccaagttcaaggacagcagcctggcctctgtggtggtgggcgtcatccaggtgctcttcaccgctgtggccgccctgatcatggacagagctggaagaaggctgctgctggtgctgagcggcgtggtgatggtgttcagcaccagcgcctttggagcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggctttgctgtgggctggggccccatcccctggctgctgatgtctgagatcttcccctag

SEQ ID NO: 170339 - DNA, 798 bp, Artificial Sequence
  Description of Artificial Sequence: Synthetic coding sequence
atggtggtggtgggcatcctgctggcctacctggccggctgggtgctggagtggcgctggctggccgtgctgggctgtgtgccccccagcctgatgctgctgctgatgtgcttcatgcctgagaccccccgcttcctgctgacccagcaccggcggcaggaggccatggccgccctgcgcttcctgtggggcagcgagcagggctgggaggacccccccatcggggctgagcagagcttccacctggccctgctgcggcagcccggcatctacaagcccttcatcatcggcgtgtccctgatggccttccagcagctgtctggagtgaatgctgtgatgttttatgcagagaccatctttgaggaggccaagttcaaggacagcagcctggcctctgtggtggtgggcgtcatccaggtgctcttcaccgctgtggccgccctgatcatggacagagctggaagaaggctgctgctggtgctgagcggcgtggtgatggtgttcagcaccagcgcctttggagcctacttcaagctgacccagggcggccctggcaacagcagccacgtggccatcagcgcccctgtgtctgcccagcctgtggatgcctctgtgggcctggcctggctggccgtgggctccatgtgcctcttcatcgccggctttgctgtgggctggggccccatcccctggctgctgatgtctgagatcttccccctgcacgtgaagggcgtggccaccggcatctgtgtgctgaccaactggctgatggccttcctggtgaccaaggagttctag

SEQ ID NO: 170340 - DNA, 1623 bp, Artificial Sequence
  Description of Artificial Sequence: Synthetic coding sequence
atggccaggaagcagaacagaaacagcaaggagctgggcctggtgcccctgacagatgacaccagccacgccggccccccaggccctggccgggccctgctggagtgtgaccacctgcggtctggagtgcctgggggcagaagaaggaaggactggagctgcagcctgctggtggccagcctggccggggccttcggcagcagcttcctgtatggctacaacctgtctgtggtgaatgcccccaccccctacatcaaggccttctacaatgaatcctgggagaggagacatggccggcccattgatcctgacaccctgaccctgctgtggagcgtgacagtgtccatctttgccatcggcggcctggtgggcaccctgattgtgaagatgattggcaaggtgctgggcaggaagcacaccctgctggccaacaatggatttgccatctctgctgccctgctgatggcctgcagcctgcaggccggggcctttgagatgctgattgtgggccgcttcatcatgggcattgatggaggagtggccctgtctgtgctgcccatgtacctgtctgagatcagccccaaggagatccggggcagcctgggccaggtgacagccatcttcatctgcattggagtcttcaccggccagctgctgggcctgcctgagctgctgggcaaggagagcacctggccctacctgtttggagtcatcgtggtgcctgctgtggtgcagctgctgagcctgcccttcctgcctgacagcccccgctacctgctgctggagaagcacaatgaggcccgggctgtgaaggccttccagaccttcctgggcaaggcagatgtgtcccaggaggtggaggaggtgctggccgagagccgggtgcagaggagcatccggctggtgtctgtgctggagctgctgcgggccccctacgtgcgctggcaggtggtgacagtgattgtgaccatggcctgctaccagctgtgtggcctgaatgccatctggttctacaccaacagcatctttgggaaggccggcatccccccagccaagatcccctacgtgaccctgagcactggaggcatcgagaccctggccgctgtgttttctggcctggtgattgagcacctgggccggcggcccctgctgattggaggcttcggcctgatgggcctcttcttcggcaccctgaccatcaccctgaccctgcaggaccacgccccctgggtgccctacctgagcatcgtgggcatcctggccatcatcgccagcttctgcagcggccctgggggcatccccttcatcctgaccggggagttcttccagcagagccagaggcctgctgccttcatcatcgccggcaccgtgaactggctgagcaactttgctgtgggcctgctcttccccttcatccagaagagcctggacacctactgcttcctggtgtttgccaccatctgcatcaccggggccatctacctgtactttgtgctgcctgagaccaagaacagaacctacgccgagatcagccaggccttcagcaagaggaacaaggcctacccacctgaggagaagattgattctgctgtgacagatggcaagatcaatggccggccctag

SEQ ID NO: 170341 - DNA, 1536 bp, Artificial Sequence
  Description of Artificial Sequence: Synthetic coding sequence
atgaagctgagcaagaaggacagaggagaagatgaggagagtgacagcgccaagaagaagctggactggagctgcagcctgctggtggccagcctggccggggccttcggcagcagcttcctgtatggctacaacctgtctgtggtgaatgcccccaccccctacatcaaggccttctacaatgaatcctgggagcggcggcacggccggcccatcgaccctgacaccctgaccctgctgtggagcgtgacagtgtccatctttgccatcggcggcctggtgggcaccctcatcgtgaagatgattggcaaggtgctgggcaggaagcacaccctgctggccaacaacggctttgccatctctgctgccctgctgatggcctgcagcctgcaggccggggcctttgagatgctgattgtgggccgcttcatcatgggcattgatggcggcgtggccctgtctgtgctgcccatgtacctgtctgagatcagccccaaggagatccggggcagcctgggccaggtgacagccatcttcatctgcatcggggtcttcaccggccagctgctgggcctgcctgagctgctgggcaaggagagcacctggccctacctgtttggagtgattgtggtgcctgctgtggtgcagctgctgagcctgcccttcctgcctgacagcccccgctacctgctgctggagaagcacaatgaggcccgggctgtgaaggccttccagaccttcctgggcaaggcagatgtgtcccaggaggtggaggaggtgctggccgagagccgggtgcagaggagcatccggctggtgtctgtgctggagctgctgcgggccccctacgtgcgctggcaggtggtgaccgtcatcgtgaccatggcctgctaccagctgtgtggcctgaatgccatctggttctacaccaacagcatctttgggaaggccggcatccccccagccaagatcccctacgtgaccctgagcactggaggcatcgagaccctggccgctgtgttcagcggcctggtgattgagcacctgggcagaagacccctgctgattggaggcttcggcctgatgggcctcttcttcggcaccctgaccatcaccctgaccctgcaggaccacgccccctgggtgccctacctgagcatcgtgggcatcctggccatcatcgccagcttctgcagcggccctgggggcatccccttcatcctgactggagagttcttccagcagagccagaggcctgctgccttcatcatcgccggcaccgtgaactggctgagcaactttgctgtgggcctgctcttccccttcatccagaagagcctggacacctactgcttcctggtgtttgccaccatctgcatcactggagccatctacctgtactttgtgctgcctgagaccaagaacagaacctatgcagagatcagccaggccttcagcaagaggaacaaggcctacccacctgaggagaagattgacagcgctgtgacagatggcaagatcaatggccggccctag

SEQ ID NO: 170342 - DNA, 1536 bp, Artificial Sequence; identical to SEQ ID NO: 170341
  Description of Artificial Sequence: Synthetic coding sequence

SEQ ID NO: 170343 - DNA, 597 bp, Artificial Sequence
  Description of Artificial Sequence: Synthetic coding sequence
atgaagctgagcaagaaggacagaggagaagatgaggagagtgacagcgccaagaagaagctggactggagctgcagcctgctggtggccagcctggccggggccttcggcagcagcttcctgtatggctacaacctgtctgtggtgaatgcccccaccccctacatcaaggccttctacaatgaatcctgggagcggcggcacggccggcccatcgaccctgacaccctgaccctgctgtggagcgtgacagtgtccatctttgccatcggcggcctggtgggcaccctcatcgtgaagatgattggcaaggtgctgggcaggaagcacaccctgctggccaacaacggctttgccatctctgctgccctgctgatggcctgcagcctgcaggccggggcctttgagatgctgattgtgggccgcttcatcatgggcattgatggcggcgtggccctgtctgtgctgcccatgtacctgtctgagatcagccccaaggagatccggggcagcctgggccaggtgacagccatcttcatctgcatcggggtcttcaccggccagctgctgggcctgcctgagctgctgggcaagtag

SEQ ID NO: 170344 - DNA, 735 bp, Artificial Sequence
  Description of Artificial Sequence: Synthetic coding sequence
atggagcagcaggaccagagcatgaaggagggccgcctgaccctggtgctggccctggccaccctgattgctgccttcggcagcagcttccagtatggctacaacgtggccgctgtgaacagccctgccctgctgatgcagcagttctacaatgagacctactacggccgcactggagagttcatggaggacttccccctgaccctgctgtggagcgtgacagtgtccatgttcccctttggaggcttcatcggcagcctgctggtgggccccctggtgaacaagtttggaagaaaaggagccctgctcttcaacaacatcttcagcatcgtgcctgccatcctgatgggctgcagccgggtggccaccagctttgagctgatcatcatcagccggctgctggtgggcatctgtgccggcgtgagcagcaatgtggtgcccatgtacctgggggagctggcccccaagaacctgcggggggccctgggcgtggtgccccagctgttcatcaccgtgggcatcctggtggcccagatcttcggcctgaggaacctgctggccaacgtggatggagagttccgcaccagccgggagcacccccaccccttcaccaccaccctgggccccctgctggtgttccagagccaccaccacaggacaggcctgtctgctgactggagcctgctgaccggctggatgagcctgggcggccccagctgcccagagcccacctag

SEQ ID NO: 170345 - DNA, 1506 bp, Artificial Sequence
  Description of Artificial Sequence: Synthetic coding sequence
atggagcagcaggaccagagcatgaaggagggccgcctgaccctggtgctggccctggccaccctgattgctgccttcggcagcagcttccagtatggctacaacgtggccgctgtgaacagccctgccctgctgatgcagcagttctacaatgagacctactacggccgcactggagagttcatggaggacttccccctgaccctgctgtggagcgtgacagtgtccatgttcccctttggaggcttcatcggcagcctgctggtgggccccctggtgaacaagtttggaagaaaaggagccctgctcttcaacaacatcttcagcatcgtgcctgccatcctgatgggctgcagccgggtggccaccagctttgagctgatcatcatcagccggctgctggtgggcatctgtgccggcgtgagcagcaatgtggtgcccatgtacctgggggagctggcccccaagaacctgcggggggccctgggcgtggtgccccagctgttcatcaccgtgggcatcctggtggcccagatcttcggcctgaggaacctgctggccaacgtggatggctggcccatcctgctgggcctgactggagtgcctgctgccctgcagctgctgctgctgcccttcttccctgagagcccccgctacctgctgatccagaagaaggatgaggccgccgccaagaaggccctgcagaccctgcggggctgggacagcgtggaccgggaggtggccgagatccggcaggaggatgaggccgagaaggccgccggcttcatctctgtgctgaagctgttcaggatgaggagcctgcgctggcagctgctgagcatcatcgtgctgatgggcggccagcagctgtctggagtgaatgccatctactactatgctgaccagatctacctgtctgctggggtgcctgaggagcacgtgcagtatgtgacagctggcactggagctgtgaatgtggtgatgaccttctgtgctgtgtttgtggtggagctgctgggccgccgcctgctgctgctgctgggcttcagcatctgcctgattgcctgctgcgtgctgacagctgccctggccctgcaggacacagtgtcctggatgccctacatcagcatcgtgtgtgtgatctcctatgtgattggacatgccctgggccccagccccatcccagccctgctgatcacagagatcttcctgcagagcagccggcccagcgccttcatggtgggcggctctgtgcactggctgagcaacttcaccgtgggcctcatcttccccttcatccaggagggcctgggcccctacagcttcatcgtgtttgctgtgatctgcctgctgaccaccatctacatcttcctgattgtgcctgagaccaaggccaagaccttcatcgagatcaaccagatcttcaccaagatgaacaaggtgtctgaggtgtacccagagaaggaggagctgaaggagctgccccctgtgaccagcgagcagtag

SEQ ID NO: 170346 - DNA, 1455 bp, Artificial Sequence
  Description of Artificial Sequence: Synthetic coding sequence
atggagcagcaggaccagagcatgaaggagggccgcctgaccctggtgctggccctggccgctgtgaacagccctgccctgctgatgcagcagttctacaatgagacctactacggccgcactggagagttcatggaggacttccccctgaccctgctgtggagcgtgacagtgtccatgttcccctttggaggcttcatcggcagcctgctggtgggccccctggtgaacaagtttggaaggaagggggccctgctcttcaacaacatcttcagcatcgtgcctgccatcctgatgggctgcagccgggtggccaccagctttgagctgatcatcatcagccggctgctggtgggcatctgtgccggcgtgagcagcaatgtggtgcccatgtacctgggggagctggcccccaagaacctgcggggggccctgggcgtggtgccccagctgttcatcaccgtgggcatcctggtggcccagatcttcggcctgaggaacctgctggccaacgtggatggctggcccatcctgctgggcctgactggagtgcctgctgccctgcagctgctgctgctgcccttcttccctgagagcccccgctacctgctgatccagaagaaggatgaagctgctgccaagaaggccctgcagaccctgcggggctgggacagcgtggaccgggaggtggccgagatccggcaggaggatgaagctgagaaggctgctggcttcatctctgtgctgaagctgttcaggatgaggagcctgcgctggcagctgctgagcatcatcgtgctgatgggcggccagcagctgagcggcgtgaatgccatctactactatgctgaccagatctacctgtctgctggggtgcctgaggagcacgtgcagtatgtgacagctggcaccggggctgtgaatgtggtgatgaccttctgtgctgtgtttgtggtggagctgctgggccggcggctgctgctgctgctgggcttcagcatctgcctgattgcctgctgcgtgctgacagctgccctggccctgcaggacacagtgtcctggatgccctacatcagcatcgtgtgtgtgatctcctatgtgattggccacgccctgggccccagccccatcccagccctgctgatcacagagatcttcctgcagagcagccggcccagcgccttcatggtgggcggctctgtgcactggctgagcaacttcaccgtgggcctcatcttccccttcatccaggagggcctgggcccctacagcttcatcgtgtttgctgtgatctgcctgctgaccaccatctacatcttcctgattgtgcctgagaccaaggccaagaccttcatcgagatcaaccagatcttcaccaagatgaacaaggtgtctgaggtgtacccagagaaggaggagctgaaggagctgccccctgtgaccagcgagcagtag

SEQ ID NO: 170347 - DNA, 1161 bp, Artificial Sequence
  Description of Artificial Sequence: Synthetic coding sequence
atgggctgcagccgggtggccaccagctttgagctgatcatcatcagccggctgctggtgggcatctgtgccggcgtgagcagcaatgtggtgcccatgtacctgggggagctggcccccaagaacctgcggggggccctgggcgtggtgccccagctgttcatcaccgtgggcatcctggtggcccagatcttcggcctgaggaacctgctggccaacgtggatggctggcccatcctgctgggcctgactggagtgcctgctgccctgcagctgctgctgctgcccttcttccctgagagcccccgctacctgctgatccagaagaaggatgaagctgctgccaagaaggccctgcagaccctgcggggctgggacagcgtggaccgggaggtggccgagatccggcaggaggatgaagctgagaaggctgctggcttcatctctgtgctgaagctgttcaggatgaggagcctgcgctggcagctgctgagcatcatcgtgctgatgggcggccagcagctgagcggcgtgaatgccatctactactatgctgaccagatctacctgtctgctggggtgcctgaggagcacgtgcagtatgtgacagctggcaccggggctgtgaatgtggtgatgaccttctgtgctgtgtttgtggtggagctgctgggccggcggctgctgctgctgctgggcttcagcatctgcctgattgcctgctgcgtgctgacagctgccctggccctgcaggacacagtgtcctggatgccctacatcagcatcgtgtgtgtgatctcctatgtgattggccacgccctgggccccagccccatcccagccctgctgatcacagagatcttcctgcagagcagccggcccagcgccttcatggtgggcggctctgtgcactggctgagcaacttcaccgtgggcctcatcttccccttcatccaggagggcctgggcccctacagcttcatcgtgtttgctgtgatctgcctgctgaccaccatctacatcttcctgattgtgcctgagaccaaggccaagaccttcatcgagatcaaccagatcttcaccaagatgaacaaggtgtctgaggtgtacccagagaaggaggagctgaaggagctgccccctgtgaccagcgagcagtag

SEQ ID NO: 170348 - DNA, 1329 bp, Artificial Sequence
  Description of Artificial Sequence: Synthetic coding sequence
atgctggagctgcacagcctgacagccagcagcatcatgagggtgctgatcatgagggcccccctgcgggaggcccctcctgagaagtttgccctgctgctgagcggcagccctgggaagggggccctgctcttcaacaacatcttcagcatcgtgcctgccatcctgatgggctgcagccgggtggccaccagctttgagctgatcatcatcagccggctgctggtgggcatctgtgccggcgtgagcagcaatgtggtgcccatgtacctgggggagctggcccccaagaacctgcggggggccctgggcgtggtgccccagctgttcatcaccgtgggcatcctggtggcccagatcttcggcctgaggaacctgctggccaacgtggatggctggcccatcctgctgggcctgactggagtgcctgctgccctgcagctgctgctgctgcccttcttccctgagagcccccgctacctgctgatccagaagaaggatgaagctgctgccaagaaggccctgcagaccctgcggggctgggacagcgtggaccgggaggtggccgagatccggcaggaggatgaagctgagaaggctgctggcttcatctctgtgctgaagctgttcaggatgaggagcctgcgctggcagctgctgagcatcatcgtgctgatgggcggccagcagctgagcggcgtgaatgccatctactactatgctgaccagatctacctgtctgctggggtgcctgaggagcacgtgcagtatgtgacagctggcaccggggctgtgaatgtggtgatgaccttctgtgctgtgtttgtggtggagctgctgggccggcggctgctgctgctgctgggcttcagcatctgcctgattgcctgctgcgtgctgacagctgccctggccctgcaggacacagtgtcctggatgccctacatcagcatcgtgtgtgtgatctcctatgtgattggccacgccctgggccccagccccatcccagccctgctgatcacagagatcttcctgcagagcagccggcccagcgccttcatggtgggcggctctgtgcactggctgagcaacttcaccgtgggcctcatcttccccttcatccaggagggcctgggcccctacagcttcatcgtgtttgctgtgatctgcctgctgaccaccatctacatcttcctgattgtgcctgagaccaaggccaagaccttcatcgagatcaaccagatcttcaccaagatgaacaaggtgtctgaggtgtacccagagaaggaggagctgaaggagctgccccctgtgaccagcgagcagtag

SEQ ID NO: 170349 - DNA, 2040 bp, Artificial Sequence
  Description of Artificial Sequence: Synthetic coding sequence
atggccaccctcatcaccagcaccacagctgccacagctgccagcggccccctggtggactacctgtggatgctgatcctgggcttcatcatcgcctttgtgctggccttctctgtgggcgccaatgatgtggccaacagctttggaacagctgtgggcagcggcgtggtgaccctgaagcaggcctgcatcctggccagcatctttgaaacagtgggctctgtgctgctgggcgccaaggtgtctgagaccatcaggaagggcctgattgatgtggagatgtacaacagcacccagggcctgctgatggccggctctgtgtctgccatgtttggatctgctgtgtggcagctggtggccagcttcctgaagctgcccatcagcggcacccactgcatcgtgggcgccaccatcggcttcagcctggtggccaagggccaggagggcgtgaagtggagcgagctgatcaagatcgtgatgtcctggtttgtgagccccctgctgagcggcatcatgagcggcatcctcttcttcctggtgcgggccttcatcctgcacaaggctgaccctgtgcccaacggcctgcgggccctgcctgtgttctacgcctgcaccgtgggcatcaacctcttcagcatcatgtacaccggggcccccctgctgggctttgacaagctgcccctgtggggcaccatcctgatctctgtgggctgtgctgtgttctgtgccctgattgtgtggttctttgtgtgccccaggatgaagaggaagattgaaagagagatcaagtgcagccccagcgagagccccctgatggagaagaagaacagcctgaaggaggaccacgaggagaccaagctgtctgtgggggacatcgagaacaagcaccctgtgtctgaggtgggccctgccaccgtgcccctgcaggccgtggtggaggagaggacagtgtccttcaagctgggggacctggaggaggcccctgagcgggagcggctgcccagcgtggacctgaaggaggagaccagcattgacagcacagtgaatggagctgtgcagctgcccaacggcaacctggtgcagttcagccaggccgtgagcaaccagatcaacagcagcggccactaccagtaccacacagtgcacaaggacagcggcctgtacaaggagctgctgcacaagctgcacctggccaaggtgggggactgcatgggagacagcggggacaagcccctgcggaggaacaacagctacaccagctacaccatggccatctgtggcatgcccctggacagcttccgggccaaggagggggagcagaagggggaggagatggagaagctgacctggcccaatgctgacagcaagaagaggatccgcatggacagctacaccagctactgcaatgctgtgtctgacctgcacagcgccagcgagattgacatgtctgtgaaggccgagatgggcctgggggacaggaagggcagcaatggcagcctggaggagtggtatgaccaggacaagccagaggtgtccctgctcttccagttcctgcagatcctgacagcctgcttcggcagctttgcccacggcggcaatgatgtgtccaatgccatcggccccctggtggccctgtacctggtgtatgacacaggagatgtgagcagcaaggtggccacccccatctggctgctgctgtatggaggagtgggcatctgtgtgggcctgtgggtgtggggcagaagagtcatccagaccatgggcaaggacctgacccccatcacccccagcagcggcttcagcattgagctggccagcgccctgactgtggtgattgccagcaacatcggcctgcccatcagcaccacccactgcaaggtgggctctgtggtgtctgtgggctggctgcggagcaagaaggctgtggactggaggctcttcaggaacatcttcatggcctggtttgtgacagtgcccatctctggagtcatctctgctgccatcatggccatcttccgctacgtgatcctgaggatgtag

SEQ ID NO: 170350 - DNA, 1137 bp, Artificial Sequence
  Description of Artificial Sequence: Synthetic coding sequence
atgggcaaccccagcgtgccccggggcggcttcacccagtactgccggggcctgctgccctggggcttccaggatgcccccttctacctgctggtgctgggctttgacaagctgcccctgtggggcaccatcctgatctctgtgggctgtgctgtgttctgtgccctgattgtgtggttctttgtgtgccccaggatgaagaggaagattgaaagagagatcaagtgcagccccagcgagagccccctgatggagaagaagaacagcctgaaggaggaccacgaggagaccaagctgtctgtgggggacatcgagaacaagcaccctgtgtctgaggtgggccctgccaccgtgcccctgcaggccgtggtggaggagaggacagtgtccttcaagctgggggacctggaggaggcccctgagcgggagcggctgcccagcgtggacctgaaggaggagaccagcattgacagcacagtgaatggagctgtgcagctgcccaacggcaacctggtgcagttcagccaggccgtgagcaaccagatcaacagcagcggccactaccagtaccacacagtgcacaaggacagcggcctgtacaaggagctgctgcacaagctgcacctggccaaggtgggggactgcatgggagacagcggggacaagcccctgcggaggaacaacagctacaccagctacaccatggccatctgtggcatgcccctggacagcttccgggccaaggagggggagcagaagggggaggagatggagaagctgacctggcccaatgctgacagcaagaagaggatccgcatggacagctacaccagctactgcaatgctgtgtctgacctgcacagcgccagcgagattgacatgtctgtgaaggccgagatgggcctgggggacaggaagggcagcaatggcagcctggaggagtggtatgaccaggacaagccagaggtgtccctgctcttccagttcctgcagatcctgacagcctgcttcggcagctttgcccacggcggcaatgatgtgtccaatgccatcggccccctggtggccctgtacctggtgtatgacacaggagatgtgagcagcaaggtggccacccccatctggctgctgtgctag

SEQ ID NO: 170351 - DNA, 1959 bp, Artificial Sequence
  Description of Artificial Sequence: Synthetic coding sequence
atggccatggatgagtacctgtggatggtgatcctgggcttcatcatcgccttcatcctggccttctctgtgggcgccaatgatgtggccaacagctttggaacagctgtgggcagcggcgtggtgaccctgcggcaggcctgcatcctggccagcatctttgagaccactggatctgtgctgctgggcgccaaggtgggggagaccatcaggaagggcatcattgatgtgaacctgtacaatgaaacagtggagaccctgatggccggggaggtgtctgccatggtgggcagcgctgtgtggcagctgattgccagcttcctgcggctgcccatcagcggcacccactgcatcgtgggcagcaccatcggcttcagcctggtggccatcggcaccaagggcgtgcagtggatggagctggtgaagatcgtggcctcctggttcatcagccccctgctgagcggcttcatgagcggcctgctgtttgtgctgatccgcatcttcatcctgaagaaggaggaccctgtgcccaacggcctgcgggccctgcccgtcttctacgccgccaccatcgccatcaacgtgttcagcatcatgtacacaggagcccctgtgctgggcctggtgctgcccatgtgggccatcgccctgatcagctttggagtggccctgctgtttgccttctttgtgtggctgtttgtgtgcccctggatgaggaggaagatcaccgggaagctgcagaaggagggcgccctgagccgggtgtctgatgagagcctgagcaaggtgcaggaggccgagagccctgtgttcaaggagctgcccggggccaaggccaatgatgacagcaccatccccctgaccggggctgctggggagaccctgggcaccagcgagggcaccagcgctggcagccaccccagggctgcctacggccgggccctgtccatgacccacggctctgtgaagagccccatcagcaatggcacctttggatttgatggccacaccaggagtgatggccacgtgtaccacacagtgcacaaggacagcggcctgtacaaggacctgctgcacaagatccacatcgaccggggccctgaggagaagccagcccaggagagcaactaccgcctgctgcggaggaacaacagctacacctgctacacagctgccatctgtggcctgcctgtgcacgccaccttccgggctgctgacagcagcgccccagaagattctgagaagctggtgggggacacagtgtcctacagcaagaagaggctgcgctatgacagctacagcagctactgcaatgctgtggccgaggccgagattgaagctgaggagggcggcgtggagatgaagctggccagcgagctggccgaccctgaccagccccgggaggaccctgctgaggaggagaaggaggagaaggatgcccctgaggtgcacctgctcttccacttcctgcaggtgctgacagcctgcttcggcagctttgcccacggcggcaatgatgtgtccaatgccatcggccccctggtggccctgtggctgatctacaagcagggcggcgtgacccaggaggccgccacccctgtgtggctgctcttctatggaggagtgggcatctgcaccggcctgtgggtgtggggcagaagagtcatccagaccatgggcaaggacctgacccccatcacccccagcagcggcttcaccatcgagctggccagcgccttcaccgtggtgattgccagcaacatcggcctgcctgtgtccaccacccactgcaaggtgggctctgtggtggccgtgggctggatccgcagcaggaaggctgtggactggaggctcttcaggaacatctttgtggcctggtttgtgacagtgcctgtggccggcctcttctctgctgctgtgatggccctgctgatgtatggcatcctgccctacgtgtag

SEQ ID NO: 170352 - DNA, 216 bp, Artificial Sequence
  Description of Artificial Sequence: Synthetic coding sequence
atggccatggatgagtacctgtggatggtgatcctgggcttcatcatcgccttcatcctggccttctctgtgggcgccaatgatgtggccaacagctttggaacagctgtgggcagcggcgtggtgaccctgcggcaggcctgcatcctggccagcatctttgagaccactggatctgtgctgctgggcgccaaggtgggggagaccatcagatag

SEQ ID NO: 170353 - DNA, 87 bp, Artificial Sequence
  Description of Artificial Sequence: Synthetic coding sequence
atggccatggatgagtacctgtggatggtgatcctgggcttcatcatcgccttcatcctggccttctctgtgggcgccaatgactag

SEQ ID NO: 170354 - DNA, 237 bp, Artificial Sequence
  Description of Artificial Sequence: Synthetic coding sequence
atggccatggatgagtacctgtggatggtgatcctgggcttcatcatcgccttcatcctggccttctctgtgggcgccaatgatgtggccaacagctttggaacagctgtgggcagcggcgtggtgaccctgcggcaggcctgcatcctggccagcatctttgagaccactggatctgtgctgctgggcgccaaggtgggggagaccatcaggaagggcatcattgatgtgaactag

SEQ ID NO: 170355 - DNA, 1959 bp, Artificial Sequence; identical to SEQ ID NO: 170351
  Description of Artificial Sequence: Synthetic coding sequence

SEQ ID NO: 170356 - DNA, 1959 bp, Artificial Sequence; identical to SEQ ID NO: 170351
  Description of Artificial Sequence: Synthetic coding sequence

SEQ ID NO: 170357 - DNA, 144 bp, Artificial Sequence
  Description of Artificial Sequence: Synthetic coding sequence
atggccatggatgagtacctgtggatggtgatcctgggcttcatcatcgccttcatcctggccttctctgtgggcgccaatgatgtggccaacagctttggaacagctgtgggcagcggcgtggtgaccctgcggcaggcctag

SEQ ID NO: 170358 - DNA, 1260 bp, Artificial Sequence
  Description of Artificial Sequence: Synthetic coding sequence
atggcccagagcatcttcatggccggcatcctgattggaggcctggtgctgggggacctgagtgaccgcttcggccggcggcccatcctgacctgcagctacctgctgctggccgccagcggcagcggggccgccttcagccccaccttccccatctacatggtgttccgcttcctgtgtggcttcggcatcagcggcatcaccctgagcaccgtcatcctgaatgtggagtgggtgcccaccaggatgagggccatcatgagcacagccctgggctactgctacaccttcggccagttcatcctgcccggcctggcctatgccatcccccagtggcgctggctgcagctgactgtgtccatccccttctttgtgttcttcctgagctcctggtggaccccagagagcatccgctggctggtgctgagcggcaagagcagcaaggccctgaagatcctgcggcgggtggccgtgttcaacgggaagaaggaggagggggagcggctgagcctggaggagctgaagctgaacctgcagaaggagatcagcctggccaaggccaagtacacagccagtgacctcttccgcatccccatgctgcggaggatgaccttctgcctgagcctggcctggtttgccaccggctttgcctactacagcctggccatgggcgtggaggagtttggagtgaacctgtacatcctgcagatcatctttggaggagtggatgtgcctgccaagttcatcaccatcctgagcctgagctacctgggccgccacaccacccaggccgccgccctgctgctggccggcggggccatcctggccctgacctttgtgcccctggacctgcagacagtgaggacagtgctggccgtgtttgggaagggctgcctgagcagcagcttcagctgcctcttcctgtacaccagcgagctgtaccccaccgtcatccggcagacaggcatgggcgtgagcaacctgtggaccagggtgggctccatggtgagccccctggtgaagatcactggagaggtgcagcccttcatccccaacatcatctacggcatcacagccctgctgggcggcagcgctgccctcttcctgcctgagaccctgaaccagcccctgcctgagaccatcgaggacctggagaactggagcctgcgggccaagaagcccaagcaggagcctgaggtggagaaggccagccagaggatccccctgcagccccacggccctggcctgggcagcagctag

SEQ ID NO: 170359 - DNA, 1356 bp, Artificial Sequence
  Description of Artificial Sequence: Synthetic coding sequence
atggagccctgcctggatggctgggtgtacaacagcaccaaggacagcatcgtgacagagtgggacctggtgtgcaacagcaacaagctgaaggagatggcccagagcatcttcatggccggcatcctgattggaggcctggtgctgggggacctgagtgaccgcttcggccggcggcccatcctgacctgcagctacctgctgctggccgccagcggcagcggggccgccttcagccccaccttccccatctacatggtgttccgcttcctgtgtggcttcggcatcagcggcatcaccctgagcaccgtcatcctgaatgtggagtgggtgcccaccaggatgagggccatcatgagcacagccctgggctactgctacaccttcggccagttcatcctgcccggcctggcctatgccatcccccagtggcgctggctgcagctgactgtgtccatccccttctttgtgttcttcctgagctcctggtggaccccagagagcatccgctggctggtgctgagcggcaagagcagcaaggccctgaagatcctgcggcgggtggccgtgttcaacgggaagaaggaggagggggagcggctgagcctggaggagctgaagctgaacctgcagaaggagatcagcctggccaaggccaagtacacagccagtgacctcttccgcatccccatgctgcggaggatgaccttctgcctgagcctggcctggtttgccaccggctttgcctactacagcctggccatgggcgtggaggagtttggagtgaacctgtacatcctgcagatcatctttggaggagtggatgtgcctgccaagttcatcaccatcctgagcctgagctacctgggccgccacaccacccaggccgccgccctgctgctggccggcggggccatcctggccctgacctttgtgcccctggacctgcagacagtgaggacagtgctggccgtgtttgggaagggctgcctgagcagcagcttcagctgcctcttcctgtacaccagcgagctgtaccccaccgtcatccggcagacaggcatgggcgtgagcaacctgtggaccagggtgggctccatggtgagccccctggtgaagatcactggagaggtgcagcccttcatccccaacatcatctacggcatcacagccctgctgggcggcagcgctgccctcttcctgcctgagaccctgaaccagcccctgcctgagaccatcgaggacctggagaactggagcctgcgggccaagaagcccaagcaggagcctgaggtggagaaggccagccagaggatccccctgcagccccacggccctggcctgggcagcagctag

SEQ ID NO: 170360 - DNA, 1653 bp, Artificial Sequence
  Description of Artificial Sequence: Synthetic coding sequence
atggccttcaatgacctgctgcagcaggtgggcggcgtgggccgcttccagcagatccaggtgaccctggtggtgctgcccctgctgctgatggccagccacaacaccctgcagaacttcaccgctgccatccccacccaccactgccggcccccagcagatgccaacctgagcaagaatggaggcctggaggtgtggctgccccgggaccggcagggccagcctgagagctgcctgcgcttcaccagcccccagtggggcctgcccttcctgaatggaacagaggccaatggaactggagccacagagccctgcacagatggctggatctatgacaacagcaccttccccagcaccatcgtgacagagtgggacctggtgtgcagccaccgggccctgcggcagctggcccagagcctgtacatggtgggcgtgctgctgggcgccatggtgtttggctacctggccgaccggctgggccgcaggaaggtgctgatcctgaactacctgcagacagctgtgtctggcacctgtgccgcctttgcccccaacttccccatctactgtgccttccggctgctgagcggcatggccctggccggcatcagcctgaactgcatgaccctgaatgtggagtggatgcccatccacacccgggcctgtgtgggcaccctcatcggctacgtgtacagcctgggccagttcctgctggccggcgtggcctatgctgtgccccactggaggcacctgcagctgctggtgtctgcccccttctttgccttcttcatctacagctggttcttcattgaaagtgcccgctggcacagcagcagcggccgcctggacctgaccctgcgggccctgcagagggtggcccgcatcaatggcaagcgggaggagggcgccaagctgtccatggaggtgctgcgggccagcctgcagaaggagctgaccatgggcaagggccaggccagcgccatggagctgctgcgctgccccaccctgcggcacctgttcctgtgcctgtccatgctgtggtttgccaccagctttgcctactacggcctggtgatggacctgcagggctttggagtgtccatctacctgatccaggtgatctttggagctgtggacctgcctgccaagctggtgggcttcctggtgatcaacagcctgggccggcggcctgcccagatggccgccctgctgctggccggcatctgcatcctgctgaatggagtcatcccccaggaccagagcatcgtgaggaccagcctggccgtgctgggcaagggctgcctggccgccagcttcaactgcatcttcctgtacacaggagagctgtaccccaccatgatccggcagacaggcatgggcatgggcagcaccatggcccgggtgggcagcatcgtgagccccctggtgtccatgacagctgagctgtaccccagcatgcccctcttcatctacggggctgtgcctgtggccgccagcgctgtgacagtgctgctgcctgagaccctgggccagcccctgcctgacacagtgcaggacctggagagcaggaagggcaagcagacccggcagcagcaggagcaccagaagtacatggtgcccctgcaggccagcgcccaggagaagaatggcctgtag

SEQ ID NO: 170361 - DNA, 1692 bp, Artificial Sequence
  Description of Artificial Sequence: Synthetic coding sequence
atggccttcaatgacctgctgcagcaggtgggcggcgtgggccgcttccagcagatccaggtgaccctggtggtgctgcccctgctgctgatggccagccacaacaccctgcagaacttcaccgctgccatccccacccaccactgccggcccccagcagatgccaacctgagcaagaatggaggcctggaggtgtggctgccccgggaccggcagggccagcctgagagctgcctgcgcttcaccagcccccagtggggcctgcccttcctgaatggaacagaggccaatggaactggagccacagagccctgcacagatggctggatctatgacaacagcaccttccccagcaccatcgtgacagagtgggacctggtgtgcagccaccgggccctgcggcagctggcccagagcctgtacatggtgggcgtgctgctgggcgccatggtgtttggctacctggccgaccggctgggccgcaggaaggtgctgatcctgaactacctgcagacagctgtgtctggcacctgtgccgcctttgcccccaacttccccatctactgtgccttccggctgctgagcggcatggccctggccggcatcagcctgaactgcatgaccctgaatgtggagtggatgcccatccacacccgggcctgtgtgggcaccctcatcggctacgtgtacagcctgggccagttcctgctggccggcgtggcctatgctgtgccccactggaggcacctgcagctgctggtgtctgcccccttctttgccttcttcatctacagctggttcttcattgaaagtgcccgctggcacagcagcagcggccgcctggacctgaccctgcgggccctgcagagggtggcccgcatcaatggcaagcgggaggagggcgccaagctgtccatggaggtgctgcgggccagcctgcagaaggagctgaccatgggcaagggccaggccagcgccatggagctgctgcgctgccccaccctgcggcacctgttcctgtgcctgtccatgctgtggtttgccaccagctttgcctactacggcctggtgatggacctgcagggctttggagtgtccatctacctgatccaggtgatctttggagctgtggacctgcctgccaagctggtgggcttcctggtgatcaacagcctgggccggcggcctgcccagatggccgccctgctgctggccggcatctgcatcctgctgaatggagtcatcccccaggaccagagcatcgtgaggaccagcctggccgtgctgggcaagggctgcctggccgccagcttcaactgcatcttcctgtacacaggagagctgtaccccaccatgatccggcagacaggcatgggcatgggcagcaccatggcccgggtgggcagcatcgtgagccccctggtgtccatgacagctgagctgtaccccagcatgcccctcttcatctacggggctgtgcctgtggccgccagcgctgtgacagtgctgctgcctgagaccctgggccagcccctgcctgacacagtgcaggacctggagagccgctgggcccccacccagaaggaggccggcatctaccccaggaagggcaagcagacccggcagcagcaggagcaccagaagtacatggtgcccctgcaggccagcgcccaggagaagaatggcctgtag

SEQ ID NO: 170362 - DNA, 1590 bp, Artificial Sequence
  Description of Artificial Sequence: Synthetic coding sequence
atggccttcaatgacctgctgctgctgatggccagccacaacaccctgcagaacttcaccgctgccatccccacccaccactgccggcccccagcagatgccaacctgagcaagaatggaggcctggaggtgtggctgccccgggaccggcagggccagcctgagagctgcctgcgcttcaccagcccccagtggggcctgcccttcctgaatggaacagaggccaacggcaccggggccacagagccctgcacagatggctggatctatgacaacagcaccttccccagcaccatcgtgacagagtgggacctggtgtgcagccaccgggccctgcggcagctggcccagagcctgtacatggtgggcgtgctgctgggcgccatggtgtttggctacctggccgaccggctgggccgcaggaaggtgctgatcctgaactacctgcagacagctgtgtctggcacctgtgccgcctttgcccccaacttccccatctactgtgccttccggctgctgagcggcatggccctggccggcatcagcctgaactgcatgaccctgaatgtggagtggatgcccatccacacccgggcctgtgtgggcaccctgattggctacgtgtacagcctgggccagttcctgctggccggcgtggcctatgctgtgccccactggaggcacctgcagctgctggtgtctgcccccttctttgccttcttcatctacagctggttcttcatcgagagcgcccgctggcacagcagcagcggccgcctggacctgaccctgcgggccctgcagagggtggcccgcatcaacgggaagcgggaggagggcgccaagctgtccatggaggtgctgcgggccagcctgcagaaggagctgaccatgggcaagggccaggccagcgccatggagctgctgcgctgccccaccctgcggcacctgttcctgtgcctgtccatgctgtggtttgccaccagctttgcctactacggcctggtgatggacctgcagggcttcggcgtgtccatctacctgatccaggtgatctttggagctgtggacctgcctgccaagctggtgggcttcctggtgatcaacagcctgggcagaagacctgcccagatggccgccctgctgctggccggcatctgcatcctgctgaatggagtcatcccccaggaccagagcatcgtgaggaccagcctggccgtgctgggcaagggctgcctggccgccagcttcaactgcatcttcctgtacaccggggagctgtaccccaccatgatccggcagacaggcatgggcatgggcagcaccatggcccgggtgggcagcatcgtgagccccctggtgtccatgacagctgagctgtaccccagcatgcccctcttcatctatggagctgtgcctgtggccgccagcgctgtgacagtgctgctgcctgagaccctgggccagcccctgcctgacacagtgcaggacctggagagcaggaagggcaagcagacccggcagcagcaggagcaccagaagtacatggtgcccctgcaggccagcgcccaggagaagaatggcctgtag

SEQ ID NO: 170363 - DNA, 1560 bp, Artificial Sequence
  Description of Artificial Sequence: Synthetic coding sequence
atggccttcaatgacctgctgcagcaggtgggcggcgtgggccgcttccagcagatccaggtgaccctggtggtgctgcccctgctgctgatggccagccacaacaccctgcagaacttcaccgctgccatccccacccaccactgccggcccccagcagatgccaacctgagcaagaatggaggcctggaggtgtggctgccccgggaccggcagggccagcctgagagctgcctgcgcttcaccagcccccagtggggcctgcccttcctgaatggaacagaggccaatggaactggagccacagagccctgcacagatggctggatctatgacaacagcaccttccccagcaccatcgtgacagagtgggacctggtgtgcagccaccgggccctgcggcagctggcccagagcctgtacatggtgggcgtgctgctgggcgccatggtgtttggctacctggccgaccggctgggccgcaggaaggtgctgatcctgaactacctgcagacagctgtgtctggcacctgtgccgcctttgcccccaacttccccatctactgtgccttccggctgctgagcggcatggccctggccggcatcagcctgaactgcatgaccctgaatgtggagtggatgcccatccacacccgggcctgtgtgggcaccctcatcggctacgtgtacagcctgggccagttcctgctggccggcgtggcctatgctgtgccccactggaggcacctgcagctgctggtgtctgcccccttctttgccttcttcatctacagctggttcttcattgaaagtgcccgctggcacagcagcagcggccgcctggacctgaccctgcgggccctgcagagggtggcccgcatcaatggcaagcgggaggagggcgccaagctgtccatggaggtgctgcgggccagcctgcagaaggagctgaccatgggcaagggccaggccagcgccatggagctgctgcgctgccccaccctgcggcacctgttcctgtgcctgtccatgctgtggtttgccaccagctttgcctactacggcctggtgatggacctgcagggctttggagtgtccatctacctgatccaggtgatctttggagctgtggacctgcctgccaagctggtgggcttcctggtgatcaacagcctgggccggcggcctgcccagatggccgccctgctgctggccggcatctgcatcctgctgaatggagtcatcccccaggaccagagcatcgtgaggaccagcctggccgtgctgggcaagggctgcctggccgccagcttcaactgcatcttcctgtacacaggagagctgtaccccaccatgatccgggctgtgacagtgctgctgcctgagaccctgggccagcccctgcctgacacagtgcaggacctggagagccgctgggcccccacccagaaggaggccggcatctaccccaggaagggcaagcagacccggcagcagcaggagcaccagaagtacatggtgcccctgcaggccagcgcccaggagaagaatggcctgtag

SEQ ID NO: 170364 - DNA, 1521 bp, Artificial Sequence
  Description of Artificial Sequence: Synthetic coding sequence
atggccttcaatgacctgctgcagcaggtgggcggcgtgggccgcttccagcagatccaggtgaccctggtggtgctgcccctgctgctgatggccagccacaacaccctgcagaacttcaccgctgccatccccacccaccactgccggcccccagcagatgccaacctgagcaagaatggaggcctggaggtgtggctgccccgggaccggcagggccagcctgagagctgcctgcgcttcaccagcccccagtggggcctgcccttcctgaatggaacagaggccaatggaactggagccacagagccctgcacagatggctggatctatgacaacagcaccttccccagcaccatcgtgacagagtgggacctggtgtgcagccaccgggccctgcggcagctggcccagagcctgtacatggtgggcgtgctgctgggcgccatggtgtttggctacctggccgaccggctgggccgcaggaaggtgctgatcctgaactacctgcagacagctgtgtctggcacctgtgccgcctttgcccccaacttccccatctactgtgccttccggctgctgagcggcatggccctggccggcatcagcctgaactgcatgaccctgaatgtggagtggatgcccatccacacccgggcctgtgtgggcaccctcatcggctacgtgtacagcctgggccagttcctgctggccggcgtggcctatgctgtgccccactggaggcacctgcagctgctggtgtctgcccccttctttgccttcttcatctacagctggttcttcattgaaagtgcccgctggcacagcagcagcggccgcctggacctgaccctgcgggccctgcagagggtggcccgcatcaatggcaagcgggaggagggcgccaagctgtccatggaggtgctgcgggccagcctgcagaaggagctgaccatgggcaagggccaggccagcgccatggagctgctgcgctgccccaccctgcggcacctgttcctgtgcctgtccatgctgtggtttgccaccagctttgcctactacggcctggtgatggacctgcagggctttggagtgtccatctacctgatccaggtgatctttggagctgtggacctgcctgccaagctggtgggcttcctggtgatcaacagcctgggccggcggcctgcccagatggccgccctgctgctggccggcatctgcatcctgctgaatggagtcatcccccaggaccagagcatcgtgaggaccagcctggccgtgctgggcaagggctgcctggccgccagcttcaactgcatcttcctgtacacaggagagctgtaccccaccatgatccgggctgtgacagtgctgctgcctgagaccctgggccagcccctgcctgacacagtgcaggacctggagagcaggaagggcaagcagacccggcagcagcaggagcaccagaagtacatggtgcccctgcaggccagcgcccaggagaagaatggcctgtag

SEQ ID NO: 170365 - DNA, 1620 bp, Artificial Sequence
  Description of Artificial Sequence: Synthetic coding sequence
atgggctttgaggagctgctggagcaggtgggcggcttcggccccttccagctgagaaatgtggccctgctggccctgccccgggtgctgctgcccctgcacttcctgctgcccatcttcctggccgctgtgcctgcccaccgctgtgccctgcccggggccccagccaacttcagccaccaggatgtgtggctggaggcccacctgccccgggagccagatggcaccctgagcagctgcctgcgctttgcctacccccaggccctgcccaacaccaccctgggggaggagcggcagagcagaggagagctggaggatgagcccgccaccgtgccctgcagccagggctgggagtatgaccacagcgagttcagcagcaccatcgccacagagtgggacctggtgtgtgagcagaagggcctgaacagagctgccagcaccttcttctttgctggggtgctggtgggcgctgtggccttcggctacctgagtgacagatttggaagaagaaggctgctgctggtggcctacgtgtccaccctggtgctgggcctggccagcgctgcctctgtgtcctatgtgatgtttgccatcaccaggaccctgactggaagtgccctggccggcttcaccatcatcgtgatgcccctggagctggagtggctggatgtggagcacaggacagtggccggcgtgctgagcagcaccttctggacaggaggagtgatgctgctggccctggtgggctacctgatccgggactggcgctggctgctgctggccgtgaccctgccctgtgcccctggcatcctgagcctgtggtgggtgcctgagagcgcccgctggctgctgacccagggccacgtgaaggaggcccaccgctacctgctgcactgtgcccggctgaatggccggcctgtgtgtgaagattccttcagccaggaggccgtgtccaaggtggccgccggggagcgggtggtgcggcggcccagctacctggacctcttccgcaccccccggctgcggcacatcagcctgtgctgcgtggtggtgtggtttggagtgaacttctcctactacggcctgagcctggatgtgtctggcctgggcctgaatgtgtaccagacccagctgctgtttggagctgtggagctgcccagcaagctgctggtgtacctgtctgtgcgctatgccggccggcggctgacccaggccggcaccctgctgggcacagccctggccttcggcacccggctgctggtgtccagtgacatgaagtcctggagcacagtgctggccgtgatgggcaaggccttcagcgaggccgccttcaccacagcctacctgttcaccagcgagctgtaccccaccgtgctgcggcagacaggcatgggcctgacagccctggtgggccgcctgggcggcagcctggcccccctggccgccctgctggatggagtgtggctgagcctgcccaagctgacctacggcggcatcgccctgctggccgccggcacagccctgctgctgcctgagacccggcaggcccagctgcctgagaccatccaggatgtggagaggaagagatgtgtgcacaggacagtgtctgtgtatgtgtag

SEQ ID NO: 170366 - DNA, 1647 bp, Artificial Sequence
  Description of Artificial Sequence: Synthetic coding sequence
atgggctttgaggagctgctggagcaggtgggcggcttcggccccttccagctgagaaatgtggccctgctggccctgccccgggtgctgctgcccctgcacttcctgctgcccatcttcctggccgctgtgcctgcccaccgctgtgccctgcccggggccccagccaacttcagccaccaggatgtgtggctggaggcccacctgccccgggagccagatggcaccctgagcagctgcctgcgctttgcctacccccaggccctgcccaacaccaccctgggggaggagcggcagagcagaggagagctggaggatgagcccgccaccgtgccctgcagccagggctgggagtatgaccacagcgagttcagcagcaccatcgccacagagagccagtgggacctggtgtgtgagcagaagggcctgaacagagctgccagcaccttcttctttgctggggtgctggtgggcgctgtggccttcggctacctgagtgacagatttggaagaagaaggctgctgctggtggcctacgtgtccaccctggtgctgggcctggccagcgctgcctctgtgtcctatgtgatgtttgccatcaccaggaccctgactggaagtgccctggccggcttcaccatcatcgtgatgcccctggagctggagtggctggatgtggagcacaggacagtggccggcgtgctgagcagcaccttctggacaggaggagtgatgctgctggccctggtgggctacctgatccgggactggcgctggctgctgctggccgtgaccctgccctgtgcccctggcatcctgagcctgtggtgggtgcctgagagcgcccgctggctgctgacccagggccacgtgaaggaggcccaccgctacctgctgcactgtgcccggctgaatggccggcctgtgtgtgaagattccttcagccaggaggccgtgtccaaggtggccgccggggagcgggtggtgcggcggcccagctacctggacctcttccgcaccccccggctgcggcacatcagcctgtgctgcgtggtggtgtggtttggagtgaacttctcctactacggcctgagcctggatgtgtctggcctgggcctgaatgtgtaccagacccagctgctgtttggagctgtggagctgcccagcaagctgctggtgtacctgtctgtgcgctatgccggccggcggctgacccaggccggcaccctgctgggcacagccctggccttcggcacccggctgctggtgtccagtgacatgaagtcctggagcacagtgctggccgtgatgggcaaggccttcagcgaggccgccttcaccacagcctacctgttcaccagcgagctgtaccccaccgtgctgcggcagacaggcatgggcctgacagccctggtgggccgcctgggcggcagcctggcccccctggccgccctgctggatggagtgtggctgagcctgcccaagctgacctacggcggcatcgccctgctggccgccggcacagccctgctgctgcctgagacccggcaggcccagctgcctgagaccatccaggatgtggagaggaagagcgcccccaccagcctgcaggaggaggagatgcccatgaagcaggtgcagaactag

SEQ ID NO: 170367 - DNA, 1641 bp, Artificial Sequence
  Description of Artificial Sequence: Synthetic coding sequence
atgggctttgaggagctgctggagcaggtgggcggcttcggccccttccagctgagaaatgtggccctgctggccctgccccgggtgctgctgcccctgcacttcctgctgcccatcttcctggccgctgtgcctgcccaccgctgtgccctgcccggggccccagccaacttcagccaccaggatgtgtggctggaggcccacctgccccgggagccagatggcaccctgagcagctgcctgcgctttgcctacccccaggccctgcccaacaccaccctgggggaggagcggcagagcagaggagagctggaggatgagcccgccaccgtgccctgcagccagggctgggagtatgaccacagcgagttcagcagcaccatcgccacagagtgggacctggtgtgtgagcagaagggcctgaacagagctgccagcaccttcttctttgctggggtgctggtgggcgctgtggccttcggctacctgagtgacagatttggaagaagaaggctgctgctggtggcctacgtgtccaccctggtgctgggcctggccagcgctgcctctgtgtcctatgtgatgtttgccatcaccaggaccctgactggaagtgccctggccggcttcaccatcatcgtgatgcccctggagctggagtggctggatgtggagcacaggacagtggccggcgtgctgagcagcaccttctggacaggaggagtgatgctgctggccctggtgggctacctgatccgggactggcgctggctgctgctggccgtgaccctgccctgtgcccctggcatcctgagcctgtggtgggtgcctgagagcgcccgctggctgctgacccagggccacgtgaaggaggcccaccgctacctgctgcactgtgcccggctgaatggccggcctgtgtgtgaagattccttcagccaggaggccgtgtccaaggtggccgccggggagcgggtggtgcggcggcccagctacctggacctcttccgcaccccccggctgcggcacatcagcctgtgctgcgtggtggtgtggtttggagtgaacttctcctactacggcctgagcctggatgtgtctggcctgggcctgaatgtgtaccagacccagctgctgtttggagctgtggagctgcccagcaagctgctggtgtacctgtctgtgcgctatgccggccggcggctgacccaggccggcaccctgctgggcacagccctggccttcggcacccggctgctggtgtccagtgacatgaagtcctggagcacagtgctggccgtgatgggcaaggccttcagcgaggccgccttcaccacagcctacctgttcaccagcgagctgtaccccaccgtgctgcggcagacaggcatgggcctgacagccctggtgggccgcctgggcggcagcctggcccccctggccgccctgctggatggagtgtggctgagcctgcccaagctgacctacggcggcatcgccctgctggccgccggcacagccctgctgctgcctgagacccggcaggcccagctgcctgagaccatccaggatgtggagaggaagagcgcccccaccagcctgcaggaggaggagatgcccatgaagcaggtgcagaactag

SEQ ID NO: 170368 - DNA, 636 bp, Artificial Sequence
  Description of Artificial Sequence: Synthetic coding sequence
atgctgcagccccacctgctgccctaccaggccgtgtccaaggtggccgccggggagcgggtggtgagaagacccagctacctggacctcttccgcaccccccggctgcggcacatcagcctgtgctgcgtggtggtgtggtttggagtgaacttctcctactacggcctgagcctggatgtgtctggcctgggcctgaatgtgtaccagacccagctgctgtttggagctgtggagctgcccagcaagctgctggtgtacctgtctgtgcgctatgccggccgccgcctgacccaggccggcaccctgctgggcacagccctggccttcggcacccggctgctggtgtccagtgacatgaagtcctggagcacagtgctggccgtgatgggcaaggccttcagcgaggccgccttcaccacagcctacctgttcaccagcgagctgtaccccaccgtgctgcggcagacaggcatgggcctgacagccctggtgggccgcctgggcggcagcctggcccccctggccgccctgctggatggagtgtggctgagcctgcccaagctgacctatggaggcatcgccctgctggccgccggcacagccctgctgctgcctgagacccggcaggcctag

SEQ ID NO: 170369 - DNA, 837 bp, Artificial Sequence
  Description of Artificial Sequence: Synthetic coding sequence
atgggctttgaggagctgctggagcaggtgggcggcttcggccccttccagctgagaaatgtggccctgctggccctgccccgggtgctgctgcccctgcacttcctgctgcccatcttcctggccgctgtgcctgcccaccgctgtgccctgcccggggccccagccaacttcagccaccaggatgtgtggctggaggcccacctgccccgggagccagatggcaccctgagcagctgcctgcgctttgcctacccccaggccctgcccaacaccaccctgggggaggagcggcagagcagaggagagctggaggatgagcccgccaccgtgccctgcagccagggctgggagtatgaccacagcgagttcagcagcaccatcgccacagagagccaggtgggcatctacatcatccacctggaggtggagtgccgctggaggcagagcccctgggaggccgccggccggggcctgccctgggaggaggccgaggccgccggcctgggccgggacaaggtgtcctacagccccagctggagggagagcctgggcggcctgctgagcggcatggagtgggacctggtgtgtgagcagaagggcctgaacagagctgccagcaccttcttctttgctggggtgctggtgggcgctgtggccttcggctacctgagtgaccgcttcggcagaagaaggctgctgctggtggcctacgtgtccaccctggtgctgggcctggccagcgctgcctctgtgtcctatgtgatgtttgccatcaccaggaccctgaccggcagcgccctggccggcttcaccatcatcgtgatgcccctgtag

SEQ ID NO: 170370 - DNA, 444 bp, Artificial Sequence
  Description of Artificial Sequence: Synthetic coding sequence
atggagtgggacctggtgtgtgagcagaagggcctgaacagagctgccagcaccttcttctttgctggggtgctggtgggcgctgtggccttcggctacctgagtgaccgcttcggcagaagaaggctgctgctggtggcctacgtgtccaccctggtgctgggcctggccagcgctgcctctgtgtcctatgtgatgtttgccatcaccaggaccctgaccggcagcgccctggccggcttcaccatcatcgtgatgcccctgggggaggccgagctggagtggctggatgtggagcacaggacagtggccggcgtgctgagcagcaccttctggacaggaggagtgatgctgctggccctggtgggctacctgatccgggactggcgctggctgctgctggccgtgaccctgccctgtgcccctggcatcctgagcctgtag

SEQ ID NO: 170371 - DNA, 1629 bp, Artificial Sequence
  Description of Artificial Sequence: Synthetic coding sequence
atgaccttcagcgagatcctggacagagtgggctccatgggccacttccagttcctgcacgtggccatcctgggcctgcccatcctgaacatggccaaccacaacctgctgcagatcttcaccgctgccacccctgtgcaccactgcaggcctccccacaatgccagcacaggcccctgggtgctgcccatgggccccaacgggaagccagagcgctgcctgcgctttgtgcaccccccaaatgccagcctgcccaatgacacccagagggccatggagccctgcctggatggctgggtgtacaacagcaccaaggacagcatcgtgacagagtgggacctggtgtgcaacagcaacaagctgaaggagatggcccagagcatcttcatggccggcatcctgattggaggcctggtgctgggggacctgagtgacagatttggaagaagacccatcctgacctgcagctacctgctgctggccgccagcggcagcggggccgccttcagccccaccttccccatctacatggtgttccgcttcctgtgtggcttcggcatcagcggcatcaccctgagcaccgtcatcctgaatgtggagtgggtgcccaccaggatgagggccatcatgagcacagccctgggctactgctacaccttcggccagttcatcctgcccggcctggcctatgccatcccccagtggcgctggctgcagctgactgtgtccatccccttctttgtgttcttcctgagctcctggtggaccccagagagcatccgctggctggtgctgagcggcaagagcagcaaggccctgaagatcctgcggcgggtggccgtgttcaacgggaagaaggaggagggggagcggctgagcctggaggagctgaagctgaacctgcagaaggagatcagcctggccaaggccaagtacacagccagtgacctcttccgcatccccatgctgcggaggatgaccttctgcctgagcctggcctggtttgccactggatttgcctactacagcctggccatgggcgtggaggagtttggagtgaacctgtacatcctgcagatcatctttggaggagtggatgtgcctgccaagttcatcaccatcctgagcctgagctacctgggccgccacaccacccaggccgccgccctgctgctggccggcggggccatcctggccctgacctttgtgcccctggacctgcagacagtgaggacagtgctggccgtgtttgggaagggctgcctgagcagcagcttcagctgcctcttcctgtacaccagcgagctgtaccccaccgtcatccggcagacaggcatgggcgtgagcaacctgtggaccagggtgggctccatggtgagccccctggtgaagatcaccggggaggtgcagcccttcatccccaacatcatctacggcatcacagccctgctgggcggcagcgctgccctcttcctgcctgagaccctgaaccagcccctgcctgagaccatcgaggacctggagaactggagcctgcgggccaagaagcccaagcaggagcctgaggtggagaaggccagccagaggatccccctgcagccccacggccctggcctgggcagcagctag

SEQ ID NO: 170372 - DNA, 1629 bp, Artificial Sequence; identical to SEQ ID NO: 170371
  Description of Artificial Sequence: Synthetic coding sequence

SEQ ID NO: 170373 - DNA, 1587 bp, Artificial Sequence
  Description of Artificial Sequence: Synthetic coding sequence
atgaccttcagcgagatcctggacagagtgggctccatgggccacttccagttcctgcacgtggccatcctgggcctgcccatcctgaacatggccaaccactgcaggcctccccacaatgccagcacaggcccctgggtgctgcccatgggccccaacgggaagccagagcgctgcctgcgctttgtgcaccccccaaatgccagcctgcccaatgacacccagagggccatggagccctgcctggatggctgggtgtacaacagcaccaaggacagcatcgtgacagagtgggacctggtgtgcaacagcaacaagctgaaggagatggcccagagcatcttcatggccggcatcctgattggaggcctggtgctgggggacctgagtgacagatttggaagaagacccatcctgacctgcagctacctgctgctggccgccagcggcagcggggccgccttcagccccaccttccccatctacatggtgttccgcttcctgtgtggcttcggcatcagcggcatcaccctgagcaccgtcatcctgaatgtggagtgggtgcccaccaggatgagggccatcatgagcacagccctgggctactgctacaccttcggccagttcatcctgcccggcctggcctatgccatcccccagtggcgctggctgcagctgactgtgtccatccccttctttgtgttcttcctgagctcctggtggaccccagagagcatccgctggctggtgctgagcggcaagagcagcaaggccctgaagatcctgcggcgggtggccgtgttcaacgggaagaaggaggagggggagcggctgagcctggaggagctgaagctgaacctgcagaaggagatcagcctggccaaggccaagtacacagccagtgacctcttccgcatccccatgctgcggaggatgaccttctgcctgagcctggcctggtttgccactggatttgcctactacagcctggccatgggcgtggaggagtttggagtgaacctgtacatcctgcagatcatctttggaggagtggatgtgcctgccaagttcatcaccatcctgagcctgagctacctgggccgccacaccacccaggccgccgccctgctgctggccggcggggccatcctggccctgacctttgtgcccctggacctgcagacagtgaggacagtgctggccgtgtttgggaagggctgcctgagcagcagcttcagctgcctcttcctgtacaccagcgagctgtaccccaccgtcatccggcagacaggcatgggcgtgagcaacctgtggaccagggtgggctccatggtgagccccctggtgaagatcaccggggaggtgcagcccttcatccccaacatcatctacggcatcacagccctgctgggcggcagcgctgccctcttcctgcctgagaccctgaaccagcccctgcctgagaccatcgaggacctggagaactggagcctgcgggccaagaagcccaagcaggagcctgaggtggagaaggccagccagaggatccccctgcagccccacggccctggcctgggcagcagctag

SEQ ID NO: 170374 - DNA, 1653 bp, Artificial Sequence
  Description of Artificial Sequence: Synthetic coding sequence
atggccttcagcaagctgctggagcaggccggcggcgtgggcctcttccagaccctgcaggtgctgaccttcatcctgccctgcctgatgatccccagccagatgctgctggagaacttctctgctgccatccctggccaccgctgctggacccacatgctggacaatggcagcgctgtgtccaccaacatgacccccaaggccctgctgaccatcagcatccccccaggccccaaccagggcccccaccagtgccgccgcttccggcagccccagtggcagctgctggaccccaatgccacagccacctcctggagcgaggccgacacagagccctgtgtggatggctgggtgtatgacaggagcgtcttcaccagcaccatcgtggccaagtgggacctggtgtgcagcagccagggcctgaagcccctgagccagagcatcttcatgagcggcatcctggtgggcagcttcatctggggcctgctgagctacagatttggaaggaagcccatgctgtcctggtgctgcctgcagctggccgtggccggcaccagcaccatctttgcccccacctttgtgatctactgcggcctgcgctttgtggccgccttcggcatggccggcatcttcctgagcagcctgaccctgatggtggagtggaccaccaccagccggcgggctgtgaccatgacagtggtgggctgtgccttctctgctggccaggccgccctgggcggcctggcctttgccctgcgggactggaggaccctgcagctggccgcctctgtgcccttctttgccatcagcctcatctcctggtggctgcctgagagcgcccgctggctgatcatcaagggcaagccagaccaggccctgcaggagctgaggaaggtggcccgcatcaatggccacaaggaggccaagaacctgaccatcgaggtgctgatgagctctgtgaaggaggaggtggccagcgccaaggagcccaggtctgtgctggacctcttctgtgtgcctgtgctgcgctggaggagctgtgccatgctggtggtgaacttcagcctgctgatctcctactacggcctggtgtttgacctgcagagcctgggccgggacatcttcctgctgcaggccctgtttggagctgtggacttcctgggccgggccaccacagccctgctgctgtccttcctgggccgccgcaccatccaggccggcagccaggccatggccggcctggccatcctggccaacatgctggtgccccaggacctgcagaccctgcgggtggtgtttgctgtgctgggcaagggctgcttcggcatcagcctgacctgcctgaccatctacaaggccgagctgttccccacccctgtgaggatgacagcagatggcatcctgcacacagtgggccgcctgggcgccatgatgggccccctcatcctgatgagccggcaggccctgcccctgctgccccccctgctgtatggagtcatcagcatcgccagcagcctggtggtgctcttcttcctgcctgagacccagggcctgcccctgcctgacaccatccaggacctggagagccagaagagcacagctgcccagggcaaccggcaggaggccgtgacagtggagagcaccagcctgtag

SEQ ID NO: 170375 - DNA, 1338 bp, Artificial Sequence
  Description of Artificial Sequence: Synthetic coding sequence
atggccttcagcgagctgctggacctggtgggcggcctgggccgcttccaggtgctgcagaccatggccctgatggtgtccatcatgtggctgtgcacccagagcatgctggagaacttctctgctgctgtgcccagccaccgctgctgggcccccctgctggacaacagcacagcccaggccagcatcctgggcagcctgagccctgaggccctgctggccatcagcatccccccaggccccaaccagaggccccaccagtgccgccgcttccggcagccccagtggcagctgctggaccccaatgccacagccacctcctggagcgaggccgacacagagccctgtgtggatggctgggtgtatgacaggagcatcttcaccagcaccatcgtggccaagtggaacctggtgtgtgacagccacgccctgaagcccatggcccagagcatctacctggccggcatcctggtgggcgctgctgcctgtggccctgccagtgaccgctggctggccgagagcgcccgctggctgctgaccaccggccgcctggactggggcctgcaggagctgtggagggtggccgccatcaacgggaaaggagctgtgcaggacaccctgaccccagaggtgctgctgagcgccatgagggaggagctgtccatgggccagcccccagccagcctgggcaccctgctgaggatgcctggcctgcgcttccgcacctgcatcagcaccctgtgctggtttgccttcggcttcaccttcttcggcctggccctggacctgcaggccctgggcagcaacatcttcctgctgcagatgtttattggagtggtggacatcccagccaagatgggcgccctgctgctgctgagccacctgggcagaagacccaccctggccgccagcctgctgctggccggcctgtgcatcctggccaacaccctggtgccccatgagatgggcgccctgcggagcgccctggccgtgctgggcctgggcggcgtgggcgccgccttcacctgcatcaccatctacagcagcgagctgttccccaccgtgctgaggatgacagctgtgggcctgggccagatggccgcccggggcggggccatcctgggccccctggtgcggctgctgggcgtgcacggcccctggctgcccctgctggtgtatggaacagtgcctgtgctgagcggcctggccgccctgctgctgcctgagacccagagcctgcccctgcctgacaccatccaggatgtgcagaaccaggccgtgaagaaggccacccacggcaccctgggcaacagcgtgctgaagagcacccagttctag

SEQ ID NO: 170376 - DNA, 1662 bp, Artificial Sequence
  Description of Artificial Sequence: Synthetic coding sequence
atggccttcagcgagctgctggacctggtgggcggcctgggccgcttccaggtgctgcagaccatggccctgatggtgtccatcatgtggctgtgcacccagagcatgctggagaacttctctgctgctgtgcccagccaccgctgctgggcccccctgctggacaacagcacagcccaggccagcatcctgggcagcctgagccctgaggccctgctggccatcagcatccccccaggccccaaccagaggccccaccagtgccgccgcttccggcagccccagtggcagctgctggaccccaatgccacagccacctcctggagcgaggccgacacagagccctgtgtggatggctgggtgtatgacaggagcatcttcaccagcaccatcgtggccaagtggaacctggtgtgtgacagccacgccctgaagcccatggcccagagcatctacctggccggcatcctggtgggcgctgctgcctgtggccctgccagtgaccgcttcggccggcggctggtgctgacctggagctacctgcagatggctgtgatgggcacagctgctgcctttgccccagccttccctgtgtactgcctcttccgcttcctgctggcctttgctgtggccggcgtgatgatgaacacaggcaccctgctgatggagtggacagctgcccgggcccggcccctggtgatgaccctgaacagcctgggcttctcctttggacatggcctgacagctgctgtggcctatggagtgcgggactggaccctgctgcagctggtggtgtctgtgcccttcttcctgtgcttcctgtacagctggtggctggccgagagcgcccgctggctgctgaccaccggccgcctggactggggcctgcaggagctgtggagggtggccgccatcaacgggaaaggagctgtgcaggacaccctgaccccagaggtgctgctgagcgccatgagggaggagctgtccatgggccagcccccagccagcctgggcaccctgctgaggatgcctggcctgcgcttccgcacctgcatcagcaccctgtgctggtttgccttcggcttcaccttcttcggcctggccctggacctgcaggccctgggcagcaacatcttcctgctgcagatgtttattggagtggtggacatcccagccaagatgggcgccctgctgctgctgagccacctgggcagaagacccaccctggccgccagcctgctgctggccggcctgtgcatcctggccaacaccctggtgccccatgagatgggcgccctgcggagcgccctggccgtgctgggcctgggcggcgtgggcgccgccttcacctgcatcaccatctacagcagcgagctgttccccaccgtgctgaggatgacagctgtgggcctgggccagatggccgcccggggcggggccatcctgggccccctggtgcggctgctgggcgtgcacggcccctggctgcccctgctggtgtatggaacagtgcctgtgctgagcggcctggccgccctgctgctgcctgagacccagagcctgcccctgcctgacaccatccaggatgtgcagaaccaggccgtgaagaaggccacccacggcaccctgggcaacagcgtgctgaagagcacccagttctag

SEQ ID NO: 170377 - DNA, 999 bp, Artificial Sequence
  Description of Artificial Sequence: Synthetic coding sequence
atggagtggacagctgcccgggcccggcccctggtgatgaccctgaacagcctgggcttctcctttggccacggcctgacagctgctgtggcctacggcgtgcgggactggaccctgctgcagctggtggtgtctgtgcccttcttcctgtgcttcctgtacagctggtggctggccgagagcgcccgctggctgctgaccaccggccgcctggactggggcctgcaggagctgtggagggtggccgccatcaatggaaaaggagctgtgcaggacaccctgaccccagaggtgctgctgagcgccatgagggaggagctgtccatgggccagcccccagccagcctgggcaccctgctgaggatgcctggcctgcgcttccgcacctgcatcagcaccctgtgctggtttgccttcggcttcaccttcttcggcctggccctggacctgcaggccctgggcagcaacatcttcctgctgcagatgttcatcggcgtggtggacatcccagccaagatgggcgccctgctgctgctgagccacctgggccggcggcccaccctggccgccagcctgctgctggccggcctgtgcatcctggccaacaccctggtgccccatgagatgggcgccctgcggagcgccctggccgtgctgggcctgggcggcgtgggcgccgccttcacctgcatcaccatctacagcagcgagctgttccccaccgtgctgaggatgacagctgtgggcctgggccagatggccgcccggggcggggccatcctgggccccctggtgcggctgctgggcgtgcacggcccctggctgcccctgctggtgtatggcaccgtgcctgtgctgagcggcctggccgccctgctgctgcctgagacccagagcctgcccctgcctgacaccatccaggatgtgcagaaccaggccgtgaagaaggccacccacggcaccctgggcaacagcgtgctgaagagcacccagttctag

SEQ ID NO: 170378 - DNA, 1665 bp, Artificial Sequence
  Description of Artificial Sequence: Synthetic coding sequence
atgcccaccgtggatgacatcctggagcaggtgggggagagcggctggttccagaagcaggccttcctgatcctgtgcctgctgtctgctgcctttgcccccatctgtgtgggcatcgtgttcctgggcttcaccccagaccaccactgccagagccctggggtggccgagctgagccagagatgtggctggagccctgctgaggagctgaactacacagtgcccggcctgggccctgctggggaggccttcctgggccagtgcagaagatatgaggtggactggaaccagagcgccctgagctgtgtggaccccctggccagcctggccaccaacagaagccacctgcccctgggcccctgccaggacggctgggtgtatgacaccccaggcagcagcatcgtgacagagttcaacctggtgtgtgccgacagctggaagctggacctcttccagagctgcctgaatgccggcttcctgtttggcagcctgggcgtgggctactttgctgacagatttggaaggaagctgtgcctgctgggcaccgtgctggtgaatgctgtgtctggagtgctgatggccttcagccccaactacatgtccatgctgctcttccggctgctgcagggcctggtgtccaagggcaactggatggccggctacaccctcatcacagaatttgtgggcagcggcagcagaagaacagtggccatcatgtaccagatggccttcaccgtgggcctggtggccctgaccggcctggcctatgccctgccccactggcgctggctgcagctggccgtgtccctgcccaccttcctgttcctgctgtactactggtgtgtgcctgagagcccccgctggctgctgagccagaagaggaacacagaggccatcaagatcatggaccacatcgcccagaagaatggcaagctgcccccagctgacctgaagatgctgagcctggaggaggatgtgacagagaagctgagccccagctttgctgacctcttccgcaccccccggctgaggaagaggaccttcatcctgatgtacctgtggttcacagacagcgtgctgtaccagggcctcatcctgcacatgggcgccaccagcggcaacctgtacctggacttcctgtacagcgccctggtggagatccctggggccttcatcgccctgatcaccatcgacagagtgggccgcatctaccccatggccatgagcaacctgctggccggggccgcctgcctggtgatgatcttcatcagcccagacctgcactggctgaacatcatcatcatgtgtgtgggccgcatgggcatcaccatcgccatccagatgatctgcctggtgaatgctgagctgtaccccacctttgtgaggaacctgggcgtgatggtgtgcagcagcctgtgtgacattggaggcatcatcacccccttcatcgtgttccggctgcgggaggtgtggcaggccctgcccctcatcctgtttgctgtgctgggcctgctggccgccggcgtgaccctgctgctgcctgagaccaagggcgtggccctgcctgagaccatgaaggatgctgagaacctgggcaggaaggccaagcccaaggagaacaccatctacctgaaggtgcagaccagcgagcccagcggcacctag

SEQ ID NO: 170379 - DNA, 1005 bp, Artificial Sequence
  Description of Artificial Sequence: Synthetic coding sequence
atgttcttcctgctggccctgctgagcgccacctttgcccccatctacgtgggcatcgtgttcctgggcttcaccccagaccaccgctgccgcagccctggggtggccgagctgagcctgcgctgtggctggagccctgctgaggagctgaactacacagtgcccggccctggccctgctggggaggccagcccccggcagtgcagaagatatgaggtggactggaaccagagcacctttgactgtgtggaccccctggccagcctggacaccaacagaagccggctgcccctgggcccctgcagagatggctgggtgtatgagaccccaggcagcagcatcgtgacagagttcaacctggtgtgtgccaacagctggatgctggacctcttccagagctctgtgaatgtgggcttcttcatcggctccatgagcatcggctacatcgctgacagatttggaaggaagctgtgcctgctgaccaccgtgctgatcaatgctgctgctggggtgctgatggccatcagccccacctacacctggatgctgatcttccgcctcatccagggcctggtgtccaaggccggctggctgattggctacatcctgatcacagaatttgtgggccgccgctacagaagaacagtgggcatcttctaccaggtggcctacacagtgggcctgctggtgctggccggcgtggcctatgccctgccccactggcgctggctgcagttcaccgtgtccctgcccaacttcttcttcctgctgtactactggtgcatccctgagagcccccgctggctgatcagccagaacaagaatgctgaggccatgaggatcatcaagcacatcgccaagaagaatggcaagagcctgcctgccagcctgcagaggctgcggctggaggaggagaccgggaagaagctgaaccccagcttcctggacctggtgaggaccccccagatcaggaagcacaccatgatcctgatgtacaactggtag

SEQ ID NO: 170380 - DNA, 1668 bp, Artificial Sequence
  Description of Artificial Sequence: Synthetic coding sequence
atgcccaccaccgtggatgatgtgctggagcacggcggggagttccacttcttccagaagcagatgttcttcctgctggccctgctgagcgccacctttgcccccatctacgtgggcatcgtgttcctgggcttcaccccagaccaccgctgccgcagccctggggtggccgagctgagcctgcgctgtggctggagccctgctgaggagctgaactacacagtgcccggccctggccctgctggggaggccagcccccggcagtgccgccgctatgaggtggactggaaccagagcacctttgactgtgtggaccccctggccagcctggacaccaacagaagccggctgcccctgggcccctgcagagatggctgggtgtatgagaccccaggcagcagcatcgtgacagagttcaacctggtgtgtgccaacagctggatgctggacctcttccagagctctgtgaatgtgggcttcttcatcggctccatgagcatcggctacatcgctgaccgcttcggcaggaagctgtgcctgctgaccaccgtgctgatcaatgctgctgctggggtgctgatggccatcagccccacctacacctggatgctgatcttccgcctcatccagggcctggtgtccaaggccggctggctgattggctacatcctgatcacagaatttgtgggccgccgctacagaagaacagtgggcatcttctaccaggtggcctacacagtgggcctgctggtgctggccggcgtggcctatgccctgccccactggcgctggctgcagttcaccgtgtccctgcccaacttcttcttcctgctgtactactggtgcatccctgagagcccccgctggctgatcagccagaacaagaatgctgaggccatgaggatcatcaagcacatcgccaagaagaatggcaagagcctgcctgccagcctgcagaggctgcggctggaggaggagaccgggaagaagctgaaccccagcttcctggacctggtgaggaccccccagatcaggaagcacaccatgatcctgatgtacaactggttcaccagctctgtgctgtaccagggcctcatcatgcacatgggcctggccggggacaacatctacctggacttcttctacagcgccctggtggagttccctgctgccttcatgatcatcctgaccatcgacagaattggaagacgctacccctgggccgccagcaacatggtggccggggccgcctgcctggcctctgtgttcatccctggggacctgcagtggctgaagatcatcatcagctgcctgggccgcatgggcatcaccatggcctatgaaattgtgtgcctggtgaatgctgagctgtaccccaccttcatccggaacctgggcgtgcacatctgcagctccatgtgtgacatcggcggcatcatcacccccttcctggtgtaccgcctgaccaacatctggctggagctgcccctgatggtgtttggagtgctgggcctggtggccggcggcctggtgctgctgctgcctgagaccaagggcaaggccctgcctgagaccatcgaggaggccgagaacatgcagaggcccaggaagaacaaggagaagatgatctacctgcaggtgcagaagctggacatccccctgaactag

SEQ ID NO: 170381 - DNA, 1632 bp, Artificial Sequence
  Description of Artificial Sequence: Synthetic coding sequence
atgaggaccctgcatgctgtgagccacccctacagcaacagcatgaggttccagagggtgctgtacttcatctgtgccttccagaacatcagctgtggcatccactacctggcctctgtgttcatgggcgtgaccccccaccacgtgtgccggcccccaggcaacctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgaccggctgggcagaagagtggtgctgtgggccaccagcagctccatgttcctgtttggaattgctgctgcctttgctgtggactactacaccttcatggccgcccgcttcttcctggccatggtggccagcggctacctggtggtgggctttgtgtatgtgatggagttcatcggcatgaagagcaggacctgggcctctgtgcacctgcacagcttctttgctgtgggcaccctgctggtggccctgaccggctacctggtgaggacctggtggctgtaccagatgatcctgagcacagtgacagtgcccttcatcctgtgctgctgggtgctgcctgagacccccttctggctgctgtctgagggccgctatgaggaggcccagaagatcgtggacatcatggccaagtggaacagagccagcagctgcaagctgtctgagctgctgagcctggacctgcagggccctgtgagcaacagccccacagaggtgcagaagcacaacctgagctacctgttctacaactggagcatcaccaagaggaccctgactgtgtggctgatctggttcaccggcagcctgggcttctacagcttcagcctgaacagcgtgaacctgggcggcaatgagtacctgaacctcttcctgctgggcgtggtggagatcccagcctacacctttgtgtgcatcgccatggacaaggtgggccgcaggacagtgctggcctacagcctcttctgcagcgccctggcctgtggggtggtgatggtgatcccccagaagcactacatcctgggcgtggtgacagccatggtgggcaagtttgccatcggggccgccttcggcctcatctacctgtacacagctgagctgtaccccaccatcgtgcgcagcctggccgtgggcagcggctccatggtgtgccgcctggccagcatcctggcccccttctctgtggacctgagcagcatctggatcttcatcccccagctgtttgtgggcaccatggccctgctgtctggagtgctgaccctgaagctgcctgagaccctgggcaagaggctggccaccacctgggaggaggccgccaagctggagagtgaaaatgaaagcaagagcagcaagctgctgctgaccaccaacaacagcggcctggagaagacagaggccatcaccccccgggacagcggcctgggggagtag

SEQ ID NO: 170382 - DNA, 1734 bp, Artificial Sequence
  Description of Artificial Sequence: Synthetic coding sequence
atgggcagccgccactttgagggcatctatgaccacgtgggccacttcggccgcttccagagggtgctgtacttcatctgtgccttccagaacatcagctgtggcatccactacctggcctctgtgttcatgggcgtgaccccccaccacgtgtgccggcccccaggaaatgtgtcccaggtggtgttccacaaccacagcaactggagcctggaggacaccggggccctgctgagcagcggccagaaggactatgtgacagtgcagctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgaccggctgggcagaagagtggtgctgtgggccaccagcagctccatgttcctgtttggaattgctgctgcctttgctgtggactactacaccttcatggccgcccgcttcttcctggccatggtggccagcggctacctggtggtgggctttgtgtatgtgatggagttcatcggcatgaagagcaggacctgggcctctgtgcacctgcacagcttctttgctgtgggcaccctgctggtggccctgaccggctacctggtgaggacctggtggctgtaccagatgatcctgagcacagtgacagtgcccttcatcctgtgctgctgggtgctgcctgagacccccttctggctgctgtctgagggccgctatgaggaggcccagaagatcgtggacatcatggccaagtggaacagagccagcagctgcaagctgtctgagctgctgagcctggacctgcagggccctgtgagcaacagccccacagaggtgcagaagcacaacctgagctacctgttctacaactggagcatcaccaagaggaccctgactgtgtggctgatctggttcaccggcagcctgggcttctacagcttcagcctgaacagcgtgaacctgggcggcaatgagtacctgaacctcttcctgctgggcgtggtggagatcccagcctacacctttgtgtgcatcgccatggacaaggtgggccgcaggacagtgctggcctacagcctcttctgcagcgccctggcctgtggggtggtgatggtgatcccccagaagcactacatcctgggcgtggtgacagccatggtgggcaagtttgccatcggggccgccttcggcctcatctacctgtacacagctgagctgtaccccaccatcgtgcgcagcctggccgtgggcagcggctccatggtgtgccgcctggccagcatcctggcccccttctctgtggacctgagcagcatctggatcttcatcccccagctgtttgtgggcaccatggccctgctgtctggagtgctgaccctgaagctgcctgagaccctgggcaagaggctggccaccacctgggaggaggccgccaagctggagagtgaaaatgaaagcaagagcagcaagctgctgctgaccaccaacaacagcggcctggagaagacagaggccatcaccccccgggacagcggcctgggggagtag

SEQ ID NO: 170383 - DNA, 525 bp, Artificial Sequence
  Description of Artificial Sequence: Synthetic coding sequence
atgggcgtgaccccccaccacgtgtgcaggcctcctggaaatgtgtcccaggtggtgttccacaaccacagcaactggagcctggaggacacaggagccctgctgagcagcggccagaaggactatgtgacagtgcagctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgaccggctgggccggcgggtggtgctgtgggccaccagcagctccatgttcctgtttggaattgctgctgcctttgctgtggactactacaccttcatggccgcccgcttcttcctggccatgtag

SEQ ID NO: 170384 - DNA, 804 bp, Artificial Sequence
  Description of Artificial Sequence: Synthetic coding sequence
atgtctgctggcccccaggccatgctgggcagaagagtggtgctgtgggccaccagcagctccatgttcctgtttggaattgctgctgcctttgctgtggactactacaccttcatggccgcccgcttcttcctggccatggtggccagcggctacctggtggtgggctttgtgtatgtgatggagttcatcggcatgaagagcaggacctgggcctctgtgcacctgcacagcttctttgctgtgggcaccctgctggtggccctgaccggctacctggtgaggacctggtggctgtaccagatgatcctgagcacagtgacagtgcccttcatcctgtgctgctgggtgctgcctgagacccccttctggctgctgtctgagggccgctatgaggaggcccagaagatcgtggacatcatggccaagtggaacagagccagcagctgcaagctgtctgagctgctgagcctggacctgcagggccctgtgagcaacagccccacagaggtgcagaagcacaacctgagctacctgttctacaactggagcatcaccaagaggaccctgactgtgtggctgatctggttcaccggcagcctgggcttctacagcttcagcctgaacagcgtgaacctgggcggcaatgagtacctgaacctcttcctgctgggcgtggtggagatcccagcctacacctttgtgtgcatcgccatggacaaggtgggccgcaggacagtgctggcctacagcctcttctgcagcgccctggcctgtggggtggtgatggtgatcccccagtag

SEQ ID NO: 170385 - DNA, 1056 bp, Artificial Sequence
  Description of Artificial Sequence: Synthetic coding sequence
atgggcgtgaccccccaccacgtgtgcaggcctcctggaaatgtgtcccaggtggtgttccacaaccacagcaactggagcctggaggacacaggagccctgctgagcagcggccagaaggactatgtgacagtgcagctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgaccggctgggccggcgggtggtgctgtgggccaccagcagctccatgttcctgtttggaattgctgctgcctttgctgtggactactacaccttcatggccgcccgcttcttcctggccatggtggccagcggctacctggtggtgggctttgtgtatgtgatggagttcatcggcatgaagagcaggacctgggcctctgtgcacctgcacagcttctttgctgtgggcaccctgctggtggccctgaccggctacctggtgaggacctggtggctgtaccagatgatcctgagcacagtgacagtgcccttcatcctgtgctgctgggtgctgcctgagacccccttctggctgctgtctgagggccgctatgaggaggcccagaagatcgtggacatcatggccaagtggaacagagccagcagctgcaagctgtctgagctgctgagcctggacctgcagggccctgtgagcaacagccccacagaggtgcagaagcacaacctgagctacctgttctacaactggagcatcaccaagaggaccctgactgtgtggctgatctggttcaccggcagcctgggcttctacagcttcagcctgaacagcgtgaacctgggcggcaatgagtacctgaacctcttcctgctgtag

SEQ ID NO: 170386 - DNA, 1548 bp, Artificial Sequence
  Description of Artificial Sequence: Synthetic coding sequence
atgggcagccgccactttgagggcatctatgaccacgtgggccacttcggccgcttccagagggtgctgtacttcatctgtgccttccagaacatcagctgtggcatccactacctggcctctgtgttcatgggcgtgaccccccaccacgtgtgccggcccccaggaaatgtgtcccaggtggtgttccacaaccacagcaactggagcctggaggacaccggggccctgctgagcagcggccagaaggactatgtgacagtgcagctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgaccggctgggcagaagagtggtgctgtgggccaccagcagctccatgttcctgtttggaattgctgctgcctttgctgtggactactacaccttcatggccgcccgcttcttcctggccatggtggccagcggctacctggtggtgggctttgtgtatgtgatggagttcatcggcatgaagagcaggacctgggcctctgtgcacctgcacagcttctttgctgtgggcaccctgctggtggccctgaccggctacctggtgaggacctggtggctgtaccagatgatcctgagcacagtgacagtgcccttcatcctgtgctgctgggtgctgcctgagacccccttctggctgctgtctgagggccgctatgaggaggcccagaagatcgtggacatcatggccaagtggaacagagccagcagctgcaagctgtctgagctgctgagcctggacctgcagggccctgtgagcaacagccccacagaggtgcagaagcacaacctgagctacctgttctacaactggagcatcaccaagaggaccctgactgtgtggctgatctggttcaccggcagcctgggcttctacagcttcagcctgaacagcgtgaacctgggcggcaatgagtacctgaacctcttcctgctgggcgtggtggagatcccagcctacacctttgtgtgcatcgccatggacaaggtgggccgcaggacagtgctggcctacagcctcttctgcagcgccctggcctgtggggtggtgatggtgatcccccagaagcactacatcctgggcgtggtgacagccatggtgggcaagtttgccatcggggccgccttcggcctcatctacctgtacacagctgagctgtaccccaccatcgtgcgcagcctggccgtgggcagcggctccatggtgtgccgcctggccagcatcctggcccccttctctgtggacctgagcagcatctggatcttcatcccccagctgctgggccagcacctgcaggagtag

SEQ ID NO: 170387 - DNA, 1299 bp, Artificial Sequence
  Description of Artificial Sequence: Synthetic coding sequence
gactatgtgacagtgcagctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgaccggctgggccggcgggtggtgctgtgggccaccagcagctccatgttcctgtttggaattgctgctgcctttgctgtggactactacaccttcatggccgcccgcttcttcctggccatggtggccagcggctacctggtggtgggctttgtgtatgtgatggagttcatcggcatgaagagcaggacctgggcctctgtgcacctgcacagcttctttgctgtgggcaccctgctggtggccctgaccggctacctggtgaggacctggtggctgtaccagatgatcctgagcacagtgacagtgcccttcatcctgtgctgctgggtgctgcctgagacccccttctggctgctgtctgagggccgctatgaggaggcccagaagatcgtggacatcatggccaagtggaacagagccagcagctgcaagctgtctgagctgctgagcctggacctgcagggccctgtgagcaacagccccacagaggtgcagaagcacaacctgagctacctgttctacaactggagcatcaccaagaggaccctgactgtgtggctgatctggttcaccggcagcctgggcttctacagcttcagcctgaacagcgtgaacctgggcggcaatgagtacctgaacctcttcctgctgggcgtggtggagatcccagcctacacctttgtgtgcatcgccatggacaaggtgggcagaagaacagtgctggcctacagcctcttctgcagcgccctggcctgtggggtggtgatggtgatcccccagaagcactacatcctgggcgtggtgacagccatggtgggcaagtttgccatcggggccgccttcggcctcatctacctgtacacagctgagctgtaccccaccatcgtgcgcagcctggccgtgggcagcggctccatggtgtgccgcctggccagcatcctggcccccttctctgtggacctgagcagcatctggatcttcatcccccagctgctgggccagcacctgcaggagtag

SEQ ID NO: 170388 - DNA, 600 bp, Artificial Sequence
  Description of Artificial Sequence: Synthetic coding sequence
atgggcagccgccactttgagggcatctatgaccacgtgggccacttcggccgcttccagagggtgctgtacttcatctgtgccttccagaacatcagctgtggcatccactacctggcctctgtgttcatgggcgtgaccccccaccacgtgtgccggcccccaggaaatgtgtcccaggtggtgttccacaaccacagcaactggagcctggaggacaccggggccctgctgagcagcggccagaaggactatgtgacagtgcagctgcagaatggagagatctgggagctgagccgctgcagcaggaacaagcgggagaacaccagcagcctgggctatgagtacacaggcagcaagaaggagttcccctgtgtggatggctacatctatgaccagaacacctggaagagcacagctgtgacccagtggaacctggtgtgtgacaggaagtggctggccatgctgatccagcccctcttcatgtttggagtgctgctgggctctgtgaccttcggctacttcagtgacagagtgggcttcctgacagcctggtacaagaccagcggcttccccaccagcagcgccccacccctgtag

SEQ ID NO: 170389 - DNA, 1674 bp, Artificial Sequence
  Description of Artificial Sequence: Synthetic coding sequence
atgagggactatgatgaggtgacagccttcctgggggagtggggccccttccagaggctcatcttcttcctgctgagcgccagcatcatccccaacggcttcaccggcctgagctctgtgttcctgattgccaccccagagcaccgctgccgggtgcctgatgctgccaacctgagcagcgcctggaggaaccacacagtgcccctgcggctgagagatggccgggaggtgccccacagctgccgccgctaccgcctggccaccatcgccaacttcagcgccctgggcctggagcccggcagagatgtggacctgggccagctggagcaggagagctgcctggatggctgggagttcagccaggatgtgtacctgagcaccatcgtgacagagtggaacctggtgtgtgaagatgactggaaggcccccctgaccatcagcctcttctttgtgggcgtgctgctgggcagcttcatcagcggccagctgagtgacagatttggaaggaagaatgtgctgtttgtgaccatgggcatgcagacaggcttctccttcctgcagatcttcagcaagaactttgagatgtttgtggtgctgtttgtgctggtgggcatgggccagatcagcaactacgtggccgcctttgtgctgggcacagagatcctgggcaagtctgtgcgcatcatcttcagcaccctgggcgtgtgcatcttctacgccttcggctacatggtgctgcccctgtttgcctacttcatccgggactggaggatgctgctggtggccctgaccatgcctggggtgctgtgtgtggccctgtggtggttcatccctgagagcccccgctggctgatcagccagggccgctttgaggaggccgaggtgatcatcaggaaggccgccaaggccaacggcatcgtggtgcccagcaccatctttgaccccagcgagctgcaggacctgagcagcaagaagcagcagagccacaacatcctggacctgctgcggacctggaacatccgcatggtgaccatcatgagcatcatgctgtggatgaccatctctgtgggctacttcggcctgagcctggacacccccaacctgcatggagacatctttgtgaactgcttcctgagcgccatggtggaggtgcctgcctacgtgctggcctggctgctgctgcagtacctgccccggcgctacagcatggccacagccctcttcctgggcggctctgtgctgctcttcatgcagctggtgcccccagacctgtactacctggccaccgtgctggtgatggtgggcaagtttggagtgacagctgccttctccatggtgtatgtgtacacagctgagctgtaccccaccgtggtgaggaacatgggcgtgggcgtgagcagcacagccagccggctgggcagcatcctgagcccctactttgtgtacctgggcgcctatgaccgcttcctgccctacatcctgatgggcagcctgaccatcctgacagccatcctgaccctcttcctgcctgagagctttggcacccccctgcctgacaccatcgaccagatgctgcgggtgaagggcatgaagcacaggaagacccccagccacaccaggatgctgaaggatggccaggagcggcccaccatcctgaagagcacagccttctag

SEQ ID NO: 170390 - DNA, 1746 bp, Artificial Sequence
  Description of Artificial Sequence: Synthetic coding sequence
atgagggactatgatgaggtgacagccttcctgggggagtggggccccttccagaggctcatcttcttcctgctgagcgccagcatcatccccaacggcttcaccggcctgagctctgtgttcctgattgccaccccagagcaccgctgccgggtgcctgatgctgccaacctgagcagcgcctggaggaaccacacagtgcccctgcggctgagagatggccgggaggtgccccacagctgccgccgctaccgcctggccaccatcgccaacttcagcgccctgggcctggagcccggcagagatgtggacctgggccagctggagcaggagagctgcctggatggctgggagttcagccaggatgtgtacctgagcaccatcgtgacagagcaggacagcggggcctacaatgccatgaagaacaggatgggcaagaagccagccctgtgcctgcctgcccagtggaacctggtgtgtgaagatgactggaaggcccccctgaccatcagcctcttctttgtgggcgtgctgctgggcagcttcatcagcggccagctgagtgacagatttggaaggaagaatgtgctgtttgtgaccatgggcatgcagacaggcttctccttcctgcagatcttcagcaagaactttgagatgtttgtggtgctgtttgtgctggtgggcatgggccagatcagcaactacgtggccgcctttgtgctgggcacagagatcctgggcaagtctgtgcgcatcatcttcagcaccctgggcgtgtgcatcttctacgccttcggctacatggtgctgcccctgtttgcctacttcatccgggactggaggatgctgctggtggccctgaccatgcctggggtgctgtgtgtggccctgtggtggttcatccctgagagcccccgctggctgatcagccagggccgctttgaggaggccgaggtgatcatcaggaaggccgccaaggccaacggcatcgtggtgcccagcaccatctttgaccccagcgagctgcaggacctgagcagcaagaagcagcagagccacaacatcctggacctgctgcggacctggaacatccgcatggtgaccatcatgagcatcatgctgtggatgaccatctctgtgggctacttcggcctgagcctggacacccccaacctgcatggagacatctttgtgaactgcttcctgagcgccatggtggaggtgcctgcctacgtgctggcctggctgctgctgcagtacctgccccggcgctacagcatggccacagccctcttcctgggcggctctgtgctgctcttcatgcagctggtgcccccagacctgtactacctggccaccgtgctggtgatggtgggcaagtttggagtgacagctgccttctccatggtgtatgtgtacacagctgagctgtaccccaccgtggtgaggaacatgggcgtgggcgtgagcagcacagccagccggctgggcagcatcctgagcccctactttgtgtacctgggcgcctatgaccgcttcctgccctacatcctgatgggcagcctgaccatcctgacagccatcctgaccctcttcctgcctgagagctttggcacccccctgcctgacaccatcgaccagatgctgcgggtgaagggcatgaagcacaggaagacccccagccacaccaggatgctgaaggatggccaggagcggcccaccatcctgaagagcacagccttctag

SEQ ID NO: 170391 - DNA, 1656 bp, Artificial Sequence
  Description of Artificial Sequence: Synthetic coding sequence
atgagggactatgatgaagtcatcgccttcctgggggagtggggccccttccagaggctcatcttcttcctgctgagcgccagcatcatccccaacggcttcaacggcatgtctgtggtgttcctggccggcaccccagagcaccgctgccgggtgcctgatgctgccaacctgagcagcgcctggaggaacaacagcgtgcccctgcggctgagagatggccgggaggtgccccacagctgcagccgctaccgcctggccaccatcgccaacttcagcgccctgggcctggagcccggcagagatgtggacctgggccagctggagcaggagagctgcctggatggctgggagttcagccaggatgtgtacctgagcacagtggtgacagagtggaacctggtgtgtgaggacaactggaaggtgcccctgaccaccagcctcttctttgtgggcgtgctgctgggcagctttgtgtctggccagctgagtgacagatttggaaggaagaatgtgctgtttgccaccatggctgtgcagacaggcttctccttcctgcagatcttcagcatctcctgggagatgttcaccgtgctcttcgtcatcgtgggcatgggccagatcagcaactacgtggtggccttcatcctgggcacagagatcctgggcaagtctgtgcgcatcatcttcagcaccctgggcgtgtgcaccttctttgctgtgggctacatgctgctgcccctgtttgcctacttcatccgggactggaggatgctgctgctggccctgactgtgcctggggtgctgtgtgtgcccctgtggtggttcatccctgagagcccccgctggctgatcagccagaggcgcttccgggaggccgaggacatcatccagaaggccgccaagatgaacaacattgctgtgcctgctgtgatctttgattctgtggaggagctgaaccccctgaagcagcagaaggccttcatcctggacctcttccgcaccaggaacatcgccatcatgaccatcatgagcctgctgctgtggatgctgacctctgtgggctactttgccctgagcctggatgcccccaacctgcatggagatgcctacctgaactgcttcctgagcgccctgattgagatcccagcctacatcacagcctggctgctgctgcggaccctgccccggcgctacatcatcgctgctgtgctcttctggggcggcggcgtgctgctcttcatccagctggtgcctgtggactactacttcctgagcatcggcctggtgatgctgggcaagtttggcatcaccagcgccttctccatgctgtatgtgttcaccgctgagctgtaccccaccctggtgaggaacatggctgtgggcgtgaccagcacagccagccgggtgggcagcatcatcgccccctactttgtgtacctgggcgcctacaacaggatgctgccctacatcgtgatgggcagcctgactgtgctgattggcatcctgaccctcttcttccctgagagcctgggcatgaccctgcctgagaccctggagcagatgcagaaggtgaagtggttccgcagcggcaagaagacccgggacagcatggagacagaggagaaccccaaggtgctgatcacagccttctag

SEQ ID NO: 170392 - DNA, 1656 bp, Artificial Sequence
  Description of Artificial Sequence: Synthetic coding sequence
atgggctttgatgtgctgctggaccaggtgggcggcatgggccgcttccagatctgcctgattgccttcttctgcatcaccaacatcctgctcttccccaacatcgtgctggagaacttcaccgccttcacccccagccaccgctgctgggtgcccctgctggacaatgacacagtgtctgacaatgacaccggcaccctgagcaaggatgacctgctgcgcatcagcatccccctggacagcaacctgcggccccagaagtgccagcgcttcatccacccccagtggcagctgctgcacctgaatggcaccttccccaacaccaatgaaccagacacagagccctgtgtggatggctgggtgtatgacaggagcagcttcctgagcaccatcgtgacagagtgggacctggtgtgtgagagccagagcctgaagtccatggtgcagagcctcttcatggccggcagcctgctgggcggcctcatctacggccacctgagtgacagagtgggcaggaagatcatctgcaagctgtgcttcctgcagctggccatcagcaacacctgtgccgcctttgcccccaccttcctggtgtactgcatcctgcgcttcctggccggcttcagcaccatgaccatcctgggcaacaccttcatcctgagcctggagtggaccctgcccaggagccgctccatgaccatcatggtgctgctgtgcagctacagcgtgggccagatgctgctgggcggcctggcctttgccatccaggactggcacatcctgcagctgactgtgtccacccccatcatcgtgctcttcctgagctcctggaagatggtggagagcgcccgctggctgatcatcaacaaccagctggatgagggcctgaaggagctgcggcgggtggcccacatcaacgggaagaagaacacagaggagaccctgaccacagagctggtgcgcagcaccatgaagaaggagctggatgctgtgcgcatcaagaccagcatcttcagcctcttccgggcccccaagctgaggatgagggtgtttggcctgtgctttgtgcgctttgccatcaccgtgcccttctacggcctcatcctgaacctgcagcacctgggcagcaatgtgtccctcttccagatcctgtgtggggctgtgaccttcaccgcccgctgtgtgtccctgctgaccctgaaccacatgggccgccgcatcagccagatcctcttcaccttccctgtgggcctcttcatcctggtgaacaccttcctgccccaggagatgcagatcctgcgggtggtgctggccaccctgggcatcggctctgtgtctgctgccagcaacagcgcctctgtgcaccacaatgagctggtgcccaccatcctgcggagcacagtggccggcatcaatgctgtgtctggccgcactggagctgccctggcccccctgctgatgaccctgatggcctacagcccccacctgccctggatctcctatggagtcttccccatcctggccgtgcctgtgatcctgctgctgcctgagacccgggacctgcccctgcccaacaccatccaggatgtggagaatgagaaggacagcaggaacatcaagcaggaggacacctgcatgaaggtgacccagttctag

SEQ ID NO: 170393 - DNA, 738 bp, Artificial Sequence
  Description of Artificial Sequence: Synthetic coding sequence
atggaggtggaggaggccttccaggccgtgggggagatgggcatctaccagatgtacctgtgcttcctgctggccgtgctgctgcagctgtatgtggccacagaggccatcctgattgccctggtgggcgccacccccagctaccactgggacctggccgagctgctgcccaaccagagccacggcaaccagagcgctggggaggaccaggccttcggggactggctgctgacagccaacggcagcgagatccacaagcacgtgcacttcagcagcagcttcaccagcatcgccagcgagtggttcctgattgccaacagaagctacaaggtgtctgctgccagcagcttcttcttcagcggcgtgtttgtgggcgtcatcagctttggccagctgagtgaccgcttcggcaggaagaaggtgtacctgaccggctttgccctggacatcctgtttgccatcgccaacggcttcagccccagctatgagttctttgctgtgacccgcttcctggtgggcatgatgaatggaggcatgagcctggtggcctttgtgctgctgaatgaatgtgtgggcacagcctactgggccctggccggcagcatcggcggcctcttctttgctgtgggcatcgcccagtatgccctgctgggctacttcatccgctcctggaggaccctggccatcctggtgaacctgcagggcaccgtggtgttcctgctgagcctggtggactag

SEQ ID NO: 170394 - DNA, 1644 bp, Artificial Sequence
  Description of Artificial Sequence: Synthetic coding sequence
atggaggtggaggaggccttccaggccgtgggggagatgggcatctaccagatgtacctgtgcttcctgctggccgtgctgctgcagctgtatgtggccacagaggccatcctgattgccctggtgggcgccacccccagctaccactgggacctggccgagctgctgcccaaccagagccacggcaaccagagcgctggggaggaccaggccttcggggactggctgctgacagccaacggcagcgagatccacaagcacgtgcacttcagcagcagcttcaccagcatcgccagcgagtggttcctgattgccaacagaagctacaaggtgtctgctgccagcagcttcttcttcagcggcgtgtttgtgggcgtcatcagctttggccagctgagtgaccgcttcggcaggaagaaggtgtacctgaccggctttgccctggacatcctgtttgccatcgccaacggcttcagccccagctatgagttctttgctgtgacccgcttcctggtgggcatgatgaatggaggcatgagcctggtggcctttgtgctgctgaatgaatgtgtgggcacagcctactgggccctggccggcagcatcggcggcctcttctttgctgtgggcatcgcccagtatgccctgctgggctacttcatccgctcctggaggaccctggccatcctggtgaacctgcagggcaccgtggtgttcctgctgagcctcttcatccctgagagcccccgctggctgtacagccagggccgcctgtctgaggccgaggaggccctgtacctgattgccaagaggaacaggaagctgaagtgcaccttcagcctgacccacccagccaacagaagctgccgggagaccggcagcttcctggacctcttccgctacagagtgctgctgggccacaccctcatcctgatgttcatctggtttgtgtgcagcctggtgtactacggcctgaccctgtctgctggggacctgggcggcagcatctatgccaacctggccctgagcggcctcatcgagatccccagctaccccctgtgcatctacctgatcaaccagaagtggtttggaaggaagaggaccctgagcgccttcctgtgcctgggcggcctggcctgcctgattgtgatgttcctgcctgagaagaaggacaccggggtgtttgctgtggtgaacagccacagcctgagcctgctgggcaagctgaccatctctgctgccttcaacatcgtgtacatctacaccagcgagctgtaccccaccgtcatcagaaatgtgggcctgggcacctgcagcatgttcagccgggtgggcggcatcatcgcccccttcatccccagcctgaagtatgtgcagtggagcctgcccttcatcgtgtttggagccaccggcctgaccagcggcctgctgagcctgctgctgcctgagaccctgaacagccccctgctggagaccttcagtgacctgcaggtgtacagctaccgccgcctgggggaggaggccctgagcctgcaggccctggacccccagcagtgtgtggacaaggagagcagcctgggcagcgagagcgaggaggaggaggagttctatgatgctgatgaggagacccagatgatcaagtag

SEQ ID NO: 170395 - DNA, 1008 bp, Artificial Sequence
  Description of Artificial Sequence: Synthetic coding sequence
atgcctgctgtgctgggctttgagggcagcgccaacaagattggagtgggcgtggtgagagatggcaaggtgctggccaaccccaggaggacctacgtgaccccacctggcaccggcttcctgcccggggacacagcccggcaccacagagctgtgatcctggacctgctgcaggaggccctgacagagagcggcctgaccagccaggacatcgactgcatcgcctacaccaagggccctggcatgggcgcccccctggtgtctgtggccgtggtggccaggacagtggcccagctgtggaacaagcccctggtgggcgtgaaccactgcatcggccacatcgagatgggccgcctcatcactggagccaccagccccaccgtgctgtatgtgtctgggggcaacacccaggtgattgcctacagcgagcaccgctaccgcatctttggagagaccattgatattgctgtgggcaactgcctggacagatttgcccgggtgctgaagatcagcaatgaccccagccctggctacaacatcgagcagatggccaagaggggcaagaagctggtggagctgccctacacagtgaagggcatggatgtgtccttcagcggcatcctgtccttcattgaagatgtggcccacaggatgctggccactggagaatgtaccccagaggacctgtgcttcagcctgcaggagaccgtgtttgccatgctggtggagatcacagagcgggccatggcccactgcggcagccaggaggccctgattgtgggcggcgtgggctgcaatgtgcggctgcaggagatgatggccaccatgtgccaggagcggggggcccggctgtttgccacagatgagcgcttctgcatcgacaatggagccatgattgcccaggccggctgggagatgttccgggccggccacaggacccccctgagtgacagcggcgtgacccagcgctacagaacagatgaggtggaggtgacctggagggactag

SEQ ID NO: 170396 - DNA, 1563 bp, Artificial Sequence
  Description of Artificial Sequence: Synthetic coding sequence
atggccagtgaccccatcttcaccctggccccacccctgcactgccactatggagccttccccccaaatgccagcggctgggagcagcccccaaatgccagcggcgtgtctgtggccagcgctgccctggccgccagcgctgccagccgggtggccaccagcacagaccccagctgcagcggctttgcccccccagacttcaaccactgcctgaaggactgggactacaacggcctgcctgtgctgaccaccaatgccatcggccagtgggacctggtgtgtgacctgggctggcaggtgatcctggagcagatcctcttcatcctgggctttgccagcggctacctgttcctgggctacccagctgacagatttggaagaagaggcatcgtgctgctgaccctgggcctggtgggcccctgtggggtgggcggcgctgctgctggcagcagcactggagtgatggccctgcgcttcctgctgggcttcctgctggccggcgtggacctgggcgtgtacctgatgaggctggagctgtgtgaccccacccagaggctgcgggtggccctggccggggagctggtgggcgtgggcggccacttcctgttcctgggcctggccctggtgtccaaggactggaggttcctgcagaggatgatcacagccccctgcatcctcttcctgttctacggctggccaggcctcttcctggagagcgcccgctggctgattgtgaagaggcagatcgaggaggcccagagcgtgctgcgcatcctggccgagaggaaccggccccacggccagatgctgggggaggaggcccaggaggccctgcaggacctggagaacacctgccccctgcctgccaccagcagcttctcctttgccagcctgctgaactacagaaacatctggaagaacctgctgatcctgggcttcaccaacttcatcgcccacgccatccgccactgctaccagcctgtgggcggcggcggcagccccagcgacttctacctgtgcagcctgctggccagcggcacagctgccctggcctgtgtgttcctgggcgtgacagtggaccgcttcggccggcggggcatcctgctgctgtccatgaccctgactggaattgccagcctggtgctgctgggcctgtgggactacctgaatgaggccgccatcaccaccttctctgtgctgggcctcttcagcagccaggccgccgccatcctgagcaccctgctggccgctgaggtgatccccaccaccgtgcggggccggggcctgggcctcatcatggccctgggcgccctgggcggcctgagcggccctgcccagaggctgcacatgggccacggggccttcctgcagcacgtggtgctggccgcctgtgccctgctgtgcatcctgagcatcatgctgctgcctgagaccaagaggaagctgctgcctgaggtgctgagagatggagagctgtgccggcggcccagcctgctgcggcagcccccacccacccgctgtgaccacgtgcccctgctggccacccccaacccagccctgtag

SEQ ID NO: 170397 - DNA, 1617 bp, Artificial Sequence
  Description of Artificial Sequence: Synthetic coding sequence
atggccagtgaccccatcttcaccctggccccacccctgcactgccactatggagccttccccccaaatgccagcggctgggagcagcccccaaatgccagcggcgtgtctgtggccagcgctgccctggccgccagcgctgccagccgggtggccaccagcacagaccccagctgcagcggctttgcccccccagacttcaaccactgcctgaaggactgggactacaacggcctgcctgtgctgaccaccaatgccatcggccagtgggacctggtgtgtgacctgggctggcaggtgatcctggagcagatcctcttcatcctgggctttgccagcggctacctgttcctgggctacccagctgacagatttggaagaagaggcatcgtgctgctgaccctgggcctggtgggcccctgtggggtgggcggcgctgctgctggcagcagcactggagtgatggccctgcgcttcctgctgggcttcctgctggccggcgtggacctgggcgtgtacctgatgaggctggagctgtgtgaccccacccagaggctgcgggtggccctggccggggagctggtgggcgtgggcggccacttcctgttcctgggcctggccctggtgtccaaggactggaggttcctgcagaggatgatcacagccccctgcatcctcttcctgttctacggctggccaggcctcttcctggagagcgcccgctggctgattgtgaagaggcagatcgaggaggcccagagcgtgctgcgcatcctggccgagaggaaccggccccacggccagatgctgggggaggaggcccaggaggccctgcaggacctggagaacacctgccccctgcctgccaccagcagcttctcctttgccagcctgctgaactacagaaacatctggaagaacctgctgatcctgggcttcaccaacttcatcgcccacgccatccgccactgctaccagcctgtgggcggcggcggcagccccagcgacttctacctgtgcagcctgctggccagcggcacagctgccctggcctgtgtgttcctgggcgtgacagtggaccgcttcggccggcggggcatcctgctgctgtccatgaccctgactggaattgccagcctggtgctgctgggcctgtgggactgtgagcaccccatcttccccaccgtgtgggcccagcagggcaaccccaacagagacctgaatgaggccgccatcaccaccttctctgtgctgggcctcttcagcagccaggccgccgccatcctgagcaccctgctggccgctgaggtgatccccaccaccgtgcggggccggggcctgggcctcatcatggccctgggcgccctgggcggcctgagcggccctgcccagaggctgcacatgggccacggggccttcctgcagcacgtggtgctggccgcctgtgccctgctgtgcatcctgagcatcatgctgctgcctgagaccaagaggaagctgctgcctgaggtgctgagagatggagagctgtgccggcggcccagcctgctgcggcagcccccacccacccgctgtgaccacgtgcccctgctggccacccccaacccagccctgtag

SEQ ID NO: 170398 - DNA, 1086 bp, Artificial Sequence
  Description of Artificial Sequence: Synthetic coding sequence
atggccatcgacagaagaagagaagctgctgggggcggccctggccggcagcctgccccagcagaagaaaatggcagcctgcccccaggagatgctgctgccagcgcccccctgggcggccgggccggccctgggggcggcgctgagatccagcccctgccccccctgcaccctgggggcggcccccaccccagctgctgcagcgctgctgctgcccccagcctgctgctgctggactatgatggctctgtgctgcccttcctgggcggcctgggcggcggctaccagaagaccctggtgctgctgacctggatcccagccctcttcatcggcttcagccagttcagtgacagcttcctgctggaccagcccaacttctggtgcagaggagctggaaaaggaacagagctggccggcgtgaccaccaccggccggggcggggacatgggcaactggaccagcctgcccaccaccccatttgccacagccccctgggaggccgccggcaacagaagcaacagcagtggagcagatggaggagacaccccacccctgcccagccccccagacaagggggacaatgccagcaactgtgactgccgggcctgggactatggcatccgggccggcctggtgcagaatgtggtgtccaagtgggacctggtgtgtgacaatgcctggaaggtgcacatcgccaagttcagcctgctggtgggcctcatcttcggctacctgatcaccggctgcatcgctgactgggtgggccggcggcctgtgctgctcttcagcatcatcttcatcctgatcttcggcctgactgtggccctgtctgtgaatgtgaccatgttcagcaccctgcgcttctttgagggcttctgcctggccggcatcatcctgaccctgtatgccctgcgcatcgagctgtgccccccaggcaagcgcttcatgatcaccatggtggccagctttgtggccatggccggccagttcctgatgcctggcctggccgccctgtgccgggactggcaggtgctgcaggccctgatcatctgccccttcctgctgatgctgctgtactggagctag

SEQ ID NO: 170399 - DNA, 1218 bp, Artificial Sequence
  Description of Artificial Sequence: Synthetic coding sequence
atgttcagcaccctgcgcttctttgagggcttctgcctggccggcatcatcctgaccctgtatgccctgagaattgagctgtgccccccaggcaagcgcttcatgatcaccatggtggccagctttgtggccatggccggccagttcctgatgcctggcctggccgccctgtgccgggactggcaggtgctgcaggccctgatcatctgccccttcctgctgatgctgctgtactggagcatcttccctgagagcctgcgctggctgatggccacccagcagtttgaaagtgccaagaggctcatcctgcacttcacccagaagaacaggatgaaccctgagggggacatcaagggcgtcatccctgagctggagaaggagctgagccggcggcccaagaaggtgtgcatcgtgaaggtggtgggcaccaggaacctgtggaagaacatcgtggtgctgtgtgtgaacagcctgaccggctacggcatccaccactgctttgcccgctccatgatgggccacgaggtgaaggtgcccctgctggagaacttctacgccgactactacaccacagccagcatcgccctggtgtcctgcctggccatgtgtgtggtggtgcgcttcctgggcagaagaggaggcctgctgctcttcatgatcctgacagccctggccagcctgctgcagctgggcctgctgaacctgattggcaagtacagccagcacccagattctggcatgtctgacagcgtgaaggacaagttcagcatcgccttcagcatcgtgggcatgtttgccagccatgctgtgggcagcctgagcgtcttcttctgtgccgagatcacccccaccgtcatccgctgtggcggcctgggcctggtgctggccagcgctggcttcggcatgctgacagcccccatcatcgagctgcacaaccagaagggctacttcctgcaccacatcatctttgcctgctgcaccctcatctgcatcatctgcatcctgctgctgcctgagagccgggaccagaacctgcctgagaacatcagcaatggagagcactacacccggcagcccctgctgccccacaagaagggggagcagcccctgctgctgaccaatgctgagctgaaggactacagcggcctgcatgatgctgctgctgctggggacaccctgcctgagggcgccacagccaacggcatgaaggccatgtag

SEQ ID NO: 170400 - DNA, 2061 bp, Artificial Sequence
  Description of Artificial Sequence: Synthetic coding sequence
atggccatcgacagaagaagagaagctgctgggggcggccctggccggcagcctgccccagcagaagaaaatggcagcctgcccccaggagatgctgctgccagcgcccccctgggcggccgggccggccctgggggcggcgctgagatccagcccctgccccccctgcaccctgggggcggcccccaccccagctgctgcagcgctgctgctgcccccagcctgctgctgctggactatgatggctctgtgctgcccttcctgggcggcctgggcggcggctaccagaagaccctggtgctgctgacctggatcccagccctcttcatcggcttcagccagttcagtgacagcttcctgctggaccagcccaacttctggtgcagaggagctggaaaaggaacagagctggccggcgtgaccaccaccggccggggcggggacatgggcaactggaccagcctgcccaccaccccatttgccacagccccctgggaggccgccggcaacagaagcaacagcagtggagcagatggaggagacaccccacccctgcccagccccccagacaagggggacaatgccagcaactgtgactgccgggcctgggactatggcatccgggccggcctggtgcagaatgtggtgtccaagtgggacctggtgtgtgacaatgcctggaaggtgcacatcgccaagttcagcctgctggtgggcctcatcttcggctacctgatcaccggctgcatcgctgactgggtgggccggcggcctgtgctgctcttcagcatcatcttcatcctgatcttcggcctgactgtggccctgtctgtgaatgtgaccatgttcagcaccctgcgcttctttgagggcttctgcctggccggcatcatcctgaccctgtatgccctgcgcatcgagctgtgccccccaggcaagcgcttcatgatcaccatggtggccagctttgtggccatggccggccagttcctgatgcctggcctggccgccctgtgccgggactggcaggtgctgcaggccctgatcatctgccccttcctgctgatgctgctgtactggagcatcttccctgagagcctgcgctggctgatggccacccagcagtttgagagcgccaagaggctcatcctgcacttcacccagaagaacaggatgaaccctgagggggacatcaagggcgtcatccctgagctggagaaggagctgagcagaagacccaagaaggtgtgcatcgtgaaggtggtgggcaccaggaacctgtggaagaacatcgtggtgctgtgtgtgaacagcctgaccggctacggcatccaccactgctttgcccgctccatgatgggccacgaggtgaaggtgcccctgctggagaacttctatgctgactactacaccacagccagcatcgccctggtgtcctgcctggccatgtgtgtggtggtgcgcttcctgggccggcggggcggcctgctgctcttcatgatcctgacagccctggccagcctgctgcagctgggcctgctgaacctgattggcaagtacagccagcacccagacagcggcatgtctgattctgtgaaggacaagttcagcatcgccttcagcatcgtgggcatgtttgccagccatgctgtgggcagcctgtctgtgttcttctgtgccgagatcacccccaccgtcatccgctgtggcggcctgggcctggtgctggccagcgctggcttcggcatgctgacagcccccatcatcgagctgcacaaccagaagggctacttcctgcaccacatcatctttgcctgctgcaccctcatctgcatcatctgcatcctgctgctgcctgagagccgggaccagaacctgcctgagaacatcagcaatggagagcactacacccggcagcccctgctgccccacaagaagggggagcagcccctgctgctgaccaatgctgagctgaaggactacagcggcctgcatgatgctgctgctgctggggacaccctgcctgagggcgccacagccaacggcatgaaggccatgtag

SEQ ID NO: 170401 - DNA, 1218 bp, Artificial Sequence; identical to SEQ ID NO: 170399
  Description of Artificial Sequence: Synthetic coding sequence

SEQ ID NO: 170402 - DNA, 969 bp, Artificial Sequence
  Description of Artificial Sequence: Synthetic coding sequence
atgggctttgatgtgctgctggaccaggtgggcggcatgggccgcttccagatctgcctgattgccttcttctgcatcaccaacatcctgctcttccccaacatcgtgctggagaacttcaccgccttcacccccagccaccgctgctgggtgcccctgctggacaatgacacagtgtctgacaatgacaccggcaccctgagcaaggatgacctgctgcgcatcagcatccccctggacagcaacctgcggccccagaagtgccagcgcttcatccacccccagtggcagctgctgcacctgaatggcaccttccccaacaccaatgaaccagacacagagccctgtgtggatggctgggtgtatgacaggagcagcttcctgagcaccatcgtgacagagtgggacctggtgtgtgagagccagagcctgaagtccatggtgcagagcctcttcatggccggcagcctgctgggcggcctcatctacggccacctgagtgacagagtgggcaggaagatcatctgcaagctgtgcttcctgcagctggccatcagcaacacctgtgccgcctttgcccccaccttcctggtgtactgcatcctgcgcttcctggccggcttcagcaccatgaccatcctgggcaacaccttcatcctgagcctggagtggaccctgcccaggagccgctccatgaccatcatggtgctgctgtgcagctacagcgtgggccagatgctgctgggcggcctggcctttgccatccaggactggcacatcctgcagctgactgtgtccacccccatcatcgtgctcttcctgagctcctggtatgagcagagcccccacagcctgcctgtgtctgaggccatggtggacatcgagaggaagatcctgaccccaggcatctgcagcgtgtctggcctggtgctgagccatgatgtgcacagcacctactgtgtgacctag

SEQ ID NO: 170403 - DNA, 780 bp, Artificial Sequence
  Description of Artificial Sequence: Synthetic coding sequence
atgagggcccaggaggacctggagggccgcacccagcacgagaccacccgggaccccagcacccccctgcccacagagcccaagtttgacatgctgtacaagattgaagatgtgcccccctggtacctgtgcatcctgctgggcttccagcactacctgacctgcttcagcggcaccatcgctgtgcccttcctgctggccgaggccctgtgtgtgggccatgaccagcacatggtgtcccagctgattggcaccatcttcacctgtgtgggcatgttctgcaccctgtttggcatgatcacagctgtgggcctgagcaacctgcagtttgtggacatgaacagcagcaggaacctgtttgtgctgggcttctccatgttcttcggcctgaccctgcccaactacctggagagcaaccctggggccatcaacacaggcatcctggaggtggaccagatcctgattgtgctgctgaccacagagatgtttgtgggcggctgcctggccttcatcctggacaacacagtgcccggcagccctgaggagcggggcctcatccagtggaaggccggggcccacgccaacagcgacatgagcagcagcctgaagagctatgacttccccatcggcatgggcatcgtgaagaggatcaccttcctgaagtacatccccatctgccctgtgttcaagggcttcagcagcagcagcaaggaccagatcgccatccctgaggacaccccagagaacacagaaacagcctctgtgtgcaccaaggtgtag

SEQ ID NO: 170404 - DNA, 1797 bp, Artificial Sequence
  Description of Artificial Sequence: Synthetic coding sequence
atgagggcccaggaggacctggagggccgcacccagcacgagaccacccgggaccccagcacccccctgcccacagagcccaagtttgacatgctgtacaagattgaagatgtgcccccctggtacctgtgcatcctgctgggcttccagcactacctgacctgcttcagcggcaccatcgctgtgcccttcctgctggccgaggccctgtgtgtgggccatgaccagcacatggtgtcccagctgattggcaccatcttcacctgtgtgggcatcaccaccctcatccagaccaccgtgggcatccggctgcccctcttccaggccagcgcctttgccttcctggtgcctgccaaggccatcctggccctggagcgctggaagtgccccccagaggaggagatctacggcaactggagcctgcccctgaacaccagccacatctggcacccccgcatccgggaggtgcagggcgccatcatggtgtcctctgtggtggaggtggtgattggcctgctgggcctgcccggggccctgctgaactacatcggccccctgactgtgacccccaccgtgtccctgattggcctgagcgtcttccaggccgccggggacagagctggcagccactggggcatcagcgcctgcagcatcctgctgatcatcctcttcagccagtacctgaggaacctgaccttcctgctgcctgtgtaccgctggggcaagggcctgaccctgctgcgcatccagatcttcaagatgttccccatcatgctggccatcatgacagtgtggctgctgtgctacgtgctgaccctgacagatgtgctgcccacagaccccaaggcctacggcttccaggccaggacagatgcccggggggacatcatggccatcgccccctggatccgcatcccctacccctgccagtggggcctgcccaccgtgacagctgctgctgtgctgggcatgttcagcgccaccctggccggcatcatcgagagcatcggggactactatgcctgtgcccggctggccggggcccctcctcctcctgtgcacgccatcaacagaggcatcttcacagagggcatctgctgcatcatcgccggcctgctgggcactggaaatggcagcaccagcagcagccccaacatcggcgtgctgggcatcaccaaggtgggcagcagaagagtggtgcagtacggggccgccatcatgctggtgctgggcaccatcggcaagttcaccgccctcttcagcagcctgcctgaccccatcctgggcggcatgttctgcaccctgtttggcatgatcacagctgtgggcctgagcaacctgcagtttgtggacatgaacagcagcaggaacctgtttgtgctgggcttctccatgttcttcggcctgaccctgcccaactacctggagagcaaccctggggccatcaacacaggcatcctggaggtggaccagatcctgattgtgctgctgaccacagagatgtttgtgggcggctgcctggccttcatcctggacaacacagtgcccggcagccctgaggagcggggcctcatccagtggaaggccggggcccacgccaacagcgacatgagcagcagcctgaagagctatgacttccccatcggcatgggcatcgtgaagaggatcaccttcctgaagtacatccccatctgccctgtgttcaagggcttcagcagcagcagcaaggaccagatcgccatccctgaggacaccccagaaaatacagaaacagcctctgtgtgcaccaaggtgtag

SEQ ID NO: 170405 - DNA, 1809 bp, Artificial Sequence
  Description of Artificial Sequence: Synthetic coding sequence
atgagggcccaggaggacctggagggccgcacccagcacgagaccacccgggaccccagcacccccctgcccacagagcccaagtttgacatgctgtacaagattgaagatgtgcccccctggtacctgtgcatcctgctgggcttccagcactacctgacctgcttcagcggcaccatcgctgtgcccttcctgctggccgaggccctgtgtgtgggccatgaccagcacatggtgtcccagctgattggcaccatcttcacctgtgtgggcatcaccaccctcatccagaccaccgtgggcatccggctgcccctcttccaggccagcgcctttgccttcctggtgcctgccaaggccatcctggccctggagcgctggaagtgccccccagaggaggagatctacggcaactggagcctgcccctgaacaccagccacatctggcacccccgcatccgggaggtgggcctgcacgtgcagggcgccatcatggtgtcctctgtggtggaggtggtgattggcctgctgggcctgcccggggccctgctgaactacatcggccccctgactgtgacccccaccgtgtccctgattggcctgagcgtcttccaggccgccggggacagagctggcagccactggggcatcagcgcctgcagcatcctgctgatcatcctcttcagccagtacctgaggaacctgaccttcctgctgcctgtgtaccgctggggcaagggcctgaccctgctgcgcatccagatcttcaagatgttccccatcatgctggccatcatgacagtgtggctgctgtgctacgtgctgaccctgacagatgtgctgcccacagaccccaaggcctacggcttccaggccaggacagatgcccggggggacatcatggccatcgccccctggatccgcatcccctacccctgccagtggggcctgcccaccgtgacagctgctgctgtgctgggcatgttcagcgccaccctggccggcatcatcgagagcatcggggactactatgcctgtgcccggctggccggggcccctcctcctcctgtgcacgccatcaacagaggcatcttcacagagggcatctgctgcatcatcgccggcctgctgggcactggaaatggcagcaccagcagcagccccaacatcggcgtgctgggcatcaccaaggtgggcagcagaagagtggtgcagtacggggccgccatcatgctggtgctgggcaccatcggcaagttcaccgccctcttcagcagcctgcctgaccccatcctgggcggcatgttctgcaccctgtttggcatgatcacagctgtgggcctgagcaacctgcagtttgtggacatgaacagcagcaggaacctgtttgtgctgggcttctccatgttcttcggcctgaccctgcccaactacctggagagcaaccctggggccatcaacacaggcatcctggaggtggaccagatcctgattgtgctgctgaccacagagatgtttgtgggcggctgcctggccttcatcctggacaacacagtgcccggcagccctgaggagcggggcctcatccagtggaaggccggggcccacgccaacagcgacatgagcagcagcctgaagagctatgacttccccatcggcatgggcatcgtgaagaggatcaccttcctgaagtacatccccatctgccctgtgttcaagggcttcagcagcagcagcaaggaccagatcgccatccctgaggacaccccagaaaatacagaaacagcctctgtgtgcaccaaggtgtag

SEQ ID NO: 170406 - DNA, 1179 bp, Artificial Sequence
  Description of Artificial Sequence: Synthetic coding sequence
atgagggcccaggaggacctggagggccgcacccagcacgagaccacccgggaccccagcacccccctgcccacagagcccaagtttgacatgctgtacaagattgaagatgtgcccccctggtacctgtgcatcctgctgggcttccagcactacctgacctgcttcagcggcaccatcgctgtgcccttcctgctggccgaggccctgtgtgtgggccatgaccagcacatggtgtcccagctgattggcaccatcttcacctgtgtgggcatcaccaccctcatccagaccaccgtgggcatccggctgcccctcttccaggccagcgcctttgccttcctggtgcctgccaaggccatcctggccctggagcgctggaagtgccccccagaggaggagatctacggcaactggagcctgcccctgaacaccagccacatctggcacccccgcatccgggaggtgggcctgcacgtgtccattgaggaggccggcggctacatgggcgtgcgggtggccgctgagtttggagacctgcggcgctggagccgcagctttgtgcctgccagcagcagccaggtgcagggcgccatcatggtgtcctctgtggtggaggtggtgattggcctgctgggcctgcccggggccctgctgaactacatcggccccctgactgtgacccccaccgtgtccctcatcggcctgtctgtgttccaggccgccggggaccgggccggcagccactggggcatcagcgcctgcagcatcctgctgatcatcctcttcagccagtacctgaggaacctgaccttcctgctgccctgtgcccagcagagcgcccccctgtggcaggccagcctgagccccagcgagatcaccacccctgtgcctgcctggctggtgcaccaccccctgcagtacatgctgagcactggagccagcagccccaaggcctttgctgccagcagccggggctactgggcccgggccaccggcccccccaggcctgtgcccaccctggcctcctgggagctgccccgctgggccgccggggcctggtgcagcatggtgcggctgagctgctggagctgggcccccagcgccagcagccggcccagcagccccaggagcctgacccccagctggggcgcctgcagcgccctgagcctggcctag

SEQ ID NO: 170407 - DNA, 1953 bp, Artificial Sequence
  Description of Artificial Sequence: Synthetic coding sequence
atgatgggcatcggcaagaacaccaccagcaagtccatggaggccggcagcagcacagagggcaagtatgaagatgaggccaagcacccagccttcttcaccctgcctgtggtgatcaatggaggagccaccagcagcggggagcaggacaatgaagacacagagctgatggccatctacaccacagaaaatggaattgctgagaagagcagcctggccgagaccctggacagcacaggcagcctggacccccagaggagtgacatgatctacaccattgaagatgtgcccccctggtacctgtgcatcttcctgggcctgcagcactacctgacctgcttcagcggcaccatcgctgtgcccttcctgctggctgatgccatgtgtgtgggctatgaccagtgggccaccagccagctgattggcaccatcttcttctgtgtgggcatcaccaccctgctgcagaccaccttcggctgccgcctgcccctcttccaggccagcgcctttgccttcctggccccagcccgggccatcctgagcctggacaagtggaagtgcaacaccacagatgtgtctgtggccaacggcacagctgagctgctgcacacagagcacatctggtacccccgcatccgggagatccagggcgccatcatcatgagcagcctgattgaggtggtgattggcctgctgggcctgcccggggccctgctgaagtacatcggccccctgaccatcacccccaccgtggccctgattggcctgagcggcttccaggccgccggggagcgggccggcaagcactggggcatcgccatgctgaccatcttcctggtgctgctcttcagccagtatgccagaaatgtgaagttccccctgcccatctacaagagcaagaagggctggacagcctacaagctgcagctgttcaagatgttccccatcatcctggccatcctggtgtcctggctgctgtgcttcatcttcaccgtgacagatgtgtttcctccagacagcaccaagtatggcttctacgccaggacagatgcccggcagggcgtgctgctggtggccccctggttcaaggtgccctaccccttccagtggggcctgcccaccgtgtctgctgctggggtgattggcatgctgtctgctgtggtggccagcatcatcgagagcattggagactactatgcctgtgcccggctgagctgtgcccctcctccacccatccacgccatcaacagaggcatctttgtggagggcctgagctgtgtgctggatggcatcttcggcactggaaatggcagcaccagcagcagccccaacattggagtgctgggcatcaccaaggtgggcagccggcgggtcatccagtgtggggccgccctgatgctggccctgggcatgattggcaagttcagcgccctgtttgccagcctgcctgaccctgtgctgggcgccctcttctgcaccctgtttggcatgatcacagctgtgggcctgagcaacctgcagttcatcgacctgaacagcagcaggaacctgtttgtgctgggcttcagcatcttcttcggcctggtgctgcccagctacctgcggcagaaccccctggtgacaggcatcaccggcatcgaccaggtgctgaatgtgctgctgaccacagccatgtttgtgggcggctgtgtggccttcatcctggacaacaccatccctggcaccccagaggagcggggcatcaggaagtggaagaagggcgtgggcaagggcaacaagagcctggatggcatggagagctacaacctgcccttcggcatgaacatcatcaagaagtaccgctgcttctcctacctgcccatcagccccacctttgtgggctacacctggaagggcctgaggaagagtgacaacagccgcagcagtgatgaggacagccaggccactggatag

SEQ ID NO: 170408 - DNA, 1953 bp, Artificial Sequence; identical to SEQ ID NO: 170407
  Description of Artificial Sequence: Synthetic coding sequence

SEQ ID NO: 170409 - DNA, 915 bp, Artificial Sequence
  Description of Artificial Sequence: Synthetic coding sequence
tgaggatatgaccagtgggccaccagccagctgattggcaccatcttcttctgtgtgggcatcaccaccctgctgcagaccaccttcggctgcaggaccatcttcctggtgctgctcttcagccagtatgccagaaatgtgaagttccccctgcccatctacaagagcaagaagggctggacagcctacaagctgcagctgttcaagatgttccccatcatcctggccatcctggtgtcctggctgctgtgcttcatcttcaccgtgacagatgtgttccccccagacagcaccaagtatggcttctacgccaggacagatgcccggcagggcgtgctgctggtggccccctggttcaaggtgccctaccccttccagtggggcctgcccaccgtgtctgctgctggggtcatcggcatgctgtctgctgtggtggccagcatcatcgagagcatcggggactactatgcctgtgcccggctgagctgtgcccctcctccacccatccacgccatcaacagaggcatctttgtggagggcctgagctgtgtgctggatggcatctttggaactggaaatggcagcaccagcagcagccccaacatcggcgtgctgggcatcaccaaggtgggcagcagaagagtcatccagtgtggggccgccctgatgctggccctgggcatgattggcaagttcagcgccctgtttgccagcctgcctgaccctgtgctgggcgccctcttctgcaccctgtttggcatgatcacagctgtgggcctgagcaacctgcagttcatcgacctgaacagcagcaggaacctgtttgtgctgggcttcagcatcttcttcggcctggtgctgcccagctacctgcggcagaaccccctggtgacaggcatcactggaattgattag

SEQ ID NO: 170410 - DNA, 1611 bp, Artificial Sequence
  Description of Artificial Sequence: Synthetic coding sequence
atgatgggcatcggcaagaacaccaccagcaagtccatggaggccggcagcagcacagagggcaagtatgaagatgaggccaagcacccagccttcttcaccctgcctgtggtgatcaatggaggagccaccagcagcggggagcaggacaatgaagacacagagctgatggccatctacaccacagaaaatggaattgctgagaagagcagcctggccgagaccctggacagcacaggcagcctggacccccagaggagtgacatgatctacaccattgaagatgtgcccccctggtacctgtgcatcttcctgggcctgcagcactacctgacctgcttcagcggcaccatcgctgtgcccttcctgctggctgatgccatgtgtgtgggctatgaccagtgggccaccagccagctgattggcaccatcttcttctgtgtgggcatcaccaccctgctgcagaccaccttcggctgcaggaccatcttcctggtgctgctcttcagccagtatgccagaaatgtgaagttccccctgcccatctacaagagcaagaagggctggacagcctacaagctgcagctgttcaagatgttccccatcatcctggccatcctggtgtcctggctgctgtgcttcatcttcaccgtgacagatgtgtttcctccagacagcaccaagtatggcttctacgccaggacagatgcccggcagggcgtgctgctggtggccccctggttcaaggtgccctaccccttccagtggggcctgcccaccgtgtctgctgctggggtgattggcatgctgtctgctgtggtggccagcatcatcgagagcattggagactactatgcctgtgcccggctgagctgtgcccctcctccacccatccacgccatcaacagaggcatctttgtggagggcctgagctgtgtgctggatggcatcttcggcactggaaatggcagcaccagcagcagccccaacattggagtgctgggcatcaccaaggtgggcagccggcgggtcatccagtgtggggccgccctgatgctggccctgggcatgattggcaagttcagcgccctgtttgccagcctgcctgaccctgtgctgggcgccctcttctgcaccctgtttggcatgatcacagctgtgggcctgagcaacctgcagttcatcgacctgaacagcagcaggaacctgtttgtgctgggcttcagcatcttcttcggcctggtgctgcccagctacctgcggcagaaccccctggtgacaggcatcaccggcatcgaccaggtgctgaatgtgctgctgaccacagccatgtttgtgggcggctgtgtggccttcatcctggacaacaccatccctggcaccccagaggagcggggcatcaggaagtggaagaagggcgtgggcaagggcaacaagagcctggatggcatggagagctacaacctgcccttcggcatgaacatcatcaagaagtaccgctgcttctcctacctgcccatcagccccacctttgtgggctacacctggaagggcctgaggaagagtgacaacagccgcagcagtgatgaggacagccaggccactggatag

SEQ ID NO: 170411 - DNA, 3300 bp, Artificial Sequence
  Description of Artificial Sequence: Synthetic coding sequence
atgggcaagctgatccgcatgggcccccaggagcgctggctgctgcggaccaagaggctgcactggagccggctgctcttcctgctgggcatgctgatcatcggcagcacctaccagcacctgcggcggccccggggcctgagcagcctgtgggccgctgtgagcagccaccagcccatcaagctggccagccgggacctgagcagcgaggagatgatgatgatgagcagcagccccagcaagcccagcagcgagatgggcggcaagatgctggtgccccaggcctctgtgggcagtgatgaggccaccctgtccatgacagtggagaacatccccagcatgcccaagaggacagccaagatgatccccaccaccaccaagaacaactacagccccacagctgctggaacagaaagaaggaaggaggacacccccaccagcagcaggaccctgacctactacaccagcaccagcagccggcagatcgtgaagaagtacacccccaccccaagaggagagatgaagagctacagccccacccaggtgcgggagaaggtgaagtacacccccagcccccggggcagaagagtgggcacctacgtgcccagcaccttcatgaccatggagaccagccacgccatcacccccaggaccaccgtgaaggacagcgacatcacagccacctacaagatcctggagaccaacagcctgaagaggatcatggaggagaccacccccaccaccctgaagggcatgtttgacagcacccccaccttcctgacccatgaggtggaggccaacgtgctgaccagccccaggtctgtgatggagaagaacaacctcttccccccaagaagagtggagagcaacagcagcgcccacccctggggcctggtgggcaagagcaaccccaagaccccccagggcaccgtgctgctgcacaccccagccaccagcgagggccaggtgaccatcagcaccatgacaggcagcagccctgctgagaccaaggccttcaccgctgcctggagcctgaggaaccccagccccaggacctctgtgtctgccatcaagacagccccagccatcgtgtggaggctggccaagaagcccagcacagcccccagcaccagcaccacccccaccgtgcgggccaagctgaccatgcaggtgcaccactgtgtggtggtgaagcccaccccagccatgctgaccacccccagccccagcctgaccacagccctgctgcctgaggagctgagccccagccccagcgtgctgccccccagcctgcctgacctgcaccccaagggggagtaccccccagacctcttctctgtggaggagcggcggcagggctgggtggtgctgcacgtgtttggcatgatgtatgtgtttgtggccctggccatcgtgtgtgatgagtactttgtgcctgccctgggcgtcatcacagacaagctgcagatcagtgaagatgtggccggggccaccttcatggccgccggcggcagcgcccctgagctgttcaccagcctcatcggggtcttcatcagccacagcaatgtgggcatcggcaccatcgtgggcagcgctgtgttcaacatcctcttcgtcatcggcacctgcagcctcttcagccgggagatcctgaacctgacctggtggcccctcttcagagatgtgtccttctacatcctggacctgatcatgctgatcctcttcttcctggacagcctgattgcctggtgggagagcctgctgctgctgctggcctatgccttctacgtgttcaccatgaagtggaacaagcacatcgaggtgtgggtgaaggagcagctgagccggcggcctgtggccaaggtgatggccctggaggacctgagcaagccaggagatggagccatcgctgtggatgagctgcaggacaacaagaagctgaagctgcccagcctgctgacccggggcagcagcagcaccagcctgcacaacagcaccatccgcagcaccatctaccagctgatgctgcacagcctggaccccctgcgggaggtgcggctggccaaggagaaggaggaggagagcctgaaccagggcgcccgggcccagccccaggccaaggccgagagcaagccagaggaggaggagcccgccaagctgcctgctgtgacagtgaccccagcccctgtgcctgacatcaagggggaccagaaggaaaatcctgggggccaggaggatgtggccgaggccgagagcactggagagatgcctggagaggagggggagacagctggggagggggagacagaggagaagtctggaggagagacccagcctgagggggagggggagacagagacccagggcaagggggaggagtgtgaagatgaaaatgaggccgagggcaaaggagacaatgaaggagaagatgaaggagagatccacgcagaagatggagagatgaagggaaatgaaggagaaacagagagccaggagctgtctgctgagaaccacggggaggccaagaatgatgagaagggcgtggaggatggcggcggcagtgatggaggagacagcgaggaggaggaggaggaggaggaggagcaggaggaggaggaggaggaggaggagcaggaggaggaggaggaggaggaggaggaggaggaggagaagggaaatgaggagcccctgagcctggactggccagagacccggcagaagcaggccatctacctgttcctgctgcccatcgtgttccccctgtggctgactgtgcctgatgtgcggcggcaggagagcaggaagttctttgtgttcaccttcctgggcagcatcatgtggatcgccatgttctcctacctgatggtgtggtgggcccaccaggtgggggagaccatcggcatcagcgaggagatcatgggcctgaccatcctggccgccggcaccagcatcccagacctgatcaccagcgtcatcgtggccaggaagggcctgggggacatggctgtgagcagctctgtgggcagcaacatctttgacatcaccgtgggcctgcctgtgccctggctgctcttcagcctcatcaatggcctgcagcctgtgcctgtgagcagcaatggcctcttctgtgccatcgtgctgctcttcctgatgctgctcttcgtcatcagcagcatcgccagctgcaagtggaggatgaacaagatcctgggcttcaccatgttcctgctgtactttgtgttcctgatcatctctgtgatgctggaggaccgcatcatcagctgccctgtgtctgtgtag

SEQ ID NO: 170412 - DNA, 3246 bp, Artificial Sequence
  Description of Artificial Sequence: Synthetic coding sequence
atgggcaagctgatccgcatgggcccccaggagcgctggctgctgcggaccaagaggctgcactggagccggctgctcttcctgctgggcatgctgatcatcggcagcacctaccagcacctgcggcggccccggggcctgagcagcctgtgggccgctgtgagcagccaccagcccatcaagctggccagccgggacctgagcagcgaggagatgatgatgatgagcagcagccccagcaagcccagcagcgagatgggcggcaagatgctggtgccccaggcctctgtgggcagtgatgaggccaccctgtccatgacagtggagaacatccccagcatgcccaagaggacagccaagatgatccccaccaccaccaagaacaactacagccccacagctgctggaacagaaagaaggaaggaggacacccccaccagcagcaggaccctgacctactacaccagcaccagcagccggcagatcgtgaagaagtacacccccaccccaagaggagagatgaagagctacagccccacccaggtgcgggagaaggtgaagtacacccccagcccccggggcagaagagtgggcacctacgtgcccagcaccttcatgaccatggagaccagccacgccatcacccccaggaccaccgtgaaggacagcgacatcacagccacctacaagatcctggagaccaacagcctgaagaggatcatggaggagaccacccccaccaccctgaagggcatgtttgacagcacccccaccttcctgacccatgaggtggaggccaacgtgctgaccagccccaggtctgtgatggagaagaacaacctcttccccccaagaagagtggagagcaacagcagcgcccacccctggggcctggtgggcaagagcaaccccaagaccccccagggcaccgtgctgctgcacaccccagccaccagcgagggccaggtgaccatcagcaccatgacaggcagcagccctgctgagaccaaggccttcaccgctgcctggagcctgaggaaccccagccccaggacctctgtgtctgccatcaagacagccccagccatcgtgtggaggctggccaagaagcccagcacagcccccagcaccagcaccacccccaccgtgcgggccaagctgaccatgcaggtgcaccactgtgtggtggtgaagcccaccccagccatgctgaccacccccagccccagcctgaccacagccctgctgcctgaggagctgagccccagccccagcgtgctgccccccagcctgcctgacctgcaccccaagggggagtaccccccagacctcttctctgtggaggagcggcggcagggctgggtggtgctgcacgtgtttggcatgatgtatgtgtttgtggccctggccatcgtgtgtgatgagtactttgtgcctgccctgggcgtcatcacagacaagctgcagatcagtgaagatgtggccggggccaccttcatggccgccggcggcagcgcccctgagctgttcaccagcctcatcggggtcttcatcagccacagcaatgtgggcatcggcaccatcgtgggcagcgctgtgttcaacatcctcttcgtcatcggcacctgcagcctcttcagccgggagatcctgaacctgacctggtggcccctcttcagagatgtgtccttctacatcctggacctgatcatgctgatcctcttcttcctggacagcctgattgcctggtgggagagcctgctgctgctgctggcctatgccttctacgtgttcaccatgaagtggaacaagcacatcgaggtgtgggtgaaggagcagctgagccggcggcctgtggccaaggtgatggccctggaggacctgagcaagctgcccagcctgctgacccggggcagcagcagcaccagcctgcacaacagcaccatccgcagcaccatctaccagctgatgctgcacagcctggaccccctgcgggaggtgcggctggccaaggagaaggaggaggagagcctgaaccagggcgcccgggcccagccccaggccaaggccgagagcaagccagaggaggaggagcccgccaagctgcctgctgtgacagtgaccccagcccctgtgcctgacatcaagggggaccagaaggaaaatcctgggggccaggaggatgtggccgaggccgagagcactggagagatgcctggagaggagggggagacagctggggagggggagacagaggagaagtctggaggagagacccagcctgagggggagggggagacagagacccagggcaagggggaggagtgtgaagatgaaaatgaggccgagggcaaaggagacaatgaaggagaagatgaaggagagatccacgcagaagatggagagatgaagggaaatgaaggagaaacagagagccaggagctgtctgctgagaaccacggggaggccaagaatgatgagaagggcgtggaggatggcggcggcagtgatggaggagacagcgaggaggaggaggaggaggaggaggagcaggaggaggaggaggaggaggaggagcaggaggaggaggaggaggaggaggaggaggaggaggagaagggaaatgaggagcccctgagcctggactggccagagacccggcagaagcaggccatctacctgttcctgctgcccatcgtgttccccctgtggctgactgtgcctgatgtgcggcggcaggagagcaggaagttctttgtgttcaccttcctgggcagcatcatgtggatcgccatgttctcctacctgatggtgtggtgggcccaccaggtgggggagaccatcggcatcagcgaggagatcatgggcctgaccatcctggccgccggcaccagcatcccagacctgatcaccagcgtcatcgtggccaggaagggcctgggggacatggctgtgagcagctctgtgggcagcaacatctttgacatcaccgtgggcctgcctgtgccctggctgctcttcagcctcatcaatggcctgcagcctgtgcctgtgagcagcaatggcctcttctgtgccatcgtgctgctcttcctgatgctgctcttcgtcatcagcagcatcgccagctgcaagtggaggatgaacaagatcctgggcttcaccatgttcctgctgtactttgtgttcctgatcatctctgtgatgctggaggaccgcatcatcagctgccctgtgtctgtgtag

SEQ ID NO: 170413 - DNA, 3210 bp, Artificial Sequence
  Description of Artificial Sequence: Synthetic coding sequence
atgggcaagctgatccgcatgggcccccaggagcgctggctgctgcggaccaagaggctgcactggagccggctgctcttcctgctgggcatgctgatcatcggcagcacctaccagcacctgcggcggccccggggcctgagcagcctgtgggccgctgtgagcagccaccagcccatcaagctggccagccgggacctgagcagcgaggagatgatgatgatgagcagcagccccagcaagcccagcagcgagatgggcggcaagatgctggtgccccaggcctctgtgggcagtgatgaggccaccctgtccatgacagtggagaacatccccagcatgcccaagaggacagccaagatgatccccaccaccaccaagaacaactacagccccacagctgctggaacagaaagaaggaaggaggacacccccaccagcagcaggaccctgacctactacaccagcaccagcagccggcagatcgtgaagaagtacacccccaccccaagaggagagatgaagagctacagccccacccaggtgcgggagaaggtgaagtacacccccagcccccggggcagaagagtgggcacctacgtgcccagcaccttcatgaccatggagaccagccacgccatcacccccaggaccaccgtgaaggacagcgacatcacagccacctacaagatcctggagaccaacagcctgaagaggatcatggaggagaccacccccaccaccctgaagggcatgtttgacagcacccccaccttcctgacccatgaggtggaggccaacgtgctgaccagccccaggtctgtgatggagaagaacaacctcttccccccaagaagagtggagagcaacagcagcgcccacccctggggcctggtgggcaagagcaaccccaagaccccccagggcaccgtgctgctgcacaccccagccaccagcgagggccaggtgaccatcagcaccatgacaggcagcagccctgctgagaccaaggccttcaccgctgcctggagcctgaggaaccccagccccaggacctctgtgtctgccatcaagacagccccagccatcgtgtggaggctggccaagaagcccagcacagcccccagcaccagcaccacccccaccgtgcgggccaagctgaccatgcaggtgcaccactgtgtggtggtgaagcccaccccagccatgctgaccacccccagccccagcctgaccacagccctgctgcctgaggagctgagccccagccccagcgtgctgccccccagcctgcctgacctgcaccccaagggggagtaccccccagacctcttctctgtggaggagcggcggcagggctgggtggtgctgcacgtgtttggcatgatgtatgtgtttgtggccctggccatcgtgtgtgatgagtactttgtgcctgccctgggcgtcatcacagacaagctgcagatcagtgaagatgtggccggggccaccttcatggccgccggcggcagcgcccctgagctgttcaccagcctcatcggggtcttcatcagccacagcaatgtgggcatcggcaccatcgtgggcagcgctgtgttcaacatcctcttcgtcatcggcacctgcagcctcttcagccgggagatcctgaacctgacctggtggcccctcttcagagatgtgtccttctacatcctggacctgatcatgctgatcctcttcttcctggacagcctgattgcctggtgggagagcctgctgctgctgctggcctatgccttctacgtgttcaccatgaagtggaacaagcacatcgaggtgtgggtgaaggagcagctgagccggcggcctgtggccaaggtgatggccctggaggacctgagcaagccaggagatggagccatcgctgtggatgagctgcaggacaacaagaagctgaagctgcccagcctgctgacccggggcagcagcagcaccagcctgcacaacagcaccatccgcagcaccatctaccagctgatgctgcacagcctggaccccctgcgggaggtgcggctggccaaggagaaggaggaggagagcctgaaccagggcgcccgggcccagccccaggccaaggccgagagcaagccagaggaggaggagcccgccaagctgcctgctgtgacagtgaccccagcccctgtgcctgacatcaagggggaccagaaggaaaatcctgggggccaggaggatgtggccgaggccgagagcactggagagatgcctggagaggagggggagacagctggggagggggagacagaggagaagtctggaggagagacccagcctgagggggagggggagacagagacccagggcaagggggaggagtgtgaagatgaaaatgaggccgagggcaaaggagacaatgaaggagaagatgaaggagagatccacgcagaagatggagagatgaagggaaatgaaggagaaacagagagccaggagctgtctgctgagaaccacggggaggccaagaatgatgagaagggcgtggaggatggcggcggcagtgatggaggagacagcgaggaggaggaggaggaggaggaggagcaggaggaggaggaggaggaggaggagcaggaggaggaggaggaggaggaggaggaggaggaggagaagggaaatgaggagcccctgagcctggactggccagagacccggcagaagcaggccatctacctgttcctgctgcccatcgtgttccccctgtggctgactgtgcctgatgtgcggcggcaggtgggggagaccatcggcatcagcgaggagatcatgggcctgaccatcctggccgccggcaccagcatcccagacctgatcaccagcgtcatcgtggccaggaagggcctgggggacatggctgtgagcagctctgtgggcagcaacatctttgacatcaccgtgggcctgcctgtgccctggctgctcttcagcctcatcaatggcctgcagcctgtgcctgtgagcagcaatggcctcttctgtgccatcgtgctgctcttcctgatgctgctcttcgtcatcagcagcatcgccagctgcaagtggaggatgaacaagatcctgggcttcaccatgttcctgctgtactttgtgttcctgatcatctctgtgatgctggaggaccgcatcatcagctgccctgtgtctgtgtag

SEQ ID NO: 170414 - DNA, 3246 bp, Artificial Sequence; identical to SEQ ID NO: 170412
  Description of Artificial Sequence: Synthetic coding sequence

SEQ ID NO: 170415 - DNA, 1935 bp, Artificial Sequence
  Description of Artificial Sequence: Synthetic coding sequence
atggacctgcagcagagcaccaccatcaccagcctggagaagtggtgcctggatgagagcctgagcggctgcagaagacactacagcgtgaagaagaagctgaagctgatccgggtgctgggcctcttcatgggcctggtggccatcagcacagtgtccttcagcatcagcgccttcagcgagacagacacccagagcactggagaggcctctgtggtgtctggcccccgggtggcccagggctaccaccagaggaccctgctggacctgaatgacaagatcctggactacaccccccagccccccctgagcaaggagggggagagcgagaacagcacagaccacgcccagggcgactaccccaaggacatcttcagcctggaggagaggaggaagggggccatcatcctgcacgtgattggcatgatctacatgtttattgccctggccatcgtgtgtgatgagttctttgtgcccagcctgaccgtcatcacagagaagctgggcatcagtgatgatgtggccggggccaccttcatggccgccggcggcagcgcccctgagctgttcaccagcctcatcggggtcttcatcgcccacagcaatgtgggcatcggcaccatcgtgggcagcgctgtgttcaacatcctcttcgtcatcggcatgtgtgccctcttcagccgggagatcctgaacctgacctggtggcccctcttcagagatgtgtccttctacatcgtggacctgatcatgctgatcatcttcttcctggacaacgtcatcatgtggtgggagagcctgctgctgctgacagcctacttctgctacgtggtgttcatgaagttcaacgtgcaggtggagaagtgggtgaagcagatgatcaacagaaacaaggtggtgaaggtgacagcccctgaggcccaggccaagcccagcgctgcccgggacaaggatgagcccaccctgcctgccaagccccggctgcagagaggaggcagcagcgccagcctgcacaacagcctgatgagaaattccatcttccagctgatgatccacaccctggaccccctggccgagggccgcttccgggagaaggccagcatcctgcacaagatcgccaagaagaagtgccacgtggatgaaaatgaaaggcagaatggagctgccaaccacgtggagaagattgagctgcccaacagcaccagcacagatgtggagatgacccccagcagtgatgccagcgagcctgtgcagaatggaaacctgagccacaacatcgagggcgctgaggcccagacagcagatgaggaggaggaccagcccctgagcctggcctggcccagcgagaccaggaagcaggtgaccttcctgattgtgttccccatcgtgttccccctgtggatcaccctgcctgatgtgaggaagcccagcagcaggaagttcttccccatcaccttcttcggcagcatcacctggattgctgtgttctcctacctgatggtgtggtgggcccaccaggtgggggagaccatcggcatcagcgaggagatcatgggcctgaccatcctggccgccggcaccagcatcccagacctgatcacctctgtgattgtggccaggaagggcctgggggacatggctgtgagcagctctgtgggcagcaacatctttgacatcaccgtgggcctgcccctgccctggctgctgtacaccgtcatccaccgcttccagcctgtggccgtgagcagcaatggcctcttctgtgccatcgtgctgctcttcatcatgctgctgtttgtgatcctgagcatcgccctgtgcaagtggaggatgaacaagatcctgggcttcatcatgtttggcctgtactttgtgttcctggtggtgtctgtgctgctggaggaccgcatcctgacctgccctgtgtccatctag

SEQ ID NO: 170416 - DNA, 1986 bp, Artificial Sequence
  Description of Artificial Sequence: Synthetic coding sequence
atggacctgcagcagagcaccaccatcaccagcctggagaagtggtgcctggatgagagcctgagcggctgcagaagacactacagcgtgaagaagaagctgaagctgatccgggtgctgggcctcttcatgggcctggtggccatcagcacagtgtccttcagcatcagcgccttcagcgagacagacacccagagcactggagaggcctctgtggtgtctggcccccgggtggcccagggctaccaccagaggaccctgctggacctgaatgacaagatcctggactacaccccccagccccccctgagcaaggagggggagagcgagaacagcacagaccacgcccagggcgactaccccaaggacatcttcagcctggaggagaggaggaagggggccatcatcctgcacgtgattggcatgatctacatgtttattgccctggccatcgtgtgtgatgagttctttgtgcccagcctgaccgtcatcacagagaagctgggcatcagtgatgatgtggccggggccaccttcatggccgccggcggcagcgcccctgagctgttcaccagcctcatcggggtcttcatcgcccacagcaatgtgggcatcggcaccatcgtgggcagcgctgtgttcaacatcctcttcgtcatcggcatgtgtgccctcttcagccgggagatcctgaacctgacctggtggcccctcttcagagatgtgtccttctacatcgtggacctgatcatgctgatcatcttcttcctggacaacgtcatcatgtggtgggagagcctgctgctgctgacagcctacttctgctacgtggtgttcatgaagttcaacgtgcaggtggagaagtgggtgaagcagatgatcaacagaaacaaggtggtgaaggtgacagcccctgaggcccaggccaagcccagcgctgcccgggacaaggatgagcccaccctgcctgccaagccccggctgcagagaggaggcagcagcgccagcctgcacaacagcctgatgagaaattccatcttccagctgatgatccacaccctggaccccctggccgaggagctgggcagctatggcaagctgaagtactatgacaccatgacagaggagggccgcttccgggagaaggccagcatcctgcacaagatcgccaagaagaagtgccacgtggatgaaaatgaaaggcagaatggagctgccaaccacgtggagaagattgagctgcccaacagcaccagcacagatgtggagatgacccccagcagtgatgccagcgagcctgtgcagaatggaaacctgagccacaacattgaaggagctgaggcccagacagcagatgaggaggaggaccagcccctgagcctggcctggcccagcgagaccaggaagcaggtgaccttcctgattgtgttccccatcgtgttccccctgtggatcaccctgcctgatgtgaggaagcccagcagcaggaagttcttccccatcaccttcttcggcagcatcacctggattgctgtgttctcctacctgatggtgtggtgggcccaccaggtgggggagaccatcggcatcagcgaggagatcatgggcctgaccatcctggccgccggcaccagcatcccagacctgatcaccagcgtcatcgtggccaggaagggcctgggggacatggctgtgagcagctctgtgggcagcaacatctttgacatcaccgtgggcctgcccctgccctggctgctgtacaccgtcatccaccgcttccagcctgtggccgtgagcagcaatggcctcttctgtgccatcgtgctgctcttcatcatgctgctcttcgtcatcctgagcatcgccctgtgcaagtggaggatgaacaagatcctgggcttcatcatgtttggcctgtactttgtgttcctggtggtgtctgtgctgctggaggaccgcatcctgacctgccctgtgtccatctag

SEQ ID NO: 170417 - DNA, 1935 bp, Artificial Sequence
  Description of Artificial Sequence: Synthetic coding sequence
atgaggcccagcggagatgaagatcgggccaggagaagaagaagaagaagaagaagaagagacctgctgctgagccagctgtgcttcctggcctctgtggccctgctgctgtggagcctgagcagcctgcgggagcagaaggagctggacctgatggacctggtgggggaggacaggaagtggatgatggccaggaagctgatgcaggtgaatgacaccctgaccagtgaagatgctggcctgaggaacagcaagaactgcacagagcccgccctgcacgagttccccaatgacatcttcaccaatgaagatcggcggcagggcgctgtggtgctgcacgtgctgtgtgccatctacatgttctacgccctggccatcgtgtgtgatgacttctttgtgcccagcctggagaagatctgtgagcggctgcacctgtctgaagatgtggccggggccaccttcatggctgctggcagcagcgcccctgagctgttcacctctgtgattggagtcttcatcaccaagggagatgtgggcgtgggcaccatcgtgggcagcgctgtgttcaacatcctgtgcatcattggagtgtgtggcctgtttgctggccaggtggtggccctgagctcctggtgcctgctgcgggacagcatctactacaccctgtctgtgattgccctgattgtgttcatctatgatgagaaggtgtcctggtgggagagcctggtgctggtgctgatgtacctgatctacatcgtcatcatgaagtacaatgcctgcatccaccagtgctttgaaagaaggaccaagggggccggcaacatggtgaatggcctggccaacaatgctgagattgatgacagcagcaactgtgatgccaccgtggtgctgctgaagaaggccaacttccacaggaaggccagcgtcatcatggtggatgagctgctgagcgcctacccccaccagctgtccttcagcgaggccggcctgcgcatcatgatcaccagccacttcccccccaagacccggctgtccatggccagcaggatgctgatcaatgaaaggcagaggctcatcaacagccgggcctacaccaacggggagagcgaggtggccatcaagatccccatcaagcacacagtggagaatggaacaggccccagcagcgccccagaccggggcgtgaatggcaccaggagagatgatgtggtggccgaggccggaaatgaaacagaaaatgaaaatgaagataatgaaaatgatgaggaggaggaggaggatgaagatgatgatgagggcccctacaccccatttgacacccccagcggcaagctggagaccgtgaagtgggccttcacctggcccctgagctttgtgctgtacttcaccgtgcccaactgcaacaagccccgctgggagaagtggttcatggtgacctttgccagcagcaccctgtggattgctgccttctcctacatgatggtgtggatggtgaccatcatcggctacaccctgggcatcccagatgtgatcatgggcatcaccttcctggccgccggcacctctgtgcctgactgcatggccagcctgattgtggcccggcagggcatgggagacatggctgtgagcaacagcatcggcagcaatgtgtttgacatcctgattggcctgggcctgccctgggccctgcagaccctggccgtggactatggcagctacatccggctgaacagccggggcctcatctacagcgtgggcctgctgctggcctctgtgtttgtgacagtgtttggagtgcacctgaacaagtggcagctggacaagaagctgggctgcggctgcctgctgctgtatggagtcttcctgtgcttcagcatcatgacagagttcaacgtgttcacctttgtgaacctgcccatgtgtggggaccactag

SEQ ID NO: 170418 - DNA, 1755 bp, Artificial Sequence
  Description of Artificial Sequence: Synthetic coding sequence
atggccggccggcggctgaacctgcgctgggccctgtctgtgctgtgtgtgctgctgatggccgagaccgtgtctggcacccggggcagcagcactggagcccacatcagcccccagtttcctgccagcggcgtgaaccagacccctgtggtggactgcaggaaggtgtgtggcctgaatgtgtctgacagatgtgacttcatccgcaccaacccagactgccacagtgatggcggctacctggactacctggagggcatcttctgccacttcccccccagcctgctgcccctggccgtgaccctgtatgtgtcctggctgctgtacctgttcctgatcctgggcgtgacagctgccaagttcttctgccccaacctgagcgccatcagcaccaccctgaagctgagccacaacgtggccggcgtgaccttcctggcctttggaaatggagccccagacatcttcagcgccctggtggccttcagtgacccccacacagctggcctggccctgggcgccctgtttggagctggggtgctggtgaccaccgtggtggccggcggcatcaccatcctgcaccccttcatggccgccagccggcccttcttccgggacatcgtgttctacatggtggccgtgttcctgaccttcctgatgctgttccggggccgggtgaccctggcctgggccctgggctacctgggcctgtatgtgttctacgtggtgaccgtcatcctgtgcacctggatctaccagaggcagaggcggggcagcctcttctgccccatgcctgtgaccccagagatcctgagtgacagtgaagaagatagagtgagcagcaacaccaacagctatgactatggagatgagtaccggcccctcttcttctaccaggagaccacagcccagatcctggtgcgggccctgaaccccctggactacatgaagtggaggaggaagagcgcctactggaaggccctgaaggtgttcaagctgcctgtggagttcctgctgctgctgactgtgcctgtggtggaccctgacaaggatgaccagaactggaagaggcccctgaactgcctgcacctggtgatcagccccctggtggtggtgctgaccctgcagagcggcacctatggagtgtatgagatcggcggcctggtgcctgtgtgggtggtggtggtgattgctggaacagccctggcctctgtgaccttctttgccaccagtgacagccagcccccccggctgcactggctgtttgccttcctgggcttcctgaccagcgccctgtggatcaatgctgctgccacagaggtggtgaacatcctgcggagcctgggcgtggtgttccggctgagcaacacagtgctgggcctgaccctgctggcctggggcaacagcattggagatgccttcagtgacttcaccctggcccggcagggctaccccaggatggccttcagcgcctgcttcggcggcatcatcttcaacatcctggtgggcgtgggcctgggctgcctgctgcagatcagccgcagccacacagaggtgaagctggagccagatggcctgctggtgtgggtgctggccggggccctgggcctgagcctggtgttcagcctggtgtctgtgcccctgcagtgcttccagctgagccgggtgtatggcttctgcctgctgctcttctacctgaacttcctggtggtggccctgctgacagaatttggagtcatccacctgaagtccatgtag

SEQ ID NO: 170419 - DNA, 1587 bp, Artificial Sequence
  Description of Artificial Sequence: Synthetic coding sequence
atggccggccggcggctgaacctgcgctgggccctgtctgtgctgtgtgtgctgctgatggccgagaccgtgtctggcacccggggcagcagcactggagcccacatcagcccccagtttcctgccagcggcgtgaaccagacccctgtggtggactgcaggaaggtgtgtggcctgaatgtgtctgacagatgtgacttcatccgcaccaacccagactgccacagtgatggcggctacctggactacctggagggcatcttctgccacttcccccccagcctgctgcccctggccgtgaccctgtatgtgtcctggctgctgtacctgttcctgatcctgggcgtgacagctgccaagttcttctgccccaacctgagcgccatcagcaccaccctgaagctgagccacaacgtggccggcgtgaccttcctggcctttggaaatggagccccagacatcttcagcgccctggtggccttcagtgacccccacacagctggcctggccctgggcgccctgtttggctacctgggcctgtatgtgttctacgtggtgaccgtcatcctgtgcacctggatctaccagaggcagaggcggggcagcctcttctgccccatgcctgtgaccccagagatcctgagtgacagtgaagaagatagagtgagcagcaacaccaacagctatgactatggagatgagtaccggcccctcttcttctaccaggagaccacagcccagatcctggtgcgggccctgaaccccctggactacatgaagtggaggaggaagagcgcctactggaaggccctgaaggtgttcaagctgcctgtggagttcctgctgctgctgactgtgcctgtggtggaccctgacaaggatgaccagaactggaagaggcccctgaactgcctgcacctggtgatcagccccctggtggtggtgctgaccctgcagagcggcacctatggagtgtatgagatcggcggcctggtgcctgtgtgggtggtggtggtgattgctggaacagccctggcctctgtgaccttctttgccaccagtgacagccagcccccccggctgcactggctgtttgccttcctgggcttcctgaccagcgccctgtggatcaatgctgctgccacagaggtggtgaacatcctgcggagcctgggcgtggtgttccggctgagcaacacagtgctgggcctgaccctgctggcctggggcaacagcattggagatgccttcagtgacttcaccctggcccggcagggctaccccaggatggccttcagcgcctgcttcggcggcatcatcttcaacatcctggtgggcgtgggcctgggctgcctgctgcagatcagccgcagccacacagaggtgaagctggagccagatggcctgctggtgtgggtgctggccggggccctgggcctgagcctggtgttcagcctggtgtctgtgcccctgcagtgcttccagctgagccgggtgtatggcttctgcctgctgctcttctacctgaacttcctggtggtggccctgctgacagaatttggagtcatccacctgaagtccatgtag

SEQ ID NO: 170420 - DNA, 1587 bp, Artificial Sequence; identical to SEQ ID NO: 170419
  Description of Artificial Sequence: Synthetic coding sequence

SEQ ID NO: 170421 - DNA, 396 bp, Artificial Sequence
  Description of Artificial Sequence: Synthetic coding sequence
atggccggccggcggctgaacctgcgctgggccctgtctgtgctgtgtgtgctgctgatggccgagaccgtgtctggcacccggggcagcagcactggagcccacatcagcccccagtttcctgccagcggcgtgaaccagacccctgtggtggactgcaggaaggtgtgtggcctgaatgtgtctgacagatgtgacttcatccgcaccaacccagactgccacagtgatggcggctacctggactacctggagggcatcttctgccacttcccccccagcctgctgcccctggccgtgaccctgtatgtgtcctggctgctgtacctgttcctgatcctgggcgtgacagctgccaagttcttctgccccaacctgagcgccatcagcacctag

SEQ ID NO: 170422 - DNA, 696 bp, Artificial Sequence
  Description of Artificial Sequence: Synthetic coding sequence
atggccggccggcggctgaacctgcgctgggccctgtctgtgctgtgtgtgctgctgatggccgagaccgtgtctggcacccggggcagcagcactggagcccacatcagcccccagtttcctgccagcggcgtgaaccagacccctgtggtggactgcaggaaggtgtgtggcctgaatgtgtctgacagatgtgacttcatccgcaccaacccagactgccacagtgatggcggctacctggactacctggagggcatcttctgccacttcccccccagcctgctgcccctggccgtgaccctgtatgtgtcctggctgctgtacctgttcctgatcctgggcgtgacagctgccaagttcttctgccccaacctgagcgccatcagcaccaccctgaagctgagccacaacgtggccggcgtgaccttcctggcctttggaaatggagccccagacatcttcagcgccctggtggccttcagtgacccccacacagctggcctggccctgggcgccctgtttggagctggggtgctggtgaccaccgtggtggccggcggcatcaccatcctgcaccccttcatggccgccagccggcccttcttccgggacatcgtgttctacatggtggccgtgttcctgaccttcctgatgctgttccggggccgggtgaccctggcctgggccctgtag

SEQ ID NO: 170423 - DNA, 312 bp, Artificial Sequence
  Description of Artificial Sequence: Synthetic coding sequence
atggccggccggcggctgaacctgcgctgggccctgtctgtgctgtgtgtgctgctgatggccgagaccgtgtctggcacccggggcagcagcactggagcccacatcagcccccagtttcctgccagcggcgtgaaccagacccctgtggtggactgcaggaaggtgtgtggcctgaatgtgtctgacagatgtgacttcatccgcaccaacccagactgccacagtgatggcggctacctggactacctggagggcatcttctgccacttcccccccagcctgctgcccctggccgtgaccctgtactag

SEQ ID NO: 170424 - DNA, 1755 bp, Artificial Sequence; identical to SEQ ID NO: 170418
  Description of Artificial Sequence: Synthetic coding sequence

SEQ ID NO: 170425 - DNA, 906 bp, Artificial Sequence
  Description of Artificial Sequence: Synthetic coding sequence
atggctgaccagcccaagcccatcagccccctgaagaacctgctggccggcggctttggaggagtgtgcctggtgtttgtgggccaccccctggacacagtgaaggtgcggctgcagacccagccccccagcctgcccggccagccccccatgtacagcggcacctttgactgcttcaggaagaccctcttccgggagggcatcaccggcctgtaccggggcatggccgcccccatcatcggcgtgacccccatgtttgctgtgtgcttctttggatttggcctgggcaagaagctgcagcagaagcacccagaagatgtgctgagctacccccagctgtttgctgctggcatgctgagcggggtcttcaccaccggcatcatgaccccaggagagcgcatcaagtgcctgctgcagatccaggccagcagcggggagagcaagtacacaggcaccctggactgtgccaagaagctgtaccaggagtttggcatccggggcatctacaagggcaccgtgctgaccctgatgagagatgtgcctgccagcggcatgtacttcatgacctatgagtggctgaagaacatcttcaccccagagggcaagagggtgtctgagctgagcgccccccgcatcctggtggccggcggcattgctggcatcttcaactgggccgtggccatccccccagatgtgctgaagagccgcttccagacagcccctcctgggaagtacccaaatggcttcagagatgtgctgcgggagctgatcagagatgaaggagtgaccagcctgtacaagggcttcaatgctgtgatgatccgggccttccctgccaatgctgcctgcttcctgggctttgaggtggccatgaagttcctgaactgggccacccccaacctgtag

SEQ ID NO: 170426 - DNA, 756 bp, Artificial Sequence
  Description of Artificial Sequence: Synthetic coding sequence
atgtacagcggcacctttgactgcttcaggaagaccctcttccgggagggcatcaccggcctgtaccggggcatggccgcccccatcatcggcgtgacccccatgtttgctgtgtgcttctttggatttggcctgggcaagaagctgcagcagaagcacccagaagatgtgctgagctacccccagctgtttgctgctggcatgctgagcggggtcttcaccaccggcatcatgaccccaggagagcgcatcaagtgcctgctgcagatccaggccagcagcggggagagcaagtacacaggcaccctggactgtgccaagaagctgtaccaggagtttggcatccggggcatctacaagggcaccgtgctgaccctgatgagagatgtgcctgccagcggcatgtacttcatgacctatgagtggctgaagaacatcttcaccccagagggcaagagggtgtctgagctgagcgccccccgcatcctggtggccggcggcattgctggcatcttcaactgggccgtggccatccccccagatgtgctgaagagccgcttccagacagcccctcctgggaagtacccaaatggcttcagagatgtgctgcgggagctgatcagagatgaaggagtgaccagcctgtacaagggcttcaatgctgtgatgatccgggccttccctgccaatgctgcctgcttcctgggctttgaggtggccatgaagttcctgaactgggccacccccaacctgtag

SEQ ID NO: 170427 - DNA, 948 bp, Artificial Sequence
  Description of Artificial Sequence: Synthetic coding sequence
atgacccaccaggacctgagcatcacagccaagctgatcaatggaggagtggccggcctggtgggcgtgacctgtgtgttccccatcgacctggccaagacccggctgcagaaccagcacggcaaggccatgtacaagggcatgattgactgcctgatgaagacagcccgggcagagggcttcttcggcatgtacagaggagctgctgtgaacctgaccctggtgaccccagagaaggccatcaagctggccgccaatgacttcttccggcggctgctgatggaggatggcatgcagaggaacctgaagatggagatgctggccggctgtggggccggcatgtgccaggtggtggtgacctgccccatggagatgctgaagatccagctgcaggatgctggccgcctggccgtgcaccaccagggcagcgccagcgcccccagcaccagccgcagctacaccactggaagtgccagcacccaccggcggcccagcgccaccctgattgcctgggagctgctgcggacccagggcctggccggcctgtaccggggcctgggcgccaccctgctgcgggacatccccttcagcatcatctacttccccctgtttgccaacctgaacaacctgggcttcaatgagctggccggcaaggccagctttgcccacagctttgtgtctggctgtgtggccggcagcattgctgctgtggccgtgacccccctggatgtgctgaagacccgcatccagaccctgaagaagggcctgggggaggacatgtacagcggcatcacagactgtgccaggaagctgtggatccaggagggccccagcgccttcatgaagggggccggctgccgggccctggtgattgcccccctgtttggaattgcccagggcgtgtacttcatcggcatcggggagcgcatcctgaagtgctttgattag

SEQ ID NO: 170428 - DNA, 948 bp, Artificial Sequence; identical to SEQ ID NO: 170427
  Description of Artificial Sequence: Synthetic coding sequence

SEQ ID NO: 170429 - DNA, 1716 bp, Artificial Sequence
  Description of Artificial Sequence: Synthetic coding sequence
atggagaatgtgaaggagatcttcggccagaccatcatccaccaccacatccccttcaactgggactgtgagttcatccggctgcacttcggccacaacaggaagaagcacctgaactacacagagttcacccagttcctgcaggagctgcagctggagcacgcccggcaggcctttgccctgaaggacaagagcaagagcggcatgatcagcggcctggacttcagtgacatcatggtgaccatccgcagccacatgctgaccccatttgtggaggagaacctggtgtctgctgctgggggcagcatcagccaccaggtgtccttctcctacttcaatgccttcaacagcctgctgaacaacatggagctggtgaggaagatctacagcaccctggccggcaccaggaaggatgtggaggtgaccaaggaggagtttgcccagagcgccatccgctatggccaggtgacccccctggagattgacatcctgtaccagctggccgacctgtacaatgccagcggccgcctgaccctggccgacatcgagagaattgcccccctggccgagggcgccctgccctacaacctggccgagctgcagaggcagcagagccctggcctgggccggcccatctggctgcagattgctgagagcgcctaccgcttcaccctgggctctgtggccggggctgtgggcgccacagctgtgtaccccatcgacctggtgaagaccaggatgcagaaccagaggggcagcggctctgtggtgggggagctgatgtacaagaacagctttgactgcttcaagaaggtgctgcgctatgagggcttcttcggcctgtaccggggcctcatcccccagctgattggagtggcccctgagaaggccatcaagctgactgtgaatgactttgtgcgggacaagttcaccaggagagatggctctgtgcccctgcctgctgaggtgctggccggcggctgtgccggcggcagccaggtgatcttcaccaaccccctggagatcgtgaagatccggctgcaggtggccggggagatcaccaccggcccccgggtgtctgccctgaatgtgctgcgggacctgggcatcttcggcctgtacaagggggccaaggcctgcttcctgcgggacatccccttcagcgccatctacttccctgtgtatgcccactgcaagctgctgctggctgatgaaaatggccacgtgggcggcctgaacctgctggccgccggggccatggccggcgtgcctgctgccagcctggtgaccccagcagatgtgatcaagacccggctgcaggtggccgcccgggccggccagaccacctacagcggggtcatcgactgcttcaggaagatcctgcgggaggagggccccagcgccttctggaagggcacagctgcccgggtcttccgcagcagcccccagtttggagtgaccctggtgacctatgagctgctgcagcgctggttctacatcgactttggaggcctgaagccagctggcagcgagcccacccccaagagcagaattgctgacctgcccccagccaacccagaccacatcggcggctaccgcctggccacagccacctttgctggcatcgagaacaagtttggcctgtacctgcccaagttcaagagccccagcgtggccgtggtgcagcccaaggctgctgtggccgccacccagtag

SEQ ID NO: 170430 - DNA, 2037 bp, Artificial Sequence
  Description of Artificial Sequence: Synthetic coding sequence
atggctgtgaaggtgcagaccaccaagagaggagacccccatgagctgaggaacatcttcctgcagtatgccagcacagaggtggatggagagcgctacatgaccccagaagattttgtgcagcgctacctgggcctgtacaatgaccccaacagcaaccccaagatcgtgcagctgctggccggcgtggccgaccagaccaaggatggcctcatctcctaccaggagttcctggcctttgagagcgtgctgtgtgccccagacagcatgttcatcgtggccttccagctgtttgacaagtctggaaatggagaggtgacctttgaaaatgtgaaggagatcttcggccagaccatcatccaccaccacatccccttcaactgggactgtgagttcatccggctgcacttcggccacaacaggaagaagcacctgaactacacagagttcacccagttcctgcaggagctgcagctggagcacgcccggcaggcctttgccctgaaggacaagagcaagagcggcatgatcagcggcctggacttcagtgacatcatggtgaccatccgcagccacatgctgaccccatttgtggaggagaacctggtgtctgctgctgggggcagcatcagccaccaggtgtccttctcctacttcaatgccttcaacagcctgctgaacaacatggagctggtgaggaagatctacagcaccctggccggcaccaggaaggatgtggaggtgaccaaggaggagtttgcccagagcgccatccgctatggccaggtgacccccctggagattgacatcctgtaccagctggccgacctgtacaatgccagcggccgcctgaccctggccgacatcgagcgcatcgcccccctggccgagggcgccctgccctacaacctggccgagctgcagaggcagcagagccctggcctgggccggcccatctggctgcagattgctgagagcgcctaccgcttcaccctgggctctgtggccggggctgtgggcgccacagctgtgtaccccatcgacctggtgaagaccaggatgcagaaccagaggggcagcggctctgtggtgggggagctgatgtacaagaacagctttgactgcttcaagaaggtgctgcgctatgagggcttcttcggcctgtaccggggcctcatcccccagctgattggagtggcccctgagaaggccatcaagctgactgtgaatgactttgtgcgggacaagttcaccaggagagatggctctgtgcccctgcctgctgaggtgctggccggcggctgtgccggcggcagccaggtgatcttcaccaaccccctggagatcgtgaagatccggctgcaggtggccggggagatcaccaccggcccccgggtgtctgccctgaatgtgctgcgggacctgggcatcttcggcctgtacaagggggccaaggcctgcttcctgcgggacatccccttcagcgccatctacttccctgtgtatgcccactgcaagctgctgctggctgatgaaaatggacatgtgggcggcctgaacctgctggccgccggggccatggccggcgtgcctgctgccagcctggtgaccccagcagatgtgatcaagacccggctgcaggtggccgcccgggccggccagaccacctacagcggcgtgattgactgcttcaggaagatcctgcgggaggagggccccagcgccttctggaagggcacagctgcccgggtcttccgcagcagcccccagtttggagtgaccctggtgacctatgagctgctgcagcgctggttctacatcgactttggaggcctgaagccagctggcagcgagcccacccccaagagcagaattgctgacctgcccccagccaacccagaccacatcggcggctaccgcctggccacagccacctttgctggcatcgagaacaagtttggcctgtacctgcccaagttcaagagccccagcgtggccgtggtgcagcccaaggctgctgtggccgccacccagtag

SEQ ID NO: 170431 - DNA, 1944 bp, Artificial Sequence
  Description of Artificial Sequence: Synthetic coding sequence
atggctgctggcctggccacctggctgccctttgcccgggctgctgctgtgggctggctgcccctggcccagcagcccctgcccccagcccctggggtgaaggccagcagaggagatgaggtgctggtggtgaatgtgtctggaagaagatttgagacctggaagaacaccctggaccgctacccagacaccctgctgggcagcagcgagaaggagttcttctatgatgctgacagcggggagtacttctttgaccgggaccctgacatgttcagacatgtgctgaacttctacagaacaggccgcctgcactgcccccggcaggagtgcatccaggcctttgatgaggagctggccttctacggcctggtgcctgagctggtgggggactgctgcctggaggagtacagagacaggaagaaggaaaatgctgagcggctggctgaagatgaggaggccgagcaggccggagatggccctgccctgcctgctggcagcagcctgcggcagaggctgtggagggcctttgagaacccccacaccagcacagctgccctggtgttctactacgtgacaggcttcttcatcgctgtgtctgtgattgccaacgtggtggagaccatcccctgccggggcagcgcccggcgcagcagccgggagcagccctgtggggagcgcttcccccaggccttcttctgcatggacacagcctgtgtgctgatcttcaccggggagtacctgctgcggctgtttgctgcccccagccgctgccgcttcctgcggtctgtgatgagcctgattgatgtggtggccatcctgccctactacatcggcctgctggtgcccaagaatgatgatgtgtctggggcctttgtgaccctgcgggtcttccgggtcttccgcatcttcaagttcagccgccacagccagggcctgcgcatcctgggctacaccctgaagagctgtgccagcgagctgggcttcctgctcttcagcctgaccatggccatcatcatctttgccaccgtgatgttttatgcagagaagggcaccaacaagaccaacttcaccagcatcccagctgccttctggtacaccatcgtgaccatgaccaccctgggctatggagacatggtgcccagcaccatcgccggcaagatcttcggcagcatctgcagcctgtctggagtgctggtgattgccctgcctgtgcctgtgattgtgagcaacttcagccgcatctaccaccagaaccagagagctgacaagaggcgggcccagcagaaggtgcggctggcccgcatccggctggccaagagcggcaccaccaatgccttcctgcagtacaagcagaatggaggcctggaggacagcggcagcggggaggagcaggccctgtgtgtgaggaacagaagtgcctttgagcagcagcaccaccacctgctgcactgcctggagaagaccacctgccacgagttcacagatgagctgaccttcagcgaggccctgggcgctgtgtcccctgggggccgcaccagccgcagcacctctgtgagcagccagcctgtgggccctggcagcctgctgagcagctgctgcccccggcgggccaagagaagagccatccggctggccaacagcacagcctctgtgtcccggggctccatgcaggagctggacatgctggccggcctgcggcgcagccacgccccccagagccgcagcagcctgaatgccaagccccatgacagcctggacctgaactgtgacagccgggactttgtggccgccatcatcagcatccccaccccaccagccaacaccccagatgagagccagcccagcagccctgggggcggcggccgggccggcagcaccctgaggaacagcagcctgggcaccccctgcctcttccctgagaccgtgaagatcagcagcctgtag

SEQ ID NO: 170432 - DNA, 1062 bp, Artificial Sequence
  Description of Artificial Sequence: Synthetic coding sequence
atgggcatcttccctggcatcatcctgatcttcctgcgggtgaagtttgccacagctgctgtgatccaccagaagagcaccaccgtgtcccatgagatgagcggcctgaactggaagccctttgtgtatggaggcctggccagcatcgtggccgagtttggcaccttccctgtggacctgaccaagacccggctgcaggtgcagggccagagcattgatgcccgcttcaaggagatcaagtaccggggcatgttccacgccctcttccgcatctgcaaggaggagggcgtgctggccctgtacagcggcatcgccccagccctgctgcggcaggccagctatggcaccatcaagattggcatctaccagagcctgaagaggctgtttgtggagcggctggaggatgagaccctgctgatcaacatgatctgtggggtggtgtctggagtcatcagcagcaccatcgccaaccccacagatgtgctgaagatccgcatgcaggcccagggcagcctcttccagggctccatgattggcagcttcatcgacatctaccagcaggagggcacccggggcctgtggcgctgcctgtgcagcaaggctgtgacaggctgtgtgctgtggctgatgcctgtgatcccagccctgtgggaggccaatgccggcggcagcctggagggcgtggtgcccacagcccagagagctgccatcgtggtgggcgtggagctgcctgtgtatgacatcaccaagaagcacctgatcctgagcggcatgatgggagacaccatcctgacccactttgtgagcagcttcacctgtggcctggccggggccctggccagcaaccctgtggatgtggtgaggaccaggatgatgaaccagagggccatcgtgggccacgtggacctgtacaagggcaccgtggatggcatcctgaagatgtggaagcatgagggcttctttgccctgtacaagggcttctggcccaactggctgcggctgggcccctggaacatcatcttcttcatcacctatgagcagctgaagaggctgcagatctag

SEQ ID NO: 170433 - DNA, 969 bp, Artificial Sequence
  Description of Artificial Sequence: Synthetic coding sequence
atgggcatcttccctggcatcatcctgatcttcctgcgggtgaagtttgccacagctgctgtgatccaccagaagagcaccaccgtgtcccatgagatgagcggcctgaactggaagccctttgtgtatggaggcctggccagcatcgtggccgagtttggcaccttccctgtggacctgaccaagacccggctgcaggtgcagggccagagcattgatgcccgcttcaaggagatcaagtaccggggcatgttccacgccctcttccgcatctgcaaggaggagggcgtgctggccctgtacagcggcatcgccccagccctgctgcggcaggccagctatggcaccatcaagattggcatctaccagagcctgaagaggctgtttgtggagcggctggaggatgagaccctgctgatcaacatgatctgtggggtggtgtctggagtcatcagcagcaccatcgccaaccccacagatgtgctgaagatccgcatgcaggcccagggcagcctcttccagggctccatgattggcagcttcatcgacatctaccagcaggagggcacccggggcctgtggaggggcgtggtgcccacagcccagagagctgccatcgtggtgggcgtggagctgcctgtgtatgacatcaccaagaagcacctgatcctgagcggcatgatgggagacaccatcctgacccactttgtgtcctccttcacctgtggcctggccggggccctggccagcaaccctgtggatgtggtgaggaccaggatgatgaaccagagggccatcgtgggccacgtggacctgtacaagggcaccgtggatggcatcctgaagatgtggaagcatgagggcttctttgccctgtacaagggcttctggcccaactggctgcggctgggcccctggaacatcatcttcttcatcacctatgagcagctgaagaggctgcagatctag

SEQ ID NO: 170434 - DNA, 597 bp, Artificial Sequence
  Description of Artificial Sequence: Synthetic coding sequence
atgggcatcttccctggcatcatcctgatcttcctgcgggtgaagtttgccacagctgctgtgattgtgtctggccaccagaagagcaccaccgtgtcccatgagatgagcggcctgaactggaagccctttgtgtatggaggcctggccagcatcgtggccgagtttggcaccttccctgtggacctgaccaagacccggctgcaggtgcagggccagagcattgatgcccgcttcaaggagatcaagtaccggggcatgtttcatgccctcttccgcatctgcaaggaggagggcgtgctggccctgtacagcggcatcgccccagccctgctgcggcaggccagctatggcaccatcaagattggcatctaccagagcctgaagaggctgtttgtggagcggctggaggatgagaccctgctgatcaacatgatctgtggggtggtgtctggagtcatcagcagcaccatcgccaaccccacagatgtgctgaagatccgcatgcaggcccagggcagcctcttccagggctccatgattggcagcttcatcgacatctaccagcaggagggcacccggggcctgtggaggtag

SEQ ID NO: 170435 - DNA, 618 bp, Artificial Sequence
  Description of Artificial Sequence: Synthetic coding sequence
atgagcggcctgaactggaagccctttgtgtatggaggcctggccagcatcgtggccgagtttggcaccttccctgtggacctgaccaagacccggctgcaggtgcagggccagagcattgatgcccgcttcaaggagatcaagtaccggggcatgttccacgccctcttccgcatctgcaaggaggagggcgtgctggccctgtacagcggcatcgccccagccctgctgcggcaggccagctatggcaccatcaagattggcatctaccagagcctgaagaggctgtttgtggagcggctggaggatgagaccctgctgatcaacatgatctgtggggtggtgtctggagtcatcagcagcaccatcgccaaccccacagatgtgctgaagatccgcatgcaggcccagggcagcctcttccagggctccatgattggcagcttcatcgacatctaccagcaggagggcacccggggcctgtggaggggcgtggtgcccacagcccagagagctgccatcgtggtgggcgtggagctgcctgtgtatgacatcaccaagaagcacctgatcctgagcggcatgatgggagacaccatcctgacccactttgtgtag

SEQ ID NO: 170436 - DNA, 723 bp, Artificial Sequence
  Description of Artificial Sequence: Synthetic coding sequence
atgggcatcttccctggcatcatcctgatcttcctgcgggtgaagtttgccacagctgctgtgattgtgtctggccaccagaagagcaccaccgtgtcccatgagatgagcggcctgaactggaagccctttgtgtatggaggcctggccagcatcgtggccgagtttggcaccttccctgtggacctgaccaagacccggctgcaggtgcagggccagagcattgatgcccgcttcaaggagatcaagtaccggggcatgtttcatgccctcttccgcatctgcaaggaggagggcgtgctggccctgtacagcggcatcgccccagccctgctgcggcaggccagctatggcaccatcaagattggcatctaccagagcctgaagaggctgtttgtggagcggctggaggatgagaccctgctgatcaacatgatctgtggggtggtgtctggagtcatcagcagcaccatcgccaaccccacagatgtgctgaagatccgcatgcaggcccagggcagcctcttccagggctccatgattggcagcttcatcgacatctaccagcaggagggcacccggggcctgtggaggggcgtggtgcccacagcccagagagctgccatcgtggtgggcgtggagctgcctgtgtatgacatcaccaagaagcacctgatcctgagcggcatgatgggagacaccatcctgacccactttgtgtag

SEQ ID NO: 170437 - DNA, 972 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggccggcacctgccaggtgattgtgaccacccccatggagatgctgaagatccagctgcaggatgctggaagaattgctgcccagaggaagatcctggccgcccagggccagctgagcgcccagggcggggcccagcccagcgtggaggccccagctgccccccggcccacagccacccagctgacccgggacctgctgcggagccggggcattgctggcctgtacaagggcctgggcgccaccctgctgagagatgtgcccttctctgtggtgtacttccccctgtttgccaacctgaaccagctgggccgcccagccagcgaggagaagagccccttctacgtgtccttcctggccggctgtgtggccggcagcgctgctgctgtggccgtgaacccctgtgatgtggtgaagacccggctgcagagcctgcagaggggcgtgaatgaagacacctacagcggcatcctggactgtgccaggaagatcctgcggcatgagggccccagcgccttcctgaagggggcctactgccgggccctggtgattgcccccctgtttggaattgcccaggtggtgtacttcctgggcattgctgagagcctgctgggcctgctgcaggacccccaggcctag

SEQ ID NO: 170438 - DNA, 333 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctag

SEQ ID NO: 170439 - DNA, 384 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggccggcacctgccaggtgattgtgaccacccccatggagatgctgtag

SEQ ID NO: 170440 - DNA, 360 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggccggcacctgccaggtgatctag

SEQ ID NO: 170441 - DNA, 372 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggccggcacctgccaggtgattgtgaccaccccctag

SEQ ID NO: 170442 - DNA, 342 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggcctag

SEQ ID NO: 170443 - DNA, 237 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccctag

SEQ ID NO: 170444 - DNA, 180 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctcctag

SEQ ID NO: 170445 - DNA, 972 bp, Artificial Sequence; identical to SEQ ID NO: 170437
  Description of Artificial Sequence: Synthetic coding sequence

SEQ ID NO: 170446 - DNA, 345 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggccggctag

SEQ ID NO: 170447 - DNA, 237 bp, Artificial Sequence; identical to SEQ ID NO: 170443
  Description of Artificial Sequence: Synthetic coding sequence

SEQ ID NO: 170448 - DNA, 321 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagtag

SEQ ID NO: 170449 - DNA, 408 bp, Artificial Sequence
  Description of Artificial Sequence: Synthetic coding sequence
atggctgacaagcagatcagcctgcctgccaagctgatcaatggaggcattgctggcctgattggagtgacctgtgtgttccccatcgacctggccaagacccggctgcagaaccagcagaatggccagagggtgtacacctccatgtctgactgcctgatcaagacagtgcgctctgagggctacttcggcatgtacagaggagctgctgtgaacctgaccctggtgaccccagagaaggccatcaagctggccgccaatgacttcttccgccaccagctgagcaaggatggccagaagctgaccctgctgaaggagatgctggccggctgtggggccggcacctgccaggtgattgtgaccacccccatggagatgctgaagatccagctgcaggatgctggatag

SEQ ID NO: 170450 - DNA, 948 bp, Artificial Sequence
  Description of Artificial Sequence: Synthetic coding sequence
atgcaccgggagcccgccaagaagaaggccgagaagaggctgtttgatgccagcagctttgggaaggacctgctggccggcggcgtggccgctgctgtgtccaagacagctgtggcccccatcgagcgggtgaagctgctgctgcaggtgcaggccagcagcaagcagatcagccctgaggcccgctacaagggcatggtggactgcctggtgcgcatcccccgggagcagggcttcttctccttctggaggggcaacctggccaacgtcatccgctacttccccacccaggccctgaactttgccttcaaggacaagtacaagcagctgttcatgtctggagtgaacaaggagaagcagttctggcgctggttcctggccaacctggccagcggcggcgctgctggggccaccagcctgtgtgtggtgtaccccctggactttgcccggacccggctgggcgtggacattggaaaaggacctgaggagcggcagttcaagggcctgggggactgcatcatgaagatcgccaagagtgatggcattgctggcctgtaccagggctttggagtgtctgtgcagggcatcatcgtgtaccgggccagctactttggagcctatgacacagtgaagggcctgctgcccaagcccaagaagacccccttcctggtgtccttcttcatcgcccaggtggtgaccacctgcagcggcatcctgagctacccctttgacacagtgagaagaaggatgatgatgcagagcggggaggccaagaggcagtacaagggcaccctggactgctttgtgaagatctaccagcacgagggcatcagcagcttcttccggggggccttcagcaatgtgctgcggggcaccggcggggccctggtgctggtgctgtatgacaagatcaaggagttcttccacatcgacatcggcggccgctag

SEQ ID NO: 170451 - DNA, 897 bp, Artificial Sequence
  Description of Artificial Sequence: Synthetic coding sequence
atgggagaccacgcctggagcttcctgaaggacttcctggccggcggcgtggccgctgctgtgtccaagacagctgtggcccccatcgagcgggtgaagctgctgctgcaggtgcagcacgccagcaagcagatctctgctgagaagcagtacaagggcatcatcgactgtgtggtgcgcatccccaaggagcagggcttcctgtccttctggaggggcaacctggccaacgtcatccgctacttccccacccaggccctgaactttgccttcaaggacaagtacaagcagctgttcctgggcggcgtggacagacacaagcagttctggagatactttgctggcaacctggccagcggcggcgctgctggggccaccagcctgtgctttgtgtaccccctggactttgcccggacccggctggccgcagatgtgggcaaaggagctgcccagcgggagttccacggcctgggggactgcatcatcaagatcttcaagagtgatggcctgcggggcctgtaccagggcttcaacgtgtctgtgcagggcatcatcatctacagagctgcctactttggagtgtatgacacagccaagggcatgctgcctgaccccaagaatgtgcacatctttgtgtcctggatgattgcccagagcgtgacagctgtggccggcctggtgtcctacccctttgacacagtgagaagaaggatgatgatgcagagcggcaggaaaggagctgacatcatgtacacaggcaccgtggactgctggaggaagatcgccaaggatgagggcgccaaggccttcttcaagggggcctggagcaatgtgctgcggggcatgggcggggcctttgtgctggtgctgtatgatgagatcaagaagtatgtgtag

SEQ ID NO: 170452 - DNA, 897 bp, Artificial Sequence
  Description of Artificial Sequence: Synthetic coding sequence
atgacagatgctgctgtgtcctttgccaaggacttcctggccggcggcgtggccgccgccatcagcaagacagctgtggcccccatcgagcgggtgaagctgctgctgcaggtgcagcacgccagcaagcagatcacagctgacaagcagtacaagggcatcatcgactgtgtggtgcgcatccccaaggagcagggcgtgctgtccttctggaggggcaacctggccaacgtcatccgctacttccccacccaggccctgaactttgccttcaaggacaagtacaagcagatcttcctgggcggcgtggacaagaggacccagttctggctgtactttgctggcaacctggccagcggcggcgctgctggggccaccagcctgtgctttgtgtaccccctggactttgcccggacccggctggccgcagatgtgggcaaggccggggctgagcgggagttccggggcctgggggactgcctggtgaagatctacaagagtgatggcatcaagggcctgtaccagggcttcaacgtgtctgtgcagggcatcatcatctacagagctgcctacttcggcatctatgacacagccaagggcatgctgcctgaccccaagaacacccacatcgtcatctcctggatgattgcccagacagtgacagctgtggccggcctgaccagctacccctttgacacagtgagaagaaggatgatgatgcagagcggcaggaaaggaacagacatcatgtacacaggcaccctggactgctggaggaagatcgccagagatgagggcggcaaggccttcttcaagggggcctggagcaatgtgctgcggggcatgggcggggcctttgtgctggtgctgtatgatgagatcaagaagtacacctag

SEQ ID NO: 170453 - DNA, 897 bp, Artificial Sequence
  Description of Artificial Sequence: Synthetic coding sequence
atgacagagcaggccatcagctttgccaaggacttcctggccggcggcattgctgctgccatcagcaagacagctgtggcccccatcgagcgggtgaagctgctgctgcaggtgcagcacgccagcaagcagattgctgctgacaagcagtacaagggcatcgtggactgcatcgtgcgcatccccaaggagcagggcgtgctgtccttctggaggggcaacctggccaacgtcatccgctacttccccacccaggccctgaactttgccttcaaggacaagtacaagcagatcttcctgggcggcgtggacaagcacacccagttctggagatactttgctggcaacctggccagcggcggcgctgctggggccaccagcctgtgctttgtgtaccccctggactttgcccggacccggctggccgcagatgtgggcaagagcggcacagagcgggagttccggggcctgggggactgcctggtgaagatcaccaagagtgatggcatccggggcctgtaccagggcttctctgtgtctgtgcagggcatcatcatctacagagctgcctactttggagtgtatgacacagccaagggcatgctgcctgaccccaagaacacccacatcgtggtgtcctggatgattgcccagacagtgacagctgtggccggcgtggtgtcctacccctttgacacagtgagaagaaggatgatgatgcagagcggcaggaaaggagctgacatcatgtacacaggcaccgtggactgctggaggaagatcttcagagatgagggcggcaaggccttcttcaagggggcctggagcaatgtgctgcggggcatgggcggggcctttgtgctggtgctgtatgatgagctgaagaaggtgatctag

SEQ ID NO: 170454 - DNA, 477 bp, Artificial Sequence
  Description of Artificial Sequence: Synthetic coding sequence
atgacagagcaggccatcagctttgccaaggacttcctggccggcggcattgctgctgccatcagcaagacagctgtggcccccatcgagcgggtgaagctgctgctgcaggtgcagcacgccagcaagcagattgctgctgacaagcagtacaagggcatcgtggactgcatcgtgcgcatccccaaggagcagggcgtgctgtccttctggaggggcaacctggccaacgtcatccgctacttccccacccaggccctgaactttgccttcaaggacaagtacaagcagatcttcctgggcggcgtggacaagcacacccagttctggagatactttgctggcaacctggccagcggcggcgctgctggggccaccagcctgtgctttgtgtaccccctggactttgcccggacccggctggccgcagatgtgggcaagagcggcacagagcgggagttccggggcctgggctag

SEQ ID NO: 170455 - DNA, 2913 bp, Artificial Sequence
  Description of Artificial Sequence: Synthetic coding sequence
atgctgtgcttcctggatgatggagctggcatggaccccagtgatgctgccagcgtcatccagtttgggaagagcgccaagaggaccccagagagcacccagatcggccagtatggaaatggcctgaagagcggctccatgagaattggcaaggacttcatcctcttcaccaagaaggaggacaccatgacctgcctcttcctgagcaggaccttccacgaggaggagggcattgatgaagtcatcgtgcccctgcccacctggaatgcccggacccgggagcctgtgacagacaacgtggagaagtttgccattgaaacagagctgatctacaagtacagccccttcagaacagaggaggaggtgatgacccagttcatgaagatccctggggacagcggcaccctggtgatcatcttcaacctgaagctgatggacaatggagagcctgagctggacatcatcagcaacccccgggacatccagatggccgagaccagccctgagggcaccaagccagagaggaggagcttccgggcctatgctgctgtgctgtacatcgaccccaggatgaggatcttcatccacggccacaaggtgcagaccaagaggctgagctgctgcctgtacaagcccaggatgtacaagtacaccagcagccgcttcaagaccagggctgagcaggaggtgaagaaggccgagcacgtggccagaattgctgaggagaaggcccgggaggccgagagcaaggcccggaccctggaggtgcggctgggcggggacctgacccgggacagccgggtgatgctgcggcaggtgcagaacagagccatcaccctgcggcgggaggctgatgtgaagaagaggatcaaggaggccaagcagagggccctgaaggagcccaaggagctgaactttgtgtttggagtgaacatcgagcaccgggacctggatggcatgttcatctacaactgcagccgcctcatcaagatgtatgagaaggtgggcccccagctggagggcggcatggcctgtggcggcgtggtgggcgtggtggatgtgccctacctggtgctggagcccacccacaacaagcaggactttgctgatgccaaggagtaccgccacctgctgcgggccatgggagagcacctggcccagtactggaaggacatcgccatcgcccagaggggcatcatcaagttctgggatgaatttggctacctgagcgccaactggaaccagccccccagcagcgagctgcgctacaagagaagaagagccatggagatccccaccaccatccagtgtgacctgtgcctgaagtggaggaccctgcccttccagctgagctctgtggagaaggactacccagacacctgggtgtgcagcatgaacccagaccctgagcaggacagatgtgaggccagcgagcagaagcagaaggtgcccctgggcaccttcaggaaggacatgaagacccaggaggagaagcagaagcagctgacagagaagatccggcagcagcaggagaagctggaggccctgcagaagaccacccccatccgcagccaggccgacctgaagaagctgcccctggaggtgaccacccggcccagcacagaggagcctgtgcggcggccccagaggcccaggagcccccccctgcctgctgtgatcagaaatgcccccagcaggcctcccagcctgcccacccccaggcctgccagccagcccaggaaggcccctgtgatcagcagcacccccaagctgcctgccctggccgcccgggaggaggccagcaccagccggctgctgcagcccccagaggcccccaggaagccagccaacaccctggtgaagacagccagcaggcctgcccccctggtgcagcagctgagccccagcctgctgcccaacagcaagagcccccgggaggtgcccagccccaaggtgatcaagacccctgtggtgaagaagacagagagccccatcaagctgagccctgccacccccagcaggaagaggtctgtggccgtgtctgatgaggaggaggtggaggaggaggccgagaggaggaaggagcgctgcaagaggggccgctttgtggtgaaggaggagaagaaggacagcaatgagctgagtgacagcgctggggaggaggacagcgctgacctgaagagggcccagaaggacaagggcctgcacgtggaggtgcgggtgaaccgggagtggtacacaggccgggtgacagctgtggaggtgggcaagcacgtggtgcgctggaaggtgaagtttgattatgtgcccacagacaccaccccccgggaccgctgggtggagaagggctctgaagatgtgcggctgatgaagccacccagccctgagcaccagagcctggacacccagcaggagggcggggaggaggaggtgggccctgtggcccagcaggccatcgctgtggccgagcccagcaccagcgagtgcctgcgcatcgagccagacaccacagccctgagcaccaaccacgagaccatcgacctgctggtgcagatcctgaggaactgcctgcgctacttcctgccccccagcttccccatcagcaagaagcagctgagcgccatgaacagtgatgagctgatctccttccccctgaaggagtacttcaagcagtatgaggtgggcctgcagaacctgtgcaacagctaccagagcagagctgacagccgggccaaggccagcgaggagagcctgcggaccagcgagaggaagctgcgggagacagaggagaagctgcagaagctgcggaccaacatcgtggccctgctgcagaaggtgcaggaggacatcgacatcaacacagatgatgagctggatgcctacattgaagatctcatcaccaagggggactag

SEQ ID NO: 170456 - DNA, 627 bp, Artificial Sequence
  Description of Artificial Sequence: Synthetic coding sequence
atgtttgagttcctgagcaaccacatgagagatgcccagggccgcctggacagcacccggggcctgctgtgtggcctgggcgctggggtggccgaggccgtggtggtggtgtgccccatggagaccatcaaggtgaagttcatccatgaccagaccagccccaaccccaagtaccggggcttcttccatggagtgcgggagatcgtgcgggagcagggcctgaagggcacctaccagggcctgacagccaccgtgctgaagcagggcagcaaccaggccatccgcttctttgtgatgaccagcctgaggaactggtacagaggagacaaccccaacaagcccatgaaccccctcatcaccggggtgtttggagccatcgccggggccgcctctgtgtttggaaacacccccctggatgtgatcaagaccaggatgcagggcctggaggcccacaagtacagaaacacctgggactgtggcctgcagatcctgaagaaggagggcctgaaggccttctacaagggcaccgtgccccggctgggccgggtgtgcctggatgtggccatcgtgtttgtgatctatgatgaggtggtgaagctgctgaacaaggtgtggaagacagactag

SEQ ID NO: 170457 - DNA, 999 bp, Artificial Sequence
  Description of Artificial Sequence: Synthetic coding sequence
atggctgctgccacagctgctgctgccctggccgctgctgaccccccaccagccatgccccaggccgccggggccggcggccccaccacccggcgggacttctactggctgcgctccttcctggccggcggcattgctggctgctgtgccaagaccaccgtggcccccctggacagagtgaaggtgctgctgcaggcccacaaccaccactacaagcacctgggcgtcttcagcgccctgcgggctgtgccccagaaggagggcttcctgggcctgtacaagggaaatggagccatgatgatccgcatcttcccctacggggccatccagttcatggcctttgagcactacaagaccctcatcaccaccaagctgggcatcagcggccacgtgcaccggctgatggccggctccatggccggcatgacagctgtgatctgcacctaccccctggacatggtgcgggtgcggctggccttccaggtgaagggggagcacagctacacaggcatcatccacgccttcaagaccatctatgccaaggagggcggcttcttcggcttctaccggggcctgatgcccaccatcctgggcatggccccctatgccggcgtgtccttcttcaccttcggcaccctgaagtctgtgggcctgagccacgcccccaccctgctgggccggcccagcagtgacaaccccaacgtgctggtgctgaagacccacgtgaacctgctgtgtggcggcgtggccggggccatcgcccagaccatctcctacccctttgatgtgaccaggaggaggatgcagctgggcaccgtgctgcctgagtttgagaagtgcctgaccatgagggacaccatgaagtatgtgtatggccaccacggcatcaggaagggcctgtaccggggcctgagcctgaactacatccgctgcatccccagccaggccgtggccttcaccacctatgagctgatgaagcagttcttccacctgaactag

SEQ ID NO: 170458 - DNA, 705 bp, Artificial Sequence
  Description of Artificial Sequence: Synthetic coding sequence
atgatgatccgcatcttcccctacggggccatccagttcatggcctttgagcactacaagaccctcatcaccaccaagctgggcatcagcggccacgtgcaccggctgatggccggctccatggccggcatgacagctgtgatctgcacctaccccctggacatggtgcgggtgcggctggccttccaggtgaagggggagcacagctacacaggcatcatccacgccttcaagaccatctatgccaaggagggcggcttcttcggcttctaccggggcctgatgcccaccatcctgggcatggccccctatgccggcgtgtccttcttcaccttcggcaccctgaagtctgtgggcctgagccacgcccccaccctgctgggccggcccagcagtgacaaccccaacgtgctggtgctgaagacccacgtgaacctgctgtgtggcggcgtggccggggccatcgcccagaccatctcctacccctttgatgtgaccaggaggaggatgcagctgggcaccgtgctgcctgagtttgagaagtgcctgaccatgagggacaccatgaagtatgtgtatggccaccacggcatcaggaagggcctgtaccggggcctgagcctgaactacatccgctgcatccccagccaggccgtggccttcaccacctatgagctgatgaagcagttcttccacctgaactag

SEQ ID NO: 170459 - DNA, 906 bp, Artificial Sequence
  Description of Artificial Sequence: Synthetic coding sequence
atgaagagcaacccagccatccaggccgccatcgacctgacagctggagctgctgggggcacagcctgtgtgctgaccggccagccctttgacaccatgaaggtgaagatgcagaccttcccagacctgtaccggggcctgacagactgctgcctgaagacctacagccaggtgggcttccggggcttctacaagggcaccagccctgccctgattgccaacattgctgaaaattctgtgctcttcatgtgctacggcttctgccagcaggtggtgaggaaggtggccggcctggacaagcaggccaagctgagtgacctgcagaatgctgctgctggcagctttgccagcgcctttgctgccctggtgctgtgccccacagagctggtgaagtgccgcctgcagaccatgtatgagatggagaccagcggcaagatcgccaagagccagaacacagtgtggagcgtcatcaagagcatcctgaggaaggatggccccctgggcttctaccacggcctgagcagcaccctgctgcgggaggtgcccggctacttcttcttcttcggcggctatgagctgagccgctccttctttgccagcggccgcagcaaggatgagctgggccctgtgcccctgatgctgtctggaggagtgggcggcatctgcctgtggctggccgtgtaccctgtggactgcatcaagagccgcatccaggtgctgtccatgtctgggaagcaggccggcttcatccgcaccttcatcaacgtggtgaagaatgaaggcatcacagccctgtacagcggcctgaagcccaccatgatccgggccttccctgccaacggggccctcttcctggcctatgagtacagcaggaagctgatgatgaaccagctggaggcctactag

SEQ ID NO: 170460 - DNA, 402 bp, Artificial Sequence
  Description of Artificial Sequence: Synthetic coding sequence
atgaagagcaacccagccatccaggccgccatcgacctgacagctggagctgctgggggcacagcctgtgtgctgaccggccagccctttgacaccatgaaggtgaagatgcagaccttcccagacctgtaccggggcctgacagactgctgcctgaagacctacagccaggtgggcttccggggcttctacaagggcaccagccctgccctgattgccaacattgctgaaaattctgtgctcttcatgtgctacggcttctgccagcaggtggtgaggaaggtggccggcctggacaagcaggccaagctgagcacagtgtggagcgtcatcaagagcatcctgaggaaggatggccccctgggcttctaccacggcctgagcagcaccctgctgaggtag

SEQ ID NO: 170461 - DNA, 402 bp, Artificial Sequence; identical to SEQ ID NO: 170460
  Description of Artificial Sequence: Synthetic coding sequence

SEQ ID NO: 170462 - DNA, 906 bp, Artificial Sequence; identical to SEQ ID NO: 170459
  Description of Artificial Sequence: Synthetic coding sequence

SEQ ID NO: 170463 - DNA, 726 bp, Artificial Sequence
  Description of Artificial Sequence: Synthetic coding sequence
atgaagagcaacccagccatccaggccgccatcgacctgacagctggagctgctgggggcacagcctgtgtgctgaccggccagccctttgacaccatgaaggtggccggcctggacaagcaggccaagctgagtgacctgcagaatgctgctgctggcagctttgccagcgcctttgctgccctggtgctgtgccccacagagctggtgaagtgccgcctgcagaccatgtatgagatggagaccagcggcaagatcgccaagagccagaacacagtgtggagcgtcatcaagagcatcctgaggaaggatggccccctgggcttctaccacggcctgagcagcaccctgctgcgggaggtgcccggctacttcttcttcttcggcggctatgagctgagccgctccttctttgccagcggccgcagcaaggatgagctgggccctgtgcccctgatgctgtctggaggagtgggcggcatctgcctgtggctggccgtgtaccctgtggactgcatcaagagccgcatccaggtgctgtccatgtctgggaagcaggccggcttcatccgcaccttcatcaacgtggtgaagaatgaaggcatcacagccctgtacagcggcctgaagcccaccatgatccgggccttccctgccaacggggccctcttcctggcctatgagtacagcaggaagctgatgatgaaccagctggaggcctactag

SEQ ID NO: 170464 - DNA, 906 bp, Artificial Sequence
  Description of Artificial Sequence: Synthetic coding sequence
atgaagagcggccctggcatccaggccgccatcgacctgacagctggagctgctgggggcacagcctgtgtgctgaccggccagccctttgacaccatcaaggtgaagatgcagaccttcccagacctgtacaagggcctgacagactgcttcctgaagacctacgcccaggtgggcctgcggggcttctacaagggcactggacctgccctgatggcctacgtggctgaaaattctgtgctcttcatgtgctacggcttctgccagcagtttgtgaggaaggtggccggcatggacaagcaggccaagctgagtgacctgcagacagctgctgctggcagctttgccagcgcctttgctgccctggccctgtgccccacagagctggtgaagtgccgcctgcagaccatgtatgagatggagatgtctgggaagatcgccaagagccacaacaccatctggagcgtggtgaagggcatcctgaagaaggatggccccctgggcttctaccacggcctgagcagcaccctgctgcaggaggtgcccggctacttcttcttcttcggcggctatgagctgagccgctccttctttgccagcggccgcagcaaggatgagctgggccctgtgcacctgatgctgtctggaggagtggccggcatctgcctgtggctggtggtgtttcctgtggactgcatcaagagccgcatccaggtgctgtccatgtatggcaagcaggccggcttcatcggcaccctgctgtctgtggtgagaaatgaaggcatcgtggccctgtacagcggcctgaaggccaccatgatccgggccatcccagccaacggggccctgtttgtggcctatgagtacagcaggaagatgatgatgaagcagctggaggcctactag

SEQ ID NO: 170465 - DNA, 423 bp, Artificial Sequence
  Description of Artificial Sequence: Synthetic coding sequence
atggccggctggaatgcctacatcgacaacctgatggctgatggcacctgccaggatgctgccatcgtgggctacaaggacagccccagcgtgtgggccgctgtgcctgggaagacctttgtgaacatcaccccagctgaggtgggcgtgctggtgggcaaggacaggagcagcttctacgtgaatggcctgaccctgggcggccagaagtgcagcgtcatccgggacagcctgctgcaggatggagagttctccatggacctgcggaccaagagcactggaggagcccccaccttcaacgtgacagtgaccaagacagacaagaccctggtgctgctgatgggcaaggagggcgtgcacggcggcctcatcaacaagaagtgctatgagatggccagccacctgcggcgcagccagtactag

SEQ ID NO: 170466 - DNA, 792 bp, Artificial Sequence
  Description of Artificial Sequence: Synthetic coding sequence
atggccgccacagccagcgctggagctgggggcattgatggcaagcccaggaccagccccaagtctgtgaagttcctgtttggaggcctggccggcctgtctgctggcctgctgcggcaggccacctacaccaccacccggctgggcatctacacagtgctgtttgagcggctgactggagcagatggcaccccacctggcttcctgctgaaggccgtcatcggcatgacagctggggccactggagcctttgtgggcaccccagctgaggtggccctgatccgcatgacagcagatggccgcctgcctgctgaccagaggcggggctacaagaatgtgttcaatgccctgatccgcatcacccgggaggagggcgtgctgaccctgtggaggggctgcatccccaccatggcccgggctgtggtggtgaatgctgcccagctggccagctacagccagagcaagcagttcctgctggacagcggctacttcagtgacaacatcctgtgccacttctgtgcctccatgatcagcggcctggtgaccacagctgcctccatgcctgtggacatcgccaagacccgcatccagaacatgaggatgattgatggcaagccagagtacaagaatggcctggatgtgctcttcaaggtggtgcgctatgagggcttcttcagcctgtggaagggcttcaccccctactatgcccggctgggcccccacacagtgctgaccttcatcttcctggagcagatgaacaaggcctacaagaggctcttcctgagcggctag

SEQ ID NO: 170467 - DNA, 678 bp, Artificial Sequence
  Description of Artificial Sequence: Synthetic coding sequence
atggagtactggtacgtggccctgaagcagcagagcctgaaggctgacatcctgcccagcctcttcctgagcatcttcctggtgaagggcgtggtgaatgtgctgctgaccacccccctgtgggtggtgaacacccggctgaagctgcagggcgccaagttcagaaatgaagatattgtgcccaccaactacaagggcatcattgatgccttccaccagatcatcagagatgagggcatcagcgccctgtggaatggcaccttccccagcctgctgctggtgttcaacccagccatccagttcatgttttatgagggcctgaagaggcagctgctgaagaagaggatgaagctgagcagcctggatgtgttcatcatcggggctgtggccaaggccatcgccaccaccgtgacctaccccctgcagacagtgcagagcatcctgcgcttcggccgccaccggctgaaccctgagaacagaaccctgggcagcctgaggaacatcctgtacctgctgcaccagagggtgagaagatttggcatcatgggcctgtacaagggcctggaggccaagctgctgcagacagtgctgacagctgccctgatgttcctggtgtatgagaagctgacagctgccaccttcaccgtgatgggcctgaagagggcccaccagcactag

SEQ ID NO: 170468 - DNA, 279 bp, Artificial Sequence
  Description of Artificial Sequence: Synthetic coding sequence
atgggctctgtgacagccatgaccgtcttcttccccctggacacagcccggctgcggctgcaggtggatgagaagaggaagagcaagaccacccacatggtgctgctggagatcatcaaggaggagggcctgctggccccctaccggggctggttccctgtgatcagcagcctgtgctgcagcaactttgtgtacttctacaccttcaacagcctgaaggccctgtgggtgaagggccagcacagcaccaccgggaaggacctggtggtgggcttctag

SEQ ID NO: 170469 - DNA, 924 bp, Artificial Sequence
  Description of Artificial Sequence: Synthetic coding sequence
atggcctctgtgctgtcctatgagagcctggtgcatgctgtggccggggctgtgggctctgtgacagccatgacagtgttcttccccctggacacagcccggctgcggctgcaggtggatgagaagaggaagagcaagaccacccacatggtgctgctggagatcatcaaggaggagggcctgctggccccctaccggggctggttccctgtgatcagcagcctgtgctgcagcaactttgtgtacttctacaccttcaacagcctgaaggccctgtgggtgaagggccagcacagcaccaccgggaaggacctggtggtgggctttgtggccggcgtggtgaatgtgctgctgaccacccccctgtgggtggtgaacacccggctgaagctgcagggcgccaagttcagaaatgaagatattgtgcccaccaactacaagggcatcattgatgccttccaccagatcatcagagatgagggcatcagcgccctgtggaatggcaccttccccagcctgctgctggtgttcaacccagccatccagttcatgttttatgagggcctgaagaggcagctgctgaagaagaggatgaagctgagcagcctggatgtgttcatcatcggggctgtggccaaggccatcgccaccaccgtgacctaccccctgcagacagtgcagagcatcctgcgcttcggccgccaccggctgaaccctgagaacagaaccctgggcagcctgaggaacatcctgtacctgctgcaccagagggtgagaagatttggcatcatgggcctgtacaagggcctggaggccaagctgctgcagacagtgctgacagctgccctgatgttcctggtgtatgagaagctgacagctgccaccttcaccgtgatgggcctgaagagggcccaccagcactag

SEQ ID NO: 170470 - DNA, 705 bp, Artificial Sequence
  Description of Artificial Sequence: Synthetic coding sequence
atggcctctgtgctgtcctatgagagcctggtgcatgctgtggccggggctgtgggctctgtgacagccatgacagtgttcttccccctggacacagcccggctgcggctgcagggcgtggtgaatgtgctgctgaccacccccctgtgggtggtgaacacccggctgaagctgcagggcgccaagttcagaaatgaagacatcgtgcccaccaactacaagggcatcattgatgccttccaccagatcatcagagatgagggcatcagcgccctgtggaatggcaccttccccagcctgctgctggtgttcaacccagccatccagttcatgttttatgagggcctgaagaggcagctgctgaagaagaggatgaagctgagcagcctggatgtgttcatcattggagctgtggccaaggccatcgccaccaccgtgacctaccccctgcagacagtgcagagcatcctgcgcttcggccgccaccggctgaacccagaaaatagaaccctgggcagcctgaggaacatcctgtacctgctgcaccagagggtgcggcgcttcggcatcatgggcctgtacaagggcctggaggccaagctgctgcagacagtgctgacagctgccctgatgttcctggtgtatgagaagctgacagctgccaccttcaccgtgatgggcctgaagagggcccaccagcactag

SEQ ID NO: 170471 - DNA, 813 bp, Artificial Sequence
  Description of Artificial Sequence: Synthetic coding sequence
atgattgatgagaagaggaagagcaagaccacccacatggtgctgctggagatcatcaaggaggagggcctgctggccccctaccggggctggttccctgtgatcagcagcctgtgctgcagcaactttgtgtacttctacaccttcaacagcctgaaggccctgtgggtgaagggccagcacagcaccaccgggaaggacctggtggtgggctttgtggccggcgtggtgaatgtgctgctgaccacccccctgtgggtggtgaacacccggctgaagctgcagggcgccaagttcagaaatgaagacatcgtgcccaccaactacaagggcatcattgatgccttccaccagatcatcagagatgagggcatcagcgccctgtggaatggcaccttccccagcctgctgctggtgttcaacccagccatccagttcatgttttatgagggcctgaagaggcagctgctgaagaagaggatgaagctgagcagcctggatgtgttcatcattggagctgtggccaaggccatcgccaccaccgtgacctaccccctgcagacagtgcagagcatcctgcgcttcggccgccaccggctgaacccagaaaatagaaccctgggcagcctgaggaacatcctgtacctgctgcaccagagggtgcggcgcttcggcatcatgggcctgtacaagggcctggaggccaagctgctgcagacagtgctgacagctgccctgatgttcctggtgtatgagaagctgacagctgccaccttcaccgtgatgggcctgaagagggcccaccagcactag

SEQ ID NO: 170472 - DNA, 1086 bp, Artificial Sequence
  Description of Artificial Sequence: Synthetic coding sequence
atgttcagctctgtggcccacctggcccgggccaaccccttcaacaccccccacctgcagctggtgcatgatggcctgggggacctgcggagcagcagccctggccccaccggccagccccggcggcccaggaacctggccgctgctgctgtggaggagtacagctgtgaatttggcagcgccaagtactatgccctgtgtggctttggaggagtgctgagctgtggcctgacccacacagctgtggtgcccctggacctggtgaagtgcaggatgcaggtggacccccagaagtacaagggcatcttcaacggcttctctgtgaccctgaaggaggatggagtgcggggcctggccaagggctgggcccccaccttcctgggctacagcatgcagggcctgtgcaagtttggcttctatgaggtgttcaaggtgctgtacagcaacatgctgggggaggagaacacctacctgtggaggaccagcctgtacctggccgccagcgccagcgctgagttctttgctgacatcgccctggcccccatggaggccgccaaggtgcgcatccagacccagcccggctacgccaacaccctgagagatgctgcccccaagatgtacaaggaggagggcctgaaggccttctacaagggcgtggcccccctgtggatgaggcagatcccctacaccatgatgaagtttgcctgctttgagaggacagtggaggccctgtacaagtttgtggtgcccaagcccaggagtgaatgttccaagccagagcagctggtggtgacctttgtggccggctacatcgccggggtcttctgtgccatcgtgagccaccctgctgacagcgtggtgtctgtgctgaacaaggagaagggcagcagcgccagcctggtgctgaagaggctgggcttcaagggcgtgtggaagggcctgtttgcccgcatcatcatgattggcaccctgacagccctgcagtggttcatctatgacagcgtgaaggtgtacttccggctgccccggcccccacctcctgagatgcctgagagcctgaagaagaagctgggcctgacccagtag

SEQ ID NO: 170473 - DNA, 1776 bp, Artificial Sequence
  Description of Artificial Sequence: Synthetic coding sequence
atggatgacctggatgccctgctggccgacctggagagcaccaccagccacatcagcaagaggcctgtgttcctgtctgaggagaccccctacagctaccccactggaaaccacacctaccaggagattgctgtgcccccacctgtgcccccaccacccagcagcgaggccctgaatggcaccatcctggaccccctggaccagtggcagcccagcagcagccgcttcatccaccagcagccccagagcagcagccctgtgtatggcagcagcgccaagaccagctctgtgagcaacccccaggacagcgtgggcagcccctgcagccgggtgggggaggaggagcacgtgtacagcttccccaacaagcagaagtctgctgagcccagccccaccgtgatgagcaccagcctgggcagcaacctgtctgagctggaccggctgctgctggagctgaatgctgtgcagcacaaccccccaggcttcccagcagatgaggccaacagcagcccccccctgcccggggccctgagccccctgtatggagtgcctgagaccaacagccccctgggcggcaaggccggccccctgaccaaggagaagcccaagagaaatggaggccggggcctggaggatgtgcggcccagcgtggagagcctgctggatgagctggagagctctgtgcccagccctgtgcctgccatcaccgtgaaccagggcgagatgagcagcccccagagggtgaccagcacccagcagcagacccgcatcagcgccagcagcgccacccgggagctggatgagctgatggccagcctgagtgacttcaagatccagggcctggagcagagagcagatggagagcgctgctgggccgccggctggcccagagatggcggccgcagcagccctgggggccaggatgagggcggcttcatggcccagggcaagacaggcagcagcagccccccaggcggcccccccaagccaggcagccagctggacagcatgctgggcagcctgcagagcgacctgaacaagctgggcgtggccaccgtggccaagggcgtgtgtggggcctgcaagaagcccatcgccggccaggtggtgacagccatgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttcttcggccctgagggcttccacgagaaggatggcaaggcctactgcaggaaggactactttgacatgtttgcccccaagtgtggcggctgtgcccgggccatcctggagaactacatcagcgccctgaacaccctgtggcaccctgagtgctttgtgtgccgggagtgcttcaccccatttgtgaatggcagcttctttgaacatgatggccagccctactgtgaggtgcactaccacgagcggcggggcagcctgtgcagcggctgccagaagcccatcaccggccgctgcatcacagccatggccaagaagttccaccctgagcactttgtgtgtgccttctgcctgaagcagctgaacaagggcaccttcaaggagcagaatgacaagccctactgccagaactgcttcctgaagctgttctgctag

SEQ ID NO: 170474 - DNA, 1086 bp, Artificial Sequence; identical to SEQ ID NO: 170472
  Description of Artificial Sequence: Synthetic coding sequence

SEQ ID NO: 170475 - DNA, 1086 bp, Artificial Sequence; identical to SEQ ID NO: 170472
  Description of Artificial Sequence: Synthetic coding sequence

SEQ ID NO: 170476 - DNA, 1089 bp, Artificial Sequence; identical to SEQ ID NO: 161684
  Description of Artificial Sequence: Synthetic coding sequence

SEQ ID NO: 170477 - DNA, 1086 bp, Artificial Sequence; identical to SEQ ID NO: 170472
  Description of Artificial Sequence: Synthetic coding sequence

SEQ ID NO: 170478 - DNA, 897 bp, Artificial Sequence
  Description of Artificial Sequence: Synthetic coding sequence
atgtctgccaagccagaggtgtccctggtgcgggaggccagccggcagatcgtggccggcggcagcgctggcctggtggagatctgcctgatgcaccccctggatgtggtgaagacccgcttccagatccagagatgtgccacagaccccaacagctacaagagcctggtggacagcttcaggatgatcttccagatggagggcctgtttggcttctacaagggcatcctgccccccatcctggccgagacccccaagagagctgtgaagttcttcacctttgagcagtacaagaagctgctgggctacgtgtccctgagccctgccctgacctttgccatcgccggcctgggcagcggcctgacagaggccatcgtggtgaacccctttgaggtggtgaaggtgggcctgcaggccaacagaaacacctttgctgagcagcccagcacagtgggctacgcccggcagatcatcaagaaggagggctggggcctgcagggcctgaacaagggcctgacagccaccctgggcagacatggagtcttcaacatggtgtacttcggcttctactacaacgtgaagaacatgatccctgtgaacaaggaccccatcctggagttctggaggaagtttggaattggcctgctgagcggcaccatcgccagcgtcatcaacatcccctttgatgtggccaagagccgcatccagggcccccagcctgtgcctggagagatcaagtaccgcacctgcttcaagaccatggccaccgtgtaccaggaggagggcatcctggccctgtacaagggcctgctgcccaagatcatgaggctgggccctggaggagctgtgatgctgctggtgtatgagtacacctacagctggctgcaggagaactag

SEQ ID NO: 170479 - DNA, 900 bp, Artificial Sequence
  Description of Artificial Sequence: Synthetic coding sequence
atgtctgccaagccagaggtgtccctggtgcgggaggccagccggcagatcgtggccggcggcagcgctggcctggtggagatctgcctgatgcaccccctggatgtggtgaagacccgcttccagatccagagatgtgccacagaccccaacagctacaagagcctggtggacagcttcaggatgatcttccagatggagggcctgtttggcttctacaagggcatcctgccccccatcctggccgagacccccaagagagctgtgaagttcttcacctttgagcagtacaagaagctgctgggctacgtgtccctgagccctgccctgacctttgccatcgccggcctgggcagcggcctgacagaggccatcgtggtgaacccctttgaggtggtgaaggtgggcctgcaggccaacagaaacacctttgctgagcagcccagcacagtgggctacgcccggcagatcatcaagaaggagggctggggcctgcagggcctgaacaagggcctgacagccaccctgggcagacatggagtcttcaacatggtgtacttcggcttctactacaacgtgaagaacatgatccctgtgaacaaggaccccatcctggagttctggaggaagtttggaattggcctgctgagcggcaccatcgccagcgtcatcaacatcccctttgatgtggccaagagccgcatccagggcccccagcctgtgcctggagagatcaagtaccgcacctgcttcaagaccatggccaccgtgtaccaggaggagggcatcctggccctgtacaagggcctgctgcccaagatcatgaggctgggccctggaggagctgtgatgctgctggtgtatgagtacacctacagctggctgcaggagaactggtag

SEQ ID NO: 170480 - DNA, 963 bp, Artificial Sequence
  Description of Artificial Sequence: Synthetic coding sequence
atggtgggctatgaccccaagccagatggaagaaacaacaccaagttccaggtggccgtggccggctctgtgtctggcctggtgacccgggccctgatcagcccctttgatgtgatcaagatccgcttccagctgcagcacgagcggctgagcagaagtgaccccagcgccaagtaccacggcatcctgcaggccagccggcagatcctgcaggaggagggccccacagccttctggaagggccacgtgcctgcccagatcctgagcatcggctacggggctgtgcagttcctgagctttgagatgctgacagagctggtgcaccggggctctgtgtatgatgcccgggagttctctgtgcactttgtgtgtggcggcctggccgcctgcatggccaccctgactgtgcaccctgtggatgtgctgcggaccaggtttgctgcccagggcgagcccaaggtgtacaacaccctgcggcatgctgtgggcaccatgtacagaagtgagggcccccaggtgttctacaagggcctggcccccaccctgattgccatcttcccctatgccggcctgcagttcagctgctacagcagcctgaagcacctgtacaagtgggccatcccagctgagggcaagaagaatgaaaacctgcagaacctgctgtgtggcagcggggccggggtcatcagcaagaccctgacctaccccctggacctcttcaagaagaggctgcaggtgggcggctttgaacatgcccgggccgccttcggccaggtgcggcgctacaagggcctgatggactgtgccaagcaggtgctgcagaaggagggcgccctgggcttcttcaagggcctgagccccagcctgctgaaggccgccctgagcacaggcttcatgttcttctcctatgagttcttctgcaatgtgttccactgcatgaacagaacagccagccagaggtag

SEQ ID NO: 170481 - DNA, 963 bp, Artificial Sequence; identical to SEQ ID NO: 170480
  Description of Artificial Sequence: Synthetic coding sequence

SEQ ID NO: 170482 - DNA, 792 bp, Artificial Sequence
  Description of Artificial Sequence: Synthetic coding sequence
atggtgggctatgaccccaagccagatggaagaaacaacaccaagttccaggtggccgtggccggctctgtgtctggcctggtgacccgggccctgatcagcccctttgatgtgatcaagatccgcttccagctgcagcacgagcggctgagcagaagtgaccccagcgccaagtaccacggcatcctgcaggccagccggcagatcctgcaggaggagggccccacagccttctggaagggccacgtgcctgcccagatcctgagcatcggctacggggctgtgcaggtgtacaacaccctgcggcatgctgtgggcaccatgtacagaagtgagggcccccaggtgttctacaagggcctggcccccaccctcatcgccatcttcccctatgccggcctgcagttcagctgctacagcagcctgaagcacctgtacaagtgggccatcccagctgagggcaagaagaatgaaaacctgcagaacctgctgtgtggcagcggggccggggtcatcagcaagaccctgacctaccccctggacctcttcaagaagaggctgcaggtgggcggctttgagcacgcccgggccgccttcggccaggtgcggcgctacaagggcctgatggactgtgccaagcaggtgctgcagaaggagggcgccctgggcttcttcaagggcctgagccccagcctgctgaaggccgccctgagcacaggcttcatgttcttctcctatgagttcttctgcaatgtgttccactgcatgaacagaacagccagccagaggtag

SEQ ID NO: 170483 - DNA, 963 bp, Artificial Sequence; identical to SEQ ID NO: 170480
  Description of Artificial Sequence: Synthetic coding sequence

SEQ ID NO: 170484 - DNA, 963 bp, Artificial Sequence; identical to SEQ ID NO: 170480
  Description of Artificial Sequence: Synthetic coding sequence

SEQ ID NO: 170485 - DNA, 963 bp, Artificial Sequence; identical to SEQ ID NO: 170480
  Description of Artificial Sequence: Synthetic coding sequence

SEQ ID NO: 170486 - DNA, 2028 bp, Artificial Sequence
  Description of Artificial Sequence: Synthetic coding sequence
atggctgctgccaaggtggccctgaccaagagagctgaccctgctgagctgcggaccatcttcctgaagtatgccagcattgagaagaatggagagttcttcatgagccccaatgactttgtgacccgctacctgaacatctttggagagagccagcccaaccccaagacagtggagctgctgagcggcgtggtggaccagaccaaggatggcctcatctccttccaggagtttgtggcctttgaatctgtgctgtgtgccccagatgccctcttcatggtggccttccagctgtttgacaaggccggcaagggggaggtgacctttgaagatgtgaagcaggtgtttggccagaccaccatccaccagcacatccccttcaactgggacagcgagtttgtgcagctgcactttgggaaggagaggaagaggcacctgacctatgcagagttcacccagttcctgctggagatccagctggagcacgccaagcaggcctttgtgcagagggacaatgccaggacaggccgggtgacagccatcgacttccgggacatcatggtgaccatccggccccacgtgctgaccccatttgtggaggagtgcctggtggccgctgctgggggcaccaccagccaccaggtgtccttctcctacttcaacggcttcaacagcctgctgaacaacatggagctgatcaggaagatctacagcaccctggccggcaccaggaaggatgtggaggtgaccaaggaggagtttgtgctggccgcccagaagtttggccaggtgacccccatggaggtggacatcctcttccagctggccgacctgtatgagccccggggccgcatgaccctggccgacatcgagagaattgcccccctggaggagggcaccctgcccttcaacctggccgaggcccagaggcagaaggccagcggggacagcgcccggcctgtgctgctgcaggtggccgagagcgcctaccgcttcggcctgggctctgtggccggggctgtgggcgccacagctgtgtaccccatcgacctggtgaagaccaggatgcagaaccagaggagcacaggcagctttgtgggggagctgatgtacaagaacagctttgactgcttcaagaaggtgctgcgctatgagggcttcttcggcctgtaccggggcctgctgccccagctgctgggcgtggcccctgagaaggccatcaagctgactgtgaatgactttgtgcgggacaagttcatgcacaaggatggctctgtgcccctggccgctgagatcctggccggcggctgtgccggcggcagccaggtgatcttcaccaaccccctggagatcgtgaagatccggctgcaggtggccggggagatcaccaccggcccccgggtgtctgccctgtctgtggtgcgggacctgggcttcttcggcatctacaagggggccaaggcctgcttcctgcgggacatccccttcagcgccatctacttcccctgctacgcccacgtgaaggccagctttgccaatgaagatggccaggtgtccccaggcagcctgctgctggccggggccatcgccggcatgcctgctgccagcctggtgaccccagcagatgtgatcaagacccggctgcaggtggccgcccgggccggccagaccacctacagcggcgtgattgactgcttcaggaagatcctgcgggaggagggccccaaggccctgtggaagggggccggggcccgggtcttccgcagcagcccccagtttggagtgaccctgctgacctatgagctgctgcagcgctggttctacatcgactttggaggagtgaagcccatgggcagcgagcctgtgcccaagagccgcatcaacctgcctgcccccaacccagaccacgtgggcggctacaagctggccgtggccacctttgctggcatcgagaacaagtttggcctgtacctgcccctcttcaagcccagcgtgtccaccagcaaggccatcggcggcggcccctag

SEQ ID NO: 170487 - DNA, 2031 bp, Artificial Sequence
  Description of Artificial Sequence: Synthetic coding sequence
atggctgctgccaaggtggccctgaccaagagagctgaccctgctgagctgcggaccatcttcctgaagtatgccagcattgagaagaatggagagttcttcatgagccccaatgactttgtgacccgctacctgaacatctttggagagagccagcccaaccccaagacagtggagctgctgagcggcgtggtggaccagaccaaggatggcctcatctccttccaggagtttgtggcctttgaatctgtgctgtgtgccccagatgccctcttcatggtggccttccagctgtttgacaaggccggcaagggggaggtgacctttgaagatgtgaagcaggtgtttggccagaccaccatccaccagcacatccccttcaactgggacagcgagtttgtgcagctgcactttgggaaggagaggaagaggcacctgacctatgcagagttcacccagttcctgctggagatccagctggagcacgccaagcaggcctttgtgcagagggacaatgccaggacaggccgggtgacagccatcgacttccgggacatcatggtgaccatccggccccacgtgctgaccccatttgtggaggagtgcctggtggccgctgctgggggcaccaccagccaccaggtgtccttctcctacttcaacggcttcaacagcctgctgaacaacatggagctgatcaggaagatctacagcaccctggccggcaccaggaaggatgtggaggtgaccaaggaggagtttgtgctggccgcccagaagtttggccaggtgacccccatggaggtggacatcctcttccagctggccgacctgtatgagccccggggccgcatgaccctggccgacatcgagagaattgcccccctggaggagggcaccctgcccttcaacctggccgaggcccagaggcagcagaaggccagcggggacagcgcccggcctgtgctgctgcaggtggccgagagcgcctacagatttggcctgggctctgtggccggggctgtgggcgccacagctgtgtaccccatcgacctggtgaagaccaggatgcagaaccagaggagcacaggcagctttgtgggggagctgatgtacaagaacagctttgactgcttcaagaaggtgctgcgctatgagggcttcttcggcctgtaccggggcctgctgccccagctgctgggcgtggcccctgagaaggccatcaagctgactgtgaatgactttgtgcgggacaagttcatgcacaaggatggctctgtgcccctggccgctgagatcctggccggcggctgtgccggcggcagccaggtgatcttcaccaaccccctggagatcgtgaagatccggctgcaggtggccggggagatcaccaccggcccccgggtgtctgccctgtctgtggtgcgggacctgggcttcttcggcatctacaagggggccaaggcctgcttcctgcgggacatccccttcagcgccatctacttcccctgctacgcccacgtgaaggccagctttgccaatgaagatggccaggtgtccccaggcagcctgctgctggccggggccatcgccggcatgcctgctgccagcctggtgaccccagcagatgtgatcaagacccggctgcaggtggccgcccgggccggccagaccacctacagcggggtcatcgactgcttcaggaagatcctgcgggaggagggccccaaggccctgtggaagggagctggggcccgggtcttccgcagcagcccccagtttggagtgaccctgctgacctatgagctgctgcagcgctggttctacatcgactttggaggagtgaagcccatgggcagcgagcctgtgcccaagagccgcatcaacctgcctgcccccaacccagaccacgtgggcggctacaagctggccgtggccacctttgctggcatcgagaacaagtttggcctgtacctgcccctcttcaagcccagcgtgtccaccagcaaggccatcggcggcggcccctag

SEQ ID NO: 170488 - DNA, 1704 bp, Artificial Sequence
  Description of Artificial Sequence: Synthetic coding sequence
atggaggatgtgaagcaggtgtttggccagaccaccatccaccagcacatccccttcaactgggacagcgagtttgtgcagctgcactttgggaaggagaggaagaggcacctgacctatgcagagttcacccagttcctgctggagatccagctggagcacgccaagcaggcctttgtgcagagggacaatgccaggacaggccgggtgacagccatcgacttccgggacatcatggtgaccatccggccccacgtgctgaccccatttgtggaggagtgcctggtggccgctgctgggggcaccaccagccaccaggtgtccttctcctacttcaacggcttcaacagcctgctgaacaacatggagctgatcaggaagatctacagcaccctggccggcaccaggaaggatgtggaggtgaccaaggaggagtttgtgctggccgcccagaagtttggccaggtgacccccatggaggtggacatcctcttccagctggccgacctgtatgagccccggggccgcatgaccctggccgacatcgagagaattgcccccctggaggagggcaccctgcccttcaacctggccgaggcccagaggcagaaggccagcggggacagcgcccggcctgtgctgctgcaggtggccgagagcgcctaccgcttcggcctgggctctgtggccggggctgtgggcgccacagctgtgtaccccatcgacctggtgaagaccaggatgcagaaccagaggagcacaggcagctttgtgggggagctgatgtacaagaacagctttgactgcttcaagaaggtgctgcgctatgagggcttcttcggcctgtaccggggcctgctgccccagctgctgggcgtggcccctgagaaggccatcaagctgactgtgaatgactttgtgcgggacaagttcatgcacaaggatggctctgtgcccctggccgctgagatcctggccggcggctgtgccggcggcagccaggtgatcttcaccaaccccctggagatcgtgaagatccggctgcaggtggccggggagatcaccaccggcccccgggtgtctgccctgtctgtggtgcgggacctgggcttcttcggcatctacaagggggccaaggcctgcttcctgcgggacatccccttcagcgccatctacttcccctgctacgcccacgtgaaggccagctttgccaatgaagatggccaggtgtccccaggcagcctgctgctggccggggccatcgccggcatgcctgctgccagcctggtgaccccagcagatgtgatcaagacccggctgcaggtggccgcccgggccggccagaccacctacagcggcgtgattgactgcttcaggaagatcctgcgggaggagggccccaaggccctgtggaagggggccggggcccgggtcttccgcagcagcccccagtttggagtgaccctgctgacctatgagctgctgcagcgctggttctacatcgactttggaggagtgaagcccatgggcagcgagcctgtgcccaagagccgcatcaacctgcctgcccccaacccagaccacgtgggcggctacaagctggccgtggccacctttgctggcatcgagaacaagtttggcctgtacctgcccctcttcaagcccagcgtgtccaccagcaaggccatcggcggcggcccctag

SEQ ID NO: 170489 - DNA, 561 bp, Artificial Sequence
  Description of Artificial Sequence: Synthetic coding sequence
atgaagcacatgctggccgccagcgctggggaggtggtggcctgcctgatccgggtgcccagcgaggtggtgaagcagagggcccaggtgtctgccagcaccaggaccttccagatcttcagcaacatcctgtatgaggagggcatccagggcctgtaccggggctacaagagcacagtgctgcgggagatccccttcagcctggtgcagttccccctgtgggagagcctgaaggccctgtggagctggaggcaggaccacgtggtggacagctggcagagcgctgtgtgtggggcctttgctgggggctttgctgctgctgtgaccacccccctggatgtggccaagacccgcatcaccctggccaaggccggcagcagcacagcagatggaaatgtgctgtctgtgctgcacggcgtgtggaggagccagggcctggccggcctgtttgctggggtcttccccaggatggccgccatcagcctgggcggcttcatcttcctgggcgcctatgacaggacccacagcctgctgctggaggtgggcaggaagagcccctag

SEQ ID NO: 170490 - DNA, 825 bp, Artificial Sequence
  Description of Artificial Sequence: Synthetic coding sequence
atggaccggcccggctttgtggccgccctggtggccggcggcgtggccggcgtgtctgtggacctgatcctcttccccctggacaccatcaagacccggctgcagagcccccagggcttcagcaaggccggcggcttccacggcatctatgccggcgtgcccagcgctgccatcggcagcttccccaatgctgctgccttcttcatcacctatgaatatgtgaagtggttcctgcacgccgacagcagcagctacctgacccccatgaagcacatgctggccgccagcgctggggaggtggtggcctgcctgatccgggtgcccagcgaggtggtgaagcagagggcccaggtgtctgccagcaccaggaccttccagatcttcagcaacatcctgtatgaggagggcatccagggcctgtaccggggctacaagagcacagtgctgcgggagatccccttcagcctggtgcagttccccctgtgggagagcctgaaggccctgtggagctggaggcaggaccacgtggtggacagctggcagagcgctgtgtgtggggcctttgctgggggctttgctgctgctgtgaccacccccctggatgtggccaagacccgcatcaccctggccaaggccggcagcagcacagcagatggaaatgtgctgtctgtgctgcacggcgtgtggaggagccagggcctggccggcctgtttgctggggtcttccccaggatggccgccatcagcctgggcggcttcatcttcctgggcgcctatgacaggacccacagcctgctgctggaggtgggcaggaagagcccctag

SEQ ID NO: 170491 - DNA, 66 bp, Artificial Sequence
  Description of Artificial Sequence: Synthetic coding sequence
atggaccggcccggctttgtggccgccctggtgctgctgcacttcctgagccccatgaacatgtag

SEQ ID NO: 170492 - DNA, 477 bp, Artificial Sequence
  Description of Artificial Sequence: Synthetic coding sequence
atggagggcaagaggaagctggagggcaagcccctgcgcttccggggcgtgcaccacgcctttgccaagatcctggccgagggcggcatccggggcctgtgggccggctgggtgcccaacatccagagagctgccctggtgaacatgggagacctgaccacctatgacacagtgaagcactacctggtgctgaacacccccctggaggacaacatcatgacccacggcctgagcagcctgtgcagcggcctggtggccagcatcctgggcaccccagcagatgtgatcaagagccgcatcatgaaccagccccgggacaagcagggccggggcctgctgtacaagagcagcacagactgcctgatccaggccgtgcagggcgagggcttcatgagcctgtacaagggcttcctgcccagctggctgaggatggccgccgtcatcgtgaacagcagccgcagccagctgaaggtgtag

SEQ ID NO: 170493 - DNA, 972 bp, Artificial Sequence
  Description of Artificial Sequence: Synthetic coding sequence
atgtctgtgcctgaggaggaggagcggctgctgcccctgacccagcgctggccccgggccagcaagttcctgctgagcggctgtgccgccaccgtggccgagctggccaccttccccctggacctgaccaagacccggctgcagatgcagggcgaggccgccctggcccggctgggagatggagcccgggagagcgccccctaccggggcatggtgaggacagccctgggcatcatcgaggaggagggcttcctgaagctgtggcagggcgtgaccccagccatctaccgccacgtggtgtacagcggcggccgcatggtgacctatgagcacctgcgggaggtggtgtttgggaagtcagaagatgagcactaccccctgtggaagagcgtcatcggcggcatgatggccggggtcatcggccagttcctggccaaccccacagacctggtgaaggtgcagatgcagatggagggcaagaggaagctggagggcaagcccctgcgcttccggggcgtgcaccacgcctttgccaagatcctggccgagggcggcatccggggcctgtgggccggctgggtgcccaacatccagagagctgccctggtgaacatgggagacctgaccacctatgacacagtgaagcactacctggtgctgaacacccccctggaggacaacatcatgacccacggcctgagcagcctgtgcagcggcctggtggccagcatcctgggcaccccagcagatgtgatcaagagccgcatcatgaaccagccccgggacaagcagggccggggcctgctgtacaagagcagcacagactgcctgatccaggccgtgcagggcgagggcttcatgagcctgtacaagggcttcctgcccagctggctgaggatgaccccctggagcatggtgttctggctgacctatgagaagatccgggagatgtctggagtgagccccttctag

SEQ ID NO: 170494 - DNA, 738 bp, Artificial Sequence
  Description of Artificial Sequence: Synthetic coding sequence
atgtctgtgcctgaggaggaggagcggctgctgcccctgacccagcgctggccccgggccagcaagttcctgctgagcggctgtgccgccaccgtggccgagctggccaccttccccctggacctgaccaagacccggctgcagatgcagggcgaggccgccctggcccggctgggagatggagcccgggagagcgccccctaccggggcatggtgaggacagccctgggcatcatcgaggaggagggcttcctgaagctgtggcagggcgtgaccccagccatctaccgccacgtggtgtacagcggcggccgcatggtgacctatgagcacctgcgggaggtggtgtttgggaagtcagaagatgagcactaccccctgtggaagagcgtcatcggcggcatgatggccggggtcatcggccagttcctggccaaccccacagacctggtgaaggtgcagatgcagatggagggcaagaggaagctggagggcaagcccctgcgcttccggggcgtgcaccacgcctttgccaagatcctggccgagggcggcatccggggcctgtgggccggctgggtgcccaacatccagagagctgccctggtgaacatgggagacctgaccacctatgacacagtgaagcactacctggtgctgaacacccccctggaggacaacatcatgacccacggcctgagcagtgacctggtgggcagccacaaggccatccagtag

SEQ ID NO: 170495 - DNA, 297 bp, Artificial Sequence
  Description of Artificial Sequence: Synthetic coding sequence
tgaaacatgggagacctgaccacctatgacacagtgaagcactacctggtgctgaacacccccctggaggacaacatcatgacccacggcctgagcagcctgtgcagcggcctggtggccagcatcctgggcaccccagcagatgtgatcaagagccgcatcatgaaccagccccgggacaagcagggccggggcctgctgtacaagagcagcacagactgcctgatccaggccgtgcagggcgagggcttcatgagcctgtacaagggcttcctgcccagctggctgaggatgtag

SEQ ID NO: 170496 - DNA, 450 bp, Artificial Sequence
  Description of Artificial Sequence: Synthetic coding sequence
atgtctgaatgtcccctcatcctgtacatccacaagcacatcgacacctacagccagagctacctgttcaatgacctcttctaccctgtgtacagcggcggccgcatggtgacctatgagcacctgcgggaggtggtgtttgggaagtcagaagatgagcactaccccctgtggaagagcgtcatcggcggcatgatggccggggtcatcggccagttcctggccaaccccacagacctggtgaaggtgcagatgcagatggagggcaagaggaagctggagggcaagcccctgcgcttccggggcgtgcaccacgcctttgccaagatcctggccgagggcggcatccggggcctgtgggccggctgggtgcccaacatccagagagctgccctggtgaacatgggagacctgaccacctatgacacagtgaagcactacctggtgtag

SEQ ID NO: 170497 - DNA, 480 bp, Artificial Sequence
  Description of Artificial Sequence: Synthetic coding sequence
tgaatggagggcaagaggaagctggagggcaagcccctgcgcttccggggcgtgcaccacgcctttgccaagatcctggccgagggcggcatccggggcctgtgggccggctgggtgcccaacatccagagagctgccctggtgaacatgggagacctgaccacctatgacacagtgaagcactacctggtgctgaacacccccctggaggacaacatcatgacccacggcctgagcagcctgtgcagcggcctggtggccagcatcctgggcaccccagcagatgtgatcaagagccgcatcatgaaccagccccgggacaagcagggccggggcctgctgtacaagagcagcacagactgcctgatccaggccgtgcagggcgagggcttcatgagcctgtacaagggcttcctgcccagctggctgaggatggctgctgtgattgtgaacagcagccgcagccagctgaaggtgtag

SEQ ID NO: 170498 - DNA, 714 bp, Artificial Sequence
  Description of Artificial Sequence: Synthetic coding sequence
atgtacctgtacctgatgaagatgcctgctgcctaccaggtgtacagcggcggccgcatggtgacctatgagcacctgcgggaggtggtgtttgggaagtcagaagatgagcactaccccctgtggaagagcgtcatcggcggcatgatggccggggtcatcggccagttcctggccaaccccacagacctggtgaaggtgcagatgcagatggagggcaagaggaagctggagggcaagcccctgcgcttccggggcgtgcaccacgcctttgccaagatcctggccgagggcggcatccggggcctgtgggccggctgggtgcccaacatccagagagctgccctggtgaacatgggagacctgaccacctatgacacagtgaagcactacctggtgctgaacacccccctggaggacaacatcatgacccacggcctgagcagcctgtgcagcggcctggtggccagcatcctgggcaccccagcagatgtgatcaagagccgcatcatgaaccagccccgggacaagcagggccggggcctgctgtacaagagcagcacagactgcctgatccaggccgtgcagggcgagggcttcatgagcctgtacaagggcttcctgcccagctggctgaggatgaccccctggagcatggtgttctggctgacctatgagaagatccgggagatgtctggagtgagccccttctag

SEQ ID NO: 170499 - DNA, 1095 bp, Artificial Sequence
  Description of Artificial Sequence: Synthetic coding sequence
atggagctggagggccgcggggccggcggcgtggccggcggccctgctgctggccctggccgcagccctggagagagcgccctgctggatggctggctgcagaggggcgtgggcagaggagctgggggcggggaggccggggcctgcaggcctcctgtgcggcaggaccctgattctggccctgactatgaggccctgcctgctggggccaccgtgaccacccacatggtggccggggctgtggccggcatcctggagcactgtgtgatgtaccccatcgactgtgtgaagaccaggatgcagagcctgcagcctgaccctgctgcccgctacagaaatgtgctggaggccctgtggaggatcatcagaacagagggcctgtggaggcccatgaggggcctgaatgtgacagccactggagctggccctgcccacgccctgtactttgcctgctatgagaagctgaagaagaccctgagtgatgtgatccaccctgggggcaacagccacatcgccaatggagctgctggctgtgtggccaccctgctgcatgatgctgccatgaacccagctgaggtggtgaagcagaggatgcagatgtacaacagcccctaccaccgggtgacagactgtgtgcgggctgtgtggcagaatgaaggagctggggccttctaccgcagctacaccacccagctgaccatgaatgtgcccttccaggccatccacttcatgacctatgagttcctgcaggagcacttcaacccccagaggcgctacaaccccagcagccacgtgctgagcggggcctgtgccggggctgtggccgctgctgccaccacccccctggatgtgtgcaagaccctgctgaacacccaggagagcctggccctgaacagccacatcaccggccacatcaccggcatggccagcgccttcagaacagtgtaccaggtgggcggcgtgacagcctacttccggggcgtgcaggcccgggtcatctaccagatccccagcacagccatcgcctggagcgtgtatgagttcttcaagtacctgatcaccaagaggcaggaggagtggagggctgggaagtag

SEQ ID NO: 170500 - DNA, 678 bp, Artificial Sequence
  Description of Artificial Sequence: Synthetic coding sequence
cggggagctgctggctggagccactgccaccacgcccatggaggaagaagaagaggccgggaccccggggccctgagagatgtgccccaccggctgcggcagggcgctgctggctgtgtggccaccctgctgcatgatgctgccatgaacccagctgaggtggtgaagcagaggatgcagatgtacaacagcccctaccaccgggtgacagactgtgtgcgggctgtgtggcagaatgaaggagctggggccttctaccgcagctacaccacccagctgaccatgaatgtgcccttccaggccatccacttcatgacctatgagttcctgcaggagcacttcaacccccagaggcgctacaaccccagcagccacgtgctgagcggggcctgtgccggggctgtggccgccgccgccaccacccccctggatgtgtgcaagaccctgctgaacacccaggagagcctggccctgaacagccacatcaccggccacatcaccggcatggccagcgccttcagaacagtgtaccaggtgggcggcgtgacagcctacttccggggcgtgcaggcccgggtcatctaccagatccccagcacagccatcgcctggagcgtgtatgagttcttcaagtacctgatcaccaagaggcaggaggagtggagggctgggaagtag

SEQ ID NO: 170501 - DNA, 876 bp, Artificial Sequence
  Description of Artificial Sequence: Synthetic coding sequence
atgtctgccctgaactggaagccctttgtgtatggaggcctggccagcatcacagcagaatgtggcaccttccccatcgacctgaccaagacccggctgcagatccagggccagaccaatgatgccaagttcaaggagatccgctaccggggcatgctgcacgccctggtgagaattggccgggaggagggcctgaaggccctgtacagcggcatcgccccagccatgctgcggcaggccagctatggcaccatcaagattggcacctaccagagcctgaagaggctcttcatcgagaggccagaagatgagaccctgcccatcaacgtcatctgtggcatcctgagcggggtcatcagcagcaccatcgccaaccccacagatgtgctgaagatccgcatgcaggcccagagcaacaccatccagggcggcatgattggcaacttcatgaacatctaccagcaggagggcacccggggcctgtggaagggcgtgtccctgacagcccagagagctgccatcgtggtgggcgtggagctgcctgtgtatgacatcaccaagaagcacctgatcctgagcggcctgatgggagacacagtgtacacccacttcctgagcagcttcacctgtggcctggccggggccctggccagcaaccctgtggatgtggtgaggaccaggatgatgaaccagagggtgctgagagatggccgctgcagcggctacacaggcaccctggactgcctgctgcagacctggaagaatgaaggcttctttgccctgtacaagggcttctggcccaactggctgcggctgggcccctggaacatcatcttctttgtgacctatgagcagctgaagaagctggacctgtag

SEQ ID NO: 170502 - DNA, 651 bp, Artificial Sequence
  Description of Artificial Sequence: Synthetic coding sequence
atgctgcggcaggccagctatggcaccatcaagattggcacctaccagagcctgaagaggctcttcatcgagaggccagaagatgagaccctgcccatcaacgtcatctgtggcatcctgtctggagtcatcagcagcaccatcgccaaccccacagatgtgctgaagatccgcatgcaggcccagagcaacaccatccagggcggcatgattggcaacttcatgaacatctaccagcaggagggcacccggggcctgtggaagggcgtgtccctgacagcccagagagctgccatcgtggtgggcgtggagctgcctgtgtatgacatcaccaagaagcacctgatcctgagcggcctgatgggagacacagtgtacacccacttcctgagcagcttcacctgtggcctggccggggccctggccagcaaccctgtggatgtggtgaggaccaggatgatgaaccagagggtgctgagagatggccgctgcagcggctacacaggcaccctggactgcctgctgcagacctggaagaatgaaggcttctttgccctgtacaagggcttctggcccaactggctgcggctgggcccctggaacatcatcttctttgtgacctatgagcagctgaagaagctggacctgtag

SEQ ID NO: 170503 - DNA, 723 bp, Artificial Sequence
  Description of Artificial Sequence: Synthetic coding sequence
atgctgcacgccctggtgcgcatcggccgggaggagggcctgaaggccctgtacagcggcatcgccccagccatgctgcggcaggccagctatggcaccatcaagattggcacctaccagagcctgaagaggctcttcatcgagaggccagaagatgagaccctgcccatcaacgtcatctgtggcatcctgtctggagtcatcagcagcaccatcgccaaccccacagatgtgctgaagatccgcatgcaggcccagagcaacaccatccagggcggcatgattggcaacttcatgaacatctaccagcaggagggcacccggggcctgtggaagggcgtgtccctgacagcccagagagctgccatcgtggtgggcgtggagctgcctgtgtatgacatcaccaagaagcacctgatcctgagcggcctgatgggagacacagtgtacacccacttcctgagcagcttcacctgtggcctggccggggccctggccagcaaccctgtggatgtggtgaggaccaggatgatgaaccagagggtgctgagagatggccgctgcagcggctacacaggcaccctggactgcctgctgcagacctggaagaatgaaggcttctttgccctgtacaagggcttctggcccaactggctgcggctgggcccctggaacatcatcttctttgtgacctatgagcagctgaagaagctggacctgtag

SEQ ID NO: 170504 - DNA, 948 bp, Artificial Sequence
  Description of Artificial Sequence: Synthetic coding sequence
atgacaggccagggccagagcgccagcggcagcagcgcctggagcaccgtcttccgccacgtgcgctatgagaacctgattgctggggtgtctggaggagtgctgagcaacctggccctgcaccccctggacctggtgaagatccgctttgctgtgtctgatggcctggagctgcggcccaagtacaacggcatcctgcactgcctgaccaccatctggaagctggatggcctgcggggcctgtaccagggcgtgacccccaacatctggggcgccggcctgtcctggggcctgtacttcttcttctacaatgccatcaagagctacaagacagagggccgggcagagcggctggaggccacagagtacctggtgtctgctgctgaggccggggccatgaccctgtgcatcaccaaccccctgtgggtgaccaagacccggctgatgctgcagtatgatgctgtggtgaacagcccccaccggcagtacaagggcatgtttgacaccctggtgaagatctacaagtatgagggcgtgcggggcctgtacaagggctttgtgcccggcctgtttggcaccagccatggagccctgcagttcatggcctatgagctgctgaagctgaagtacaaccagcacatcaaccggctgcctgaggcccagctgagcacagtggagtacatctctgtggccgccctgagcaagatctttgctgtggccgccacctacccctaccaggtggtgcgggcccggctgcaggaccagcacatgttctacagcggcgtgattgatgtgatcaccaagacctggaggaaggagggcgtgggcggcttctacaagggcatcgcccccaacctgatccgggtgaccccagcctgctgcatcacctttgtggtgtatgaaaatgtgagccacttcctgctggacctgcgggagaagaggaagtag

SEQ ID NO: 170505 - DNA, 900 bp, Artificial Sequence
  Description of Artificial Sequence: Synthetic coding sequence
atgacaggccagggccagagcgccagcggcagcagcgcctggagcggaggagtgctgagcaacctggccctgcaccccctggacctggtgaagatccgctttgctgtgtctgatggcctggagctgcggcccaagtacaacggcatcctgcactgcctgaccaccatctggaagctggatggcctgcggggcctgtaccagggcgtgacccccaacatctggggcgccggcctgtcctggggcctgtacttcttcttctacaatgccatcaagagctacaagacagagggccgggcagagcggctggaggccacagagtacctggtgtctgctgctgaggccggggccatgaccctgtgcatcaccaaccccctgtgggtgaccaagacccggctgatgctgcagtatgatgctgtggtgaacagcccccaccggcagtacaagggcatgtttgacaccctggtgaagatctacaagtatgagggcgtgcggggcctgtacaagggctttgtgcccggcctgtttggcaccagccatggagccctgcagttcatggcctatgagctgctgaagctgaagtacaaccagcacatcaaccggctgcctgaggcccagctgagcacagtggagtacatctctgtggccgccctgagcaagatctttgctgtggccgccacctacccctaccaggtggtgcgggcccggctgcaggaccagcacatgttctacagcggcgtgattgatgtgatcaccaagacctggaggaaggagggcgtgggcggcttctacaagggcatcgcccccaacctgatccgggtgaccccagcctgctgcatcacctttgtggtgtatgaaaatgtgagccacttcctgctggacctgcgggagaagaggaagtag

SEQ ID NO: 170506 - DNA, 552 bp, Artificial Sequence
  Description of Artificial Sequence: Synthetic coding sequence
atgaccctgtgcatcaccaaccccctgtgggtgaccaagacccggctgatgctgcagtatgatgctgtggtgaacagcccccaccggcagtacaagggcatgtttgacaccctggtgaagatctacaagtatgagggcgtgcggggcctgtacaagggctttgtgcccggcctgtttggcaccagccatggagccctgcagttcatggcctatgagctgctgaagctgaagtacaaccagcacatcaaccggctgcctgaggcccagctgagcacagtggagtacatctctgtggccgccctgagcaagatctttgctgtggccgccacctacccctaccaggtggtgcgggcccggctgcaggaccagcacatgttctacagcggcgtgattgatgtgatcaccaagacctggaggaaggagggcgtgggcggcttctacaagggcatcgcccccaacctgatccgggtgaccccagcctgctgcatcacctttgtggtgtatgaaaatgtgagccacttcctgctggacctgcgggagaagaggaagtag

SEQ ID NO: 170507 - DNA, 966 bp, Artificial Sequence
  Description of Artificial Sequence: Synthetic coding sequence
atggccactggaggccagcagaaggagaacaccctgctgcacctgtttgctgggggctgcggcggcaccgtgggcgccatcttcacctgccccctggaggtgatcaagacccggctgcagagcagccggctggccctgaggacagtgtactacccccaggtgcacctgggcaccatcagcggggccggcatggtgcggcccacctctgtgaccccaggcctcttccaggtgctgaagagcatcctggagaaggagggccccaagagcctcttccggggcctgggccccaacctggtgggcgtggcccccagcagagctgtgtactttgcctgctacagcaaggccaaggagcagttcaacggcatctttgtgcccaacagcaacatcgtgcacatcttctctgctggcagcgctgccttcatcaccaacagcctgatgaaccccatctggatggtgaagaccaggatgcagctggagcagaaggtgcggggcagcaagcagatgaacaccctgcagtgtgcccgctacgtgtaccagacagagggcatccggggcttctaccggggcctgacagccagctatgccggcatcagcgagaccatcatctgctttgccatctatgagagcctgaagaagtacctgaaggaggcccccctggccagcagcgccaacggcacagagaagaacagcaccagcttcttcggcctgatggctgctgctgccctgagcaagggctgtgccagctgcatcgcctacccccatgaggtgatccgcacccggctgcgggaggagggcaccaagtacaagagctttgtgcagacagcccggctggtgttccgggaggagggctacctggccttctaccggggcctgtttgcccagctgatccggcagatccccaacacagccatcgtgctgagcacctatgagctgattgtgtacctgctggaggacaggacccagtag

SEQ ID NO: 170508 - DNA, 915 bp, Artificial Sequence
  Description of Artificial Sequence: Synthetic coding sequence
atggagaccgtgcccccagctgtggacctggtgctgggcgccagcgcctgctgcctggcctgtgtgttcaccaaccccctggaggtggtgaagacccggctgcagctgcagggcgagctgcaggcccggggcacctacccccggccctaccacggcttcatcgcctctgtggccgctgtggcccgggcagatggcctgtggggcctgcagaagggcctggccgccggcctgctgtaccagggcctgatgaatggagtgcgcttctactgctacagcctggcctgccaggccggcctgacccagcagcccggcggcaccgtggtggccggggctgtggccggggccctgggcgcctttgtgggcagccctgcctacctgatcaagacccagctgcaggcccagacagtggccgctgtggccgtgggccaccagcacaaccaccagacagtgctgggcgccctggagaccatctggaggcagcagggcctgctgggcctgtggcagggcgtgggcggcgctgtgccccgggtgatggtgggcagcgctgcccagctggccacctttgccagcgccaaggcctgggtgcagaagcagcagtggctgcctgaagattcctggctggtggccctggccggcggcatgatcagcagcattgctgtggtggtggtgatgaccccatttgatgtggtgtccacccggctgtacaaccagcctgtggacacagctggccggggccagctgtatggaggcctgacagactgcatggtgaagatctggaggcaggagggccccctggccctgtacaagggcctgggccctgcctacctgcggctgggcccccacaccatcctgtccatgctgttctgggatgagctgaggaagctggccggccgggcccagcacaagggcacctag

SEQ ID NO: 170509 - DNA, 888 bp, Artificial Sequence
  Description of Artificial Sequence: Synthetic coding sequence
atggacttcctgatgagcggcctggccgcctgtggggcctgtgtgttcaccaaccccctggaggtggtgaagaccaggatgcagctgcagggcgagctgcaggcccctggcacctaccagaggcactacagaaatgtgttccacgccttcatcaccatcggcaaggtggatggcctggccgccctgcagaagggcctggccccagccctgctgtaccagttcctgatgaatggcatccggctgggcacctacggcctggccgaggccggcggctacctgcacacagctgagggcacccacagccctgcccggtctgctgctgctggggccatggccggcgtgatgggcgcctacctgggcagccccatctacatggtgaagacccacctgcaggcccaggccgccagcgagattgctgtgggccaccagtacaagcaccagggcatgttccaggccctgacagagatcggccagaagcacggcctggtgggcctgtggaggggggccctgggcggcctgccccgggtgattgtgggcagcagcacccagctgtgcaccttcagcagcaccaaggacctgctgagccagtgggagatcttccccccccagagctggaagctggccctggtggccgccatgatgtctggaattgctgtggtgctggccatggccccctttgatgtggcctgcacccggctgtacaaccagcccacagatgcccagggcaagaacagagtgcccaagttcagcgccaccagctgcagcgccagcgcccccctgctgggcaccaaggatgtgcgcatcgtgaagggccagacaggccaccagctgttcaaggtgacccaggcccctggctgcagccccatcctgctgggcacccagagctag

SEQ ID NO: 170510 - DNA, 876 bp, Artificial Sequence
  Description of Artificial Sequence: Synthetic coding sequence
atggacttcctgatgagcggcctggccgcctgtggggcctgtgtgttcaccaaccccctggaggtggtgaagaccaggatgcagctgcagggcgagctgcaggcccctggcacctaccagaggcactacagaaatgtgttccacgccttcatcaccatcggcaaggtggatggcctggccgccctgcagaagggcctggccccagccctgctgtaccagttcctgatgaatggcatccggctgggcacctacggcctggccgaggccggcggctacctgcacacagctgagggcacccacagccctgcccggtctgctgctgctggggccatggccggcgtgatgggcgcctacctgggcagccccatctacatggtgaagacccacctgcaggcccaggccgccagcgagattgctgtgggccaccagtacaagcaccagggcatgttccaggccctgacagagatcggccagaagcacggcctggtgggcctgtggaggggggccctgggcggcctgccccgggtgattgtgggcagcagcacccagctgtgcaccttcagcagcaccaaggacctgctgagccagtgggagatcttccccccccagagctggaagctggccctggtggccgccatgatgtctggaattgctgtggtgctggccatggccccctttgatgtggcctgcacccggctgtacaaccagcccacagatgcccagggcaagggcctgatgtaccggggcatcctggatgccctgctgcagacagccaggacagagggcatcttcggcatgtacaaggagcccagcccccaggtgctgagcaacatcatgcagtgcttcagcgccttcaccggggaccagcgctgctag

SEQ ID NO: 170511 - DNA, 915 bp, Artificial Sequence
  Description of Artificial Sequence: Synthetic coding sequence
atgatccagaacagccggcccagcctgctgcagccccaggatgtgggggacacagtggagaccctgatgctgcaccctgtgatcaaggccttcctgtgtggcagcatcagcggcacctgcagcaccctgctcttccagcccctggacctgctgaagacccggctgcagaccctgcagcccagcgaccacggcagccggcgggtgggcatgctggccgtgctgctgaaggtggtgaggacagagagcctgctgggcctgtggaagggcatgagccccagcatcgtgcgctgtgtgcctggggtgggcatctacttcggcaccctgtacagcctgaagcagtacttcctgcggggccaccccccaacagccctggagagcgtgatgctgggcgtgggcagccgctctgtggccggcgtgtgcatgagccccatcaccgtcatcaagaccaggtatgaaagtggcaagtatggctatgagagcatctatgctgccctgcggagcatctaccacagcgagggccaccggggcctcttcagcggcctgacagccaccctgctgagagatgcccccttcagcggcatctacctgatgttctacaaccagaccaagaacatcgtgccccatgaccaggtggatgccaccctcatccccatcaccaacttcagctgtggcatctttgctggcatcctggccagcctggtgacccagcctgcagatgtgatcaagacccacatgcagctgtaccccctgaagttccagtggattggccaggccgtgaccctcatcttcaaggactatggcctgcggggcttcttccagggcggcatcccccgggccctgcggaggaccctgatggccgccatggcctggacagtgtatgaggagatgatggccaagatgggcctgaagagctag

SEQ ID NO: 170512 - DNA, 1671 bp, Artificial Sequence
  Description of Artificial Sequence: Synthetic coding sequence
atgcctcctgagaggagaagaaggatgaagctggacagaagaactggagccaagcccaagaggaagccaggcatgaggccagactggaaggccggggccggccctgggggccccccccagaagccagcccccagcagccagaggaagcccccagcccggcccagcgctgctgctgctgccatcgctgtggccgctgctgaggaggagcggcggctgcggcagaggaaccggctgcggctggaggaggacaagccagctgtggagcgctgcctggaggagctggtgtttggagatgtggagaatgatgaagatgccctgctgcggcggctgcggggcccccgggtgcaggagcatgaagattctggggacagcgaggtggagaatgaggccaagggcaacttccccccccagaagaagcctgtgtgggtggatgaggaggatgaagatgaggagatggtggacatgatgaacaaccgcttcaggaaggacatgatgaagaatgccagcgagagcaagctgagcaaggacaacctgaagaagaggctgaaggaggagttccagcacgccatgggcggcgtgcctgcctgggccgagaccaccaagaggaagaccagcagtgatgatgagagcgaggaggatgaagatgacctgctgcagaggactggaaacttcatcagcaccagcaccagcctgccccggggcatcctgaagatgaagaactgccagcacgccaatgctgagcggcccaccgtggcccgcatcagctctgtgcagttccaccctggggcccagatcgtgatggtggccggcctggacaatgctgtgtccctcttccaggtggatggcaagaccaaccccaagatccagagcatctacctggagcgcttccccatcttcaaggcctgcttcagcgccaacggggaggaggtgctggccaccagcacccacagcaaggtgctgtatgtgtatgacatgctggccggcaagctgatccctgtgcaccaggtgcggggcctgaaggagaagatcgtgcgcagctttgaggtgtccccagatggcagcttcctgctgatcaatggaattgctggctacctgcacctgctggccatgaagaccaaggagctgattggctccatgaagatcaatggccgggtggccgccagcaccttcagcagtgacagcaagaaggtgtatgccagcagtggagatggagaggtgtatgtgtgggatgtgaacagcaggaagtgcctgaacagatttgtggatgagggcagcctgtatggcctgagcatcgccaccagcagaaatggccagtatgtggcctgtggcagcaactgtggggtggtgaacatctacaaccaggacagctgcctgcaggagaccaaccccaagcccatcaaggccatcatgaacctggtgactggagtgaccagcctgaccttcaaccccaccacagagatcctggccatcgccagcgagaagatgaaggaggccgtgcggctggtgcacctgcccagctgcaccgtcttcagcaacttccctgtgatcaagaacaagaacatcagccacgtgcacaccatggacttcagccccaggagcggctactttgccctgggcaatgagaagggcaaggccctgatgtaccgcctgcaccactacagcgacttctag

SEQ ID NO: 170513 - DNA, 1080 bp, Artificial Sequence
  Description of Artificial Sequence: Synthetic coding sequence
atggctgaccaggaccctgctggcatcagccccctgcagcagatggtggccagcggcaccggggctgtggtgaccagcctcttcatgacccccctggatgtggtgaaggtgcggctgcagagccagaggcccagcatggccagcgagctgatgcccagcagccggctgtggagcctgagctacaccaagctgcccagcagcctgcagagcacaggcaagtgcctgctgtactgcaatggagtgctggagcccctgtacctgtgccccaacggggcccgctgtgccacctggttccaggaccccacccgcttcaccggcaccatggatgcctttgtgaagatcgtgagacatgagggcaccaggaccctgtggagcggcctgcctgccaccctggtgatgacagtgcctgccacagccatctacttcaccgcctatgaccagctgaaggccttcctgtgtggccgggccctgaccagtgacctgtatgcccccatggtggccggggccctggcccggctgggcaccgtgaccgtcatcagccccctggagctgatgaggaccaagctgcaggcccagcacgtgtcctaccgggagctgggcgcctgtgtgaggacagctgtggcccagggcggctggaggagcctgtggctgggctggggccccacagccctgagagatgtgcccttcagcgccctgtactggttcaactatgagctggtgaagtcctggctgaatggcttccggcccaaggaccagacctctgtgggcatgagctttgtggccggcggcatctctggaacagtggccgctgtgctgaccctgccctttgatgtggtgaagacccagaggcaggtggccctgggcgccatggaggccgtgcgggtgaaccccctgcacgtggacagcacctggctgctgctgcggcgcatccgggcagagagcggcaccaagggcctgtttgctggcttcctgccccgcatcatcaaggccgcccccagctgtgccatcatgatcagcacctatgaatttgggaagagcttcttccagaggctgaaccaggaccggctgctgggcggctag

SEQ ID NO: 170514 - DNA, 1011 bp, Artificial Sequence
  Description of Artificial Sequence: Synthetic coding sequence
atggctgaccaggaccctgctggcatcagccccctgcagcagatggtggccagcggcaccggggctgtggtgaccagcctcttcatgacccccctggatgtggtgaaggtgcggctgcagagccagaggcccagcatggccagcggcaagtgcctgctgtactgcaatggagtgctggagcccctgtacctgtgccccaatggagcccgctgtgccacctggttccaggaccccacccgcttcaccggcaccatggatgcctttgtgaagatcgtgagacatgagggcaccaggaccctgtggagcggcctgcctgccaccctggtgatgacagtgcctgccacagccatctacttcaccgcctatgaccagctgaaggccttcctgtgtggccgggccctgaccagtgacctgtatgcccccatggtggccggggccctggcccggctgggcaccgtgaccgtcatcagccccctggagctgatgaggaccaagctgcaggcccagcacgtgtcctaccgggagctgggcgcctgtgtgaggacagctgtggcccagggcggctggaggagcctgtggctgggctggggccccacagccctgagagatgtgcccttcagcgccctgtactggttcaactatgagctggtgaagtcctggctgaatggcttccggcccaaggaccagacctctgtgggcatgagctttgtggccggcggcatcagcggcaccgtggccgctgtgctgaccctgccctttgatgtggtgaagacccagaggcaggtggccctgggcgccatggaggccgtgcgggtgaaccccctgcacgtggacagcacctggctgctgctgcggcgcatccgggcagagagcggcaccaagggcctgtttgctggcttcctgccccgcatcatcaaggccgcccccagctgtgccatcatgatcagcacctatgaatttgggaagagcttcttccagaggctgaaccaggaccggctgctgggcggctag

SEQ ID NO: 170515 - DNA, 1017 bp, Artificial Sequence
  Description of Artificial Sequence: Synthetic coding sequence
atggaccctgagacccggggccaggagatcatcaaggtgacccccctgcagcagatgctggccagctgcaccggggccatcctgaccagcgtcatcgtgacccccctggatgtggtgaagatccggctgcaggcccagaacaaccccctgcccaagggcaagtgctttgtgtacagcaatggcctgatggaccacctgtgtgtgtgtgaggagggcggcaacaagctgtggtacaagaagccaggcaacttccagggcaccctggatgccttcttcaagatcatcagaaatgaaggcatcaagagcctgtggagcggcctgccccccaccctggtgatggctgtgcctgccaccgtcatctacttcacctgctatgaccagctgagcgccctgctgcggagcaagctgggggagaatgagacctgcatccccatcgtggccggcatcgtggccaggtttggagctgtgaccgtcatcagccccctggagctgatccgcaccaagatgcagagcaagaagttctcctatgtggagctgcacagatttgtgtccaagaaggtgtctgaagatggctggatcagcctgtggaggggctgggcccccaccgtgctgagagatgtgcccttcagcgccatgtactggtacaactatgagatcctgaagaagtggctgtgtgagaagagcggcctgtatgagcccaccttcatgatcaacttcaccagcggggccctgagcggcagctttgctgctgtggccaccctgccctttgatgtggtgaagacccagaagcagacccagctgtggacctatgagagccacaagatctccatgcccctgcacatgagcacctggatcatcatgaagaacatcgtggccaagaatggcttcagcggcctcttcagcggcctcatccccaggctcatcaagatcgccccagcctgtgccatcatgatcagcacctatgaatttgggaaggccttcttccagaagcagaatgtgcggcggcagcagtactag

SEQ ID NO: 170516 - DNA, 1113 bp, Artificial Sequence
  Description of Artificial Sequence: Synthetic coding sequence
atgggcgcccagcctggagagccccagaacacctgcagccgcatccagaccctcttccggcgggtgaagaccctgctgatcaaggcccctcctccaccccagcccccacctcctcctccttcctggaaccctggctgcacccacgtgtatggctacgccttcggccacatgcatgacaacaacctggagcacctgcccagccagcaggtgctggacacaggagagcagctgatggtgcctgtggaggtgctggaggtggacaacaaggaggccctgtggaagttcctgctgagcggggccatggccggggctgtgtccaggactggaacagcccccctggaccgggccaaggtgtacatgcaggtgtacagcagcaagaccaacttcaccaacctgctgggcggcctgcagagcatggtgcaggagggcggcttccgcagcctgtggagaggaaatggcatcaacgtgctgaagatcgccccagaatatgccatcaagttctctgtgtttgagcagtgcaagaactacttctgtggcatccagggcagcccccccttccaggagcggctgctggccggcagcctggccgtggccatcagccagaccctcatcaaccccatggaggtgctgaagacccggctgaccctgcggaggacaggccagtacaagggcctgctggactgtgcccggcagatcctgcagcgggagggcacccgggccctgtaccggggctacctgcccaacatgctgggcatcatcccctatgcctgcacagacctggccgtgtatgagatgctgcagtgcttctgggtgaagagcggccgggacatgggagaccccagcggcctggtgtccctgagctctgtgaccctgagcaccacctgtggccagatggccagctaccccctgaccctggtgaggaccaggatgcaggcccaggacacagtggagggcagcaaccccaccatgagaggagtgctgcagaggatcctggcccagcagggctggctgggcctgtaccggggcatgacccccaccctgctgaaggtgctgcctgctgggggcatctcctatgtggtgtatgaggccatgaagaagaccctgggcatctag

SEQ ID NO: 170517 - DNA, 729 bp, Artificial Sequence
  Description of Artificial Sequence: Synthetic coding sequence
atgggcgcccagcctggagagccccagaacacctgcagccgcatccagaccctcttccggcgggtgaagaccctgctgatcaaggcccctcctccaccccagcccccacctcctcctccttcctggaaccctggctgcacccacgtgtatggctacgccttcggccacatgcatgacaacaacctggagcacctgcccagccagcaggtgctggacacaggagagcagctgatggtgcctgtggaggtgctggaggtggacaacaaggaggccctgtggaagttcctgctgagcggggccatggccggggctgtgtccaggactggaacagcccccctggaccgggccaaggtgtacatgcagctgctgggccgcctgcggcaggagaaccggctgaacctgggcggcggcggctgcagcgagcccaggagcccagacaggaccccagcctgggccacagagagcaccccacccaggaggaccagccccacctgctggggcggctaccgggcctggagccggcgggccgccagcgccccctgtggcggggccacagccagcacctgcagccggctgctgctgtccatgcccagcagcagcccctacagcagcagcgcccgcatcacctctgtggagtacaagggcccccggcccagccgctctgtgtccctgctggccccctggctgtggcccagcccccggcccagcagcaccccctggcgctgctag

SEQ ID NO: 170518 - DNA, 957 bp, Artificial Sequence
  Description of Artificial Sequence: Synthetic coding sequence
atgggaaatggagtgaaggagggccctgtgcggctgcatgaagatgctgaggccgtgctgagcagctctgtgagcagcaagagggaccaccggcaggtgctgagcagcctgctgagcggggccctggccggggccctggccaagacagctgtggcccccctggacaggaccaagatcatcttccaggtgagcagcaagcgcttcagcgccaaggaggccttccgggtgctgtactacacctacctgaatgaaggcttcctgagcctgtggaggggcaacagcgccaccatggtgcgggtggtgccctatgctgccatccagttcagcgcccacgaggagtacaagaggatcctgggcagctactacggcttccggggggaggccctgcccccctggccccggctgtttgctggggccctggccggcaccacagctgccagcctgacctaccccctggacctggtgcgggccaggatggctgtgacccccaaggagatgtacagcaacatcttccacgtgttcatccgcatcagccgggaggagggcctgaagaccctgtaccacggcttcatgcccaccgtgctgggcgtcatcccctatgccggcctgtccttcttcacctatgagaccctgaagagcctgcaccgggagtacagcggccggcggcagccctacccctttgagaggatgatctttggagcctgtgccggcctgattggccagagcgccagctaccccctggatgtggtgagaagaaggatgcagacagctggggtgacaggctacccccgggccagcatcgcccggaccctgcggaccatcgtgcgggaggagggcgctgtgcggggcctgtacaagggcctgtccatgaactgggtgaagggccccatcgctgtgggcatctccttcaccacctttgacctgatgcagatcctgctgcggcacctgcagagctag

SEQ ID NO: 170519 - DNA, 1011 bp, Artificial Sequence
  Description of Artificial Sequence: Synthetic coding sequence
atgtctgtgctcttcttctacatcatgagatacaagcagagcgaccctgaaaatccagacaatgacagatttgtgctggccaagatcgccaccaggaaggcctgtggcctggccctggccaagctgggctacgccaacaacagagtggtggtgctggatggagacacccgctacagcaccttcagcgagatcttcaacaaggagtacccagagcgcttcatcgagtgcttcatggccgagcagaacatggtgtctgtggccctgggctgtgccagccggggccgcaccatcgcctttgccagcacctttgctgccttcctgacccgggcctttgaccacatccgcatcggcggcctggccgagagcaacatcaacatcatcggcagccactgcggcgtgtctgtgggagatgatggagccagccagatggccctggaggacatcgccatgttccgcaccatccccaagtgcaccatcttctaccccacagatgctgtgtccacagagcacgctgtggccctggccgccaatgccaagggcatgtgcttcatccgcaccaccaggcctgagaccatggtgatctacaccccccaggagagatttgaaattggccaggccaaggtgctgcggcactgtgtgtctgacaaggtgaccgtcatcggggccggcatcaccgtgtatgaggccctggccgctgctgatgagctgagcaagcaggacatcttcatccgggtcatcgacctcttcaccatcaagcccctggatgtggccaccatcgtgagcagcgccaaggccacagagggccgcatcatcaccgtggaggaccactacccccagggcggcatcggggaggccgtgtgtgccgctgtgtccatggaccctgacatccaggtgcacagcctggccgtgtctggagtgccccagagcggcaagtctgaggagctgctggacatgtatggcatcagcgcccggcacatcatcgtggccgtgaagtgcatgctgctgaactag

SEQ ID NO: 170520 - DNA, 870 bp, Artificial Sequence
  Description of Artificial Sequence: Synthetic coding sequence
atggccacctggaggagagatggccgcctgactggaggccagaggctgctgtgtgccggcctggccggcaccctgagcctgagcctgacagcccccctggagctggccgcctacaggaagtttgtggtgctcttcacagatgacctgggccacatcagccagtggagcagcatcatggccggcagcctggccggcatggtgtccaccatcgtgacctaccccacagacctgatcaagaccaggctcatcatgcagaacatcctggagcccagctaccggggcctgctgcacgccttcagcaccatctaccagcaggagggcttcctggccctgtaccggggcgtgtccctgactgtggtgggcgccctgcccttctctgctggcagcctgctggtgtacatgaacctggagaagatctggaatggcccccgggaccagttcagcctgccccagaactttgccaacgtgtgcctggccgctgctgtgacccagaccctgtccttcccctttgagaccgtgaagaggaagatgcaggcccagagcccctacctgccccacagcggaggagtggatgtgcacttctctggagctgtggactgcttccggcagatcgtgaaggcccagggcgtgctgggcctgtggaatggcctgacagccaacctgctgaagatcgtgccctacttcggcatcatgttcagcacctttgagttctgcaagaggatctgcctgtaccagaatggctacatcctgagccccctgagctacaagctgaccccaggagtggaccagagcctgcagccccaggagctgcgggagctgaagaagttcttcaagaccaggaagcccaagcccaagaagcccaccctgtag

SEQ ID NO: 170521 - DNA, 681 bp, Artificial Sequence
  Description of Artificial Sequence: Synthetic coding sequence
atggccacctggaggagagatggccgcctgactggaggccagaggctgctgtgtgccggcctggccggcaccctgagcctgagcctgacagcccccctggagctggccaccgtgctggcccaggtgggcgtggtgcggggccacgcccggggcccctgggccaccggccaccgggtgtggagggctgagggcctgcgggccctgtggaagggaaatgctgtggcctgcctgcggctcttcccctgcagcgctgtgcagctggccgcctacaggaagtttgtggtgctcttcacagatgacctgggccacatcagccagtggagcagcatcatggccggcagcctggccggcatggtgtccaccatcgtgacctaccccacagacctgatcaagaccaggctcatcatgcagaacatcctggagcccagctaccggggcctgctgcacgccttcagcaccatctaccagcaggagggcttcctggccctgtaccggggcgtgtccctgactgtggtgggcagcgagcccctgccccccacccagtggaggagccgctgccccttcctgcggagcagcggcctgctgcctgctgacagcgagggccctgggggccctggggccctggagtggattgacagccagttcacagaggacagcagcatcttctggaactacgtgtag

SEQ ID NO: 170522 - DNA, 945 bp, Artificial Sequence
  Description of Artificial Sequence: Synthetic coding sequence
atggaggacaagaggaacatccagatcatcgagtgggagcacctggacaagaagaagttctacgtgtttggagtggccatgaccatgatgatccgggtgtctgtgtaccccttcaccctcatccgcacccggctgcaggtgcagaagggcaagagcctgtaccacggcacctttgatgccttcatcaagatcctgcgggcagatggcatcaccggcctgtaccggggcttcctggtgaacaccttcaccctcatcagcggccagtgctacgtgaccacctatgagctgaccaggaagtttgtggccgactacagccagagcaacacagtgaagagcctggtggccggcggcagcgccagcctggtggcccagagcatcaccgtgcccattgatgtggtgtcccagcacctgatgatgcagaggaagggggagaagatgggccgcttccaggtgcggggcaaccctgagggccagggcgtggtggccttcggccagaccaaggacatcatccggcagatcctgcaggctgatggcctgcggggcttctaccggggctacgtggccagcctgctgacctacatccccaacagcgctgtgtggtggcccttctaccacttctacgccgagcagctgagctacctgtgccccaaggagtgcccccacatcgtgttccaggccgtgtctggccccctggccgccgccacagccagcatcctgaccaaccccatggatgtgatccgcaccagggtgcaggtggagggcaagaacagcatcatcctgaccttccggcagctgatggccgaggagggcccctggggcctgatgaagggcctgagcgcccgcatcatcagcgccacccccagcaccatcgtcatcgtggtgggctatgagagcctgaagaagctgagcctgcggcctgagctggtggacagccgccactggtag

SEQ ID NO: 170523 - DNA, 489 bp, Artificial Sequence
  Description of Artificial Sequence: Synthetic coding sequence
atggaggacaagaggaacatccagatcatcgagtgggagcacctggacaagaagaagttctacgtgtttggagtggccatgaccatgatgatccgggtgtctgtgtaccccttcaccctcatccgcacccggctgcaggtgcagaagggcaagagcctgtaccacggcacctttgatgccttcatcaagatcctgcgggcagatggcatcaccggcctgtaccggggcttcctggtgaacaccttcaccctcatcagcggccagtgctacgtgaccacctatgagctgaccaggaagtttgtggccgactacagccagagcaacacagtgaagagcctgatggccgaggagggcccctggggcctgatgaagggcctgagcgcccgcatcatcagcgccacccccagcaccatcgtcatcgtggtgggctatgagagcctgaagaagctgagcctgcggcctgagctggtggacagccgccactggtag

SEQ ID NO: 170524 - DNA, 876 bp, Artificial Sequence
  Description of Artificial Sequence: Synthetic coding sequence
atggaggacaagaggaacatccagatcatcgagtgggagcacctggacaagaagaagttctacgtgtttggagtggccatgaccatgatgatccgggtgtctgtgtaccccttcaccctcatccgcacccggctgcaggtgcagaagggcaagagcctgtaccacggcacctttgatgccttcatcaagatcctgcgggcagatggcatcaccggcctgtaccggggcttcctggtgaacaccttcaccctcatcagcggccagtgctacgtgaccacctatgagctgaccaggaagtttgtggccgactacagccagagcaacacagtgaagagcctggtggccggcggcagcgccagcctggtggcccagagcatcaccgtgcggggcaaccctgagggccagggcgtggtggccttcggccagaccaaggacatcatccggcagatcctgcaggctgatggcctgcggggcttctaccggggctacgtggccagcctgctgacctacatccccaacagcgctgtgtggtggcccttctaccacttctatgcagagcagctgagctacctgtgccccaaggaatgtccccacatcgtgttccaggccgtgtctggccccctggccgccgccacagccagcatcctgaccaaccccatggatgtgatccgcaccagggtgcaggtggagggcaagaacagcatcatcctgaccttccggcagctgatggccgaggagggcccctggggcctgatgaagggcctgagcgcccgcatcatcagcgccacccccagcaccatcgtgattgtggtgggctatgagagcctgaagaagctgagcctgcggcctgagctggtggacagccgccactggtag

SEQ ID NO: 170525 - DNA, 741 bp, Artificial Sequence
  Description of Artificial Sequence: Synthetic coding sequence
atggtgaagatctacagacatgagagcctgctgggcttcttcaagggcatgtccttccccatcgccagcattgctgtggtgaacagcgtgctgtttggagtgtacagcaacaccctgctggtgctgacagccaccagccaccaggagcggcgggcccagccccccagctacatgcacatcttcctggccggctgcaccggcggcttcctgcaggcctactgcctggccccctttgacctgatcaaggtgcggctgcagaaccagacagagccccgggcccagcccggcagccccccaccccgctaccagggccctgtgcactgtgccgccagcatcttccgggaggagggcccccggggcctcttccggggggcctgggccctgaccctgcgggacacccccaccgtgggcatctacttcatcacctatgagggcctgtgccggcagtacaccccagagggccagaaccccagcagcgccaccgtgctggtggccggcggctttgctggcatcgcctcctgggtggccgccacccccctggacatgatcaagagcaggatgcagatggatggcctgcggcggcgggtgtaccagggcatgctggactgcatggtgagcagcatccggcaggagggcctgggcgtcttcttccggggcgtgaccatcaacagcgcccgggccttccctgtgaatgctgtgaccttcctgtcctatgagtacctgctgcgctggtggggctag

SEQ ID NO: 170526 - DNA, 795 bp, Artificial Sequence
  Description of Artificial Sequence: Synthetic coding sequence
atgcctgtggaggagtttgtggccggctggatcagcggggccctgggcctggtgctgggccacccctttgacacagtgaagctgctgggcttcttcaagggcatgtccttccccatcgccagcattgctgtggtgaacagcgtgctgtttggagtgtacagcaacaccctgctggtgctgacagccaccagccaccaggagcggcgggcccagccccccagctacatgcacatcttcctggccggctgcaccggcggcttcctgcaggcctactgcctggccccctttgacctgatcaaggtgcggctgcagaaccagacagagccccgggcccagcccggcagccccccaccccgctaccagggccctgtgcactgtgccgccagcatcttccgggaggagggcccccggggcctcttccggggggcctgggccctgaccctgcgggacacccccaccgtgggcatctacttcatcacctatgagggcctgtgccggcagtacaccccagagggccagaaccccagcagcgccaccgtgctggtggccggcggctttgctggcatcgcctcctgggtggccgccacccccctggacatgatcaagagcaggatgcagatggatggcctgcggcggcgggtgtaccagggcatgctggactgcatggtgagcagcatccggcaggagggcctgggcgtcttcttccggggcgtgaccatcaacagcgcccgggccttccctgtgaatgctgtgaccttcctgtcctatgagtacctgctgcgctggtggggctag

SEQ ID NO: 170527 - DNA, 555 bp, Artificial Sequence
  Description of Artificial Sequence: Synthetic coding sequence
atggtgaagatctacagacatgaaagtgcctactgcctggccccctttgacctgatcaaggtgcggctgcagaaccagacagagccccgggcccagcccggcagccccccaccccgctaccagggccctgtgcactgtgccgccagcatcttccgggaggagggcccccggggcctcttccggggggcctgggccctgaccctgcgggacacccccaccgtgggcatctacttcatcacctatgagggcctgtgccggcagtacaccccagagggccagaaccccagcagcgccaccgtgctggtggccggcggctttgctggcatcgcctcctgggtggccgccacccccctggacatgatcaagagcaggatgcagatggatggcctgcggcggcgggtgtaccagggcatgctggactgcatggtgagcagcatccggcaggagggcctgggcgtcttcttccggggcgtgaccatcaacagcgcccgggccttccctgtgaatgctgtgaccttcctgtcctatgagtacctgctgcgctggtggggctag

SEQ ID NO: 170528 - DNA, 867 bp, Artificial Sequence
  Description of Artificial Sequence: Synthetic coding sequence
atgcctgtggaggagtttgtggccggctggatcagcggggccctgggcctggtgctgggccacccctttgacacagtgaaggtgcggctgcagacccagaccacctaccggggcatcgtggactgcatggtgaagatctacagacatgagagcctgctgggcttcttcaagggcatgtccttccccatcgccagcattgctgtggtgaacagcgtgctgtttggagtgtacagcaacaccctgctggtgctgacagccaccagccaccaggagcggcgggcccagccccccagctacatgcacatcttcctggccggctgcaccggcggcttcctgcaggcctactgcctggccccctttgacctgatcaaggtgcggctgcagaaccagacagagccccgggcccagcccggcagccccccaccccgctaccagggccctgtgcactgtgccgccagcatcttccgggaggagggcccccggggcctcttccggggggcctgggccctgaccctgcgggacacccccaccgtgggcatctacttcatcacctatgagggcctgtgccggcagtacaccccagagggccagaaccccagcagcgccaccgtgctggtggccggcggctttgctggcatcgcctcctgggtggccgccacccccctggacatgatcaagagcaggatgcagatggatggcctgcggcggcgggtgtaccagggcatgctggactgcatggtgagcagcatccggcaggagggcctgggcgtcttcttccggggcgtgaccatcaacagcgcccgggccttccctgtgaatgctgtgaccttcctgtcctatgagtacctgctgcgctggtggggctag

SEQ ID NO: 170529 - DNA, 741 bp, Artificial Sequence; identical to SEQ ID NO: 170525
  Description of Artificial Sequence: Synthetic coding sequence

SEQ ID NO: 170530 - DNA, 867 bp, Artificial Sequence; identical to SEQ ID NO: 170528
  Description of Artificial Sequence: Synthetic coding sequence

SEQ ID NO: 170531 - DNA, 357 bp, Artificial Sequence
  Description of Artificial Sequence: Synthetic coding sequence
atgcctgtggaggagtttgtggccggctggatcagcggggccctgggcctggtgctgggccacccctttgacacagtgaaggtgcggctgcagacccagaccacctaccggggcatcgtggactgcatggtgaagatctacagacatgagagcctgctgggcttcttcaagggcatgtccttccccatcgccagcattgctgtggtgaacagcgtgctgtttggagtgtacagcaacaccctgctggtgctgacagccaccagccaccaggagcggcgggcccagccccccagctacatgcacatcttcctggccggctgcaccggcggcttcctgcaggcctactgcctggcctag

SEQ ID NO: 170532 - DNA, 1257 bp, Artificial Sequence
  Description of Artificial Sequence: Synthetic coding sequence
atgcacccccggcggccagatggctttgatggcctgggctaccggggcggggccagagatgagcagggctttggaggagccttccctgcccggagcttcagcactggaagtgacctgggccactgggtgaccaccccaccagacatccctggcagcaggaacctgcactggggcgagaagagccccccctacggcgtgcccaccaccagcaccccctatgagggccccacagaggagcccttcagcagcggcggcggcggctctgtgcagggccagagcagcgagcagctgaacagatttgctggctttggaattggcctggccagcctcttcacagaaaatgtgctggcccacccctgcatcgtgctgcggcggcagtgccaggtgaactaccacgcccagcactaccacctgacccccttcaccgtcatcaacatcatgtacagcttcaacaagacccagggcccccgggccctgtggaagggcatgggcagcaccttcatcgtgcagggcgtgaccctgggcgctgagggcatcatcagcgagttcacccccctgccccgggaggtgctgcacaagtggagccccaagcagattggagagcacctgctgctgaagagcctgacctacgtggtggccatgcccttctacagcgccagcctcatcgagaccgtgcagagcgagatcatccgggacaacacaggcatcctggagtgtgtgaaggagggcatcggccgggtcatcggcatgggcgtgccccacagcaagaggctgctgcccctgctgagcctcatcttccccaccgtgctgcatggagtgctgcactacatcatcagcagcgtcatccagaagtttgtgctgctgatcctgaagaggaagacctacaacagccacctggccgagagcaccagccctgtgcagagcatgctggatgcctacttccctgagctgattgccaactttgctgccagcctgtgcagtgatgtgatcctgtaccccctggagaccgtgctgcaccggctgcacatccagggcaccaggaccatcatcgacaacacagacctgggctatgaggtgctgcccatcaacacccagtatgagggcatgagggactgcatcaacaccatccggcaggaggagggcgtgtttggcttctacaagggctttggagctgtgatcatccagtacaccctgcacgccgctgtgctgcagatcaccaagatcatctacagcaccctgctgcagaacaacatctag

SEQ ID NO: 170533 - DNA, 1014 bp, Artificial Sequence
  Description of Artificial Sequence: Synthetic coding sequence
atgcacccccggcggccagatggctttgatggcctgggctaccggggcggggccagagatgagcagggctttggaggagccttccctgcccggagcttcagcactggaagtgacctgggccactgggtgaccaccccaccagacatccctggcagcaggaacctgcactggggcgagaagagccccccctacggcgtgcccaccaccagcaccccctatgagggccccacagaggagcccttcagcagcggcggcggcggctctgtgcagggccagagcagcgagcagctgaacagatttgctggctttggaattggcctggccagcctcttcacagaaaatgtgctggcccacccctgcatcgtgctgcggcggcagtgccaggtgaactaccacgcccagcactaccacctgacccccttcaccgtcatcaacatcatgtacagcttcaacaagacccagggcccccgggccctgtggaagggcatgggcagcaccttcatcgtgcagggcgtgaccctgggcgctgagggcatcatcagcgagttcacccccctgccccgggaggtgctgcacaagtggagccccaagcagattggagagcacctgctgctgaagagcctgacctacgtggtggccatgcccttctacagcgccagcctcatcgagaccgtgcagagcatgctggatgcctacttccctgagctgattgccaactttgctgccagcctgtgcagtgatgtgatcctgtaccccctggagaccgtgctgcaccggctgcacatccagggcaccaggaccatcatcgacaacacagacctgggctatgaggtgctgcccatcaacacccagtatgagggcatgagggactgcatcaacaccatccggcaggaggagggcgtgtttggcttctacaagggctttggagctgtgatcatccagtacaccctgcatgctgctgtgctgcagatcaccaagatcatctacagcaccctgctgcagaacaacatctag

SEQ ID NO: 170534 - DNA, 819 bp, Artificial Sequence
  Description of Artificial Sequence: Synthetic coding sequence
atgtacagcttcaacaagacccagggcccccgggccctgtggaagggcatgggcagcaccttcatcgtgcagggcgtgaccctgggcgctgagggcatcatcagcgagttcacccccctgccccgggaggtgctgcacaagtggagccccaagcagattggagagcacctgctgctgaagagcctgacctacgtggtggccatgcccttctacagcgccagcctcatcgagaccgtgcagagcgagatcatccgggacaacacaggcatcctggagtgtgtgaaggagggcatcggccgggtcatcggcatgggcgtgccccacagcaagaggctgctgcccctgctgagcctcatcttccccaccgtgctgcatggagtgctgcactacatcatcagcagcgtcatccagaagtttgtgctgctgatcctgaagaggaagacctacaacagccacctggccgagagcaccagccctgtgcagagcatgctggatgcctacttccctgagctgattgccaactttgctgccagcctgtgcagtgatgtgatcctgtaccccctggagaccgtgctgcaccggctgcacatccagggcaccaggaccatcatcgacaacacagacctgggctatgaggtgctgcccatcaacacccagtatgagggcatgagggactgcatcaacaccatccggcaggaggagggcgtgtttggcttctacaagggctttggagctgtgatcatccagtacaccctgcacgccgctgtgctgcagatcaccaagatcatctacagcaccctgctgcagaacaacatctag

SEQ ID NO: 170535 - DNA, 618 bp, Artificial Sequence
  Description of Artificial Sequence: Synthetic coding sequence
atgcccttctacagcgccagcctgattgaaacagtgcagagcgagatcatccgggacaacacaggcatcctggagtgtgtgaaggagggcatcggccgggtgattggcatgggcgtgccccacagcaagaggctgctgcccctgctgagcctcatcttccccaccgtgctgcacggcgtgctgcactacatcatcagcagcgtcatccagaagtttgtgctgctgatcctgaagaggaagacctacaacagccacctggccgagagcaccagccctgtgcagagcatgctggatgcctacttccctgagctgattgccaactttgctgccagcctgtgcagtgatgtgatcctgtaccccctggagaccgtgctgcaccggctgcacatccagggcaccaggaccatcatcgacaacacagacctgggctatgaggtgctgcccatcaacacccagtatgagggcatgagggactgcatcaacaccatccggcaggaggagggcgtgtttggcttctacaagggctttggagctgtgatcatccagtacaccctgcatgctgctgtgctgcagatcaccaagatcatctacagcaccctgctgcagaacaacatctag

SEQ ID NO: 170536 - DNA, 984 bp, Artificial Sequence
  Description of Artificial Sequence: Synthetic coding sequence
atgaagacagagcagctgaacagatttgctggcttcggcatcggcctggccagcctcttcacagaaaatgtgctggcccacccctgcatcgtgctgcggcggcagtgccaggtgaactaccacgcccagcactaccacctgacccccttcaccgtcatcaacatcatgtacagcttcaacaagacccagggcccccgggccctgtggaagggcatgggcagcaccttcatcgtgcagggcgtgaccctgggcgctgagggcatcatcagcgagttcacccccctgccccgggaggtgctgcacaagtggagccccaagcagatcggggagcacctgctgctgaagagcctgacctacgtggtggccatgcccttctacagcgccagcctgattgaaacagtgcagagcgagatcatccgggacaacacaggcatcctggagtgtgtgaaggagggcatcggccgggtgattggcatgggcgtgccccacagcaagaggctgctgcccctgctgagcctcatcttccccaccgtgctgcacggcgtgctgcactacatcatcagcagcgtcatccagaagtttgtgctgctgatcctgaagaggaagacctacaacagccacctggccgagagcaccagccctgtgcagagcatgctggatgcctacttccctgagctgattgccaactttgctgccagcctgtgcagtgatgtgatcctgtaccccctggagaccgtgctgcaccggctgcacatccagggcaccaggaccatcatcgacaacacagacctgggctatgaggtgctgcccatcaacacccagtatgagggcatgagggactgcatcaacaccatccggcaggaggagggcgtgtttggcttctacaagggctttggagctgtgatcatccagtacaccctgcatgctgctgtgctgcagatcaccaagatcatctacagcaccctgctgcagaacaacatctag

SEQ ID NO: 170537 - DNA, 771 bp, Artificial Sequence
  Description of Artificial Sequence: Synthetic coding sequence
atgggcagcaccttcatcgtgcagggcgtgaccctgggcgctgagggcatcatcagcgagttcacccccctgccccgggaggtgctgcacaagtggagccccaagcagattggagagcacctgctgctgaagagcctgacctacgtggtggccatgcccttctacagcgccagcctcatcgagaccgtgcagagcgagatcatccgggacaacacaggcatcctggagtgtgtgaaggagggcatcggccgggtcatcggcatgggcgtgccccacagcaagaggctgctgcccctgctgagcctcatcttccccaccgtgctgcatggagtgctgcactacatcatcagcagcgtcatccagaagtttgtgctgctgatcctgaagaggaagacctacaacagccacctggccgagagcaccagccctgtgcagagcatgctggatgcctacttccctgagctgattgccaactttgctgccagcctgtgcagtgatgtgatcctgtaccccctggagaccgtgctgcaccggctgcacatccagggcaccaggaccatcatcgacaacacagacctgggctatgaggtgctgcccatcaacacccagtatgagggcatgagggactgcatcaacaccatccggcaggaggagggcgtgtttggcttctacaagggctttggagctgtgatcatccagtacaccctgcacgccgctgtgctgcagatcaccaagatcatctacagcaccctgctgcagaacaacatctag

SEQ ID NO: 170538 - DNA, 819 bp, Artificial Sequence; identical to SEQ ID NO: 170534
  Description of Artificial Sequence: Synthetic coding sequence

SEQ ID NO: 170539 - DNA, 2220 bp, Artificial Sequence
  Description of Artificial Sequence: Synthetic coding sequence
atgagcagcgagagcaaggagcagcacaacgtgagcccccgggacagcgctgagggcaatgacagctaccccagcggcatccacctggagctgcagcgggagagcagcacagacttcaagcagtttgagaccaatgaccagtgccggccctaccaccgcatcctgattgaaaggcaggagaagagtgacaccaacttcaaggagtttgtgatcaagaagctgcagaagaactgccagtgcagccctgccaaggccaagaacatgatcctgggcttcctgcctgtgctgcagtggctgcccaagtatgacctgaagaagaacatcctgggagatgtgatgagcggcctgattgtgggcatcctgctggtgccccagagcatcgcctacagcctgctggccggccaggagcctgtgtatggcctgtacaccagcttctttgccagcatcatctacttcctgctgggcaccagccgccacatctctgtgggcatctttggagtgctgtgcctgatgattggagaaacagtggaccgggagctgcagaaggccggctatgacaatgcccacagcgcccccagcctgggcatggtgtccaatggcagcaccctgctgaaccacaccagtgaccgcatctgtgacaagagctgctacgccatcatggtgggcagcacagtgaccttcatcgccggcgtgtaccaggtggccatgggcttcttccaggtgggctttgtgtctgtgtacctgagtgatgccctgctgagcggctttgtgactggagccagcttcaccatcctgaccagccaggccaagtacctgctgggcctgaacctgcccaggaccaatggagtgggcagcctcatcaccacctggatccacgtgttcaggaacatccacaagaccaacctgtgtgacctgatcaccagcctgctgtgcctgctggtgctgctgcccaccaaggagctgaatgagcacttcaagagcaagctgaaggcccccatccccatcgagctggtggtggtggtggccgccaccctggccagccactttgggaagctgcacgagaactacaacagcagcattgctggccacatccccaccggcttcatgccacccaaggtgcctgagtggaacctgatccccagcgtggccgtggatgccatcgccatcagcatcatcggctttgccatcaccgtgtccctgtctgagatgtttgccaagaagcacggctacacagtgaaggccaaccaggagatgtatgccatcggcttctgcaacatcatccccagcttcttccactgcttcaccaccagcgctgccctggccaagaccctggtgaaggagagcacaggctgccacacccagctgagcggcgtggtgacagccctggtgctgctgctggtgctgctggtgattgcccccctcttctacagcctgcagaagtctgtgctgggcgtcatcaccatcgtgaacctgcggggggccctgaggaagttccgggacctgcccaagatgtggagcatcagcaggatggacaccgtcatctggtttgtgaccatgctgagcagcgccctgctgagcacagaaattggcctgctggtgggcgtgtgcttcagcatcttctgtgtgatcctgcggacccagaagcccaagagcagcctgctgggcctggtggaggagagcgaggtgtttgaatctgtgtctgcctacaagaacctgcagatcaagccaggcatcaagatcttccgctttgtggcccccctgtactacatcaacaaggagtgcttcaagagcgccctgtacaagcagacagtgaaccccatcctgatcaaggtggcctggaagaaggccgccaagaggaagatcaaggagaaggtggtgaccctgggcggcatccaggatgagatgtctgtgcagctgagccatgaccccctggagctgcacaccatcgtgattgactgcagcgccatccagttcctggacacagctggcatccacaccctgaaggaggtgagaagagattatgaggccatcggcatccaggtgctgctggcccagtgcaaccccaccgtgcgggacagcctgaccaacggggagtactgcaagaaggaggaggagaacctgctcttctacagcgtgtatgaggccatggcctttgctgaggtgtccaagaaccagaagggcgtgtgtgtgcccaacggcctgagcctgagcagtgactag

SEQ ID NO: 170540 - DNA, 72 bp, Artificial Sequence
  Description of Artificial Sequence: Synthetic coding sequence
atgagcagcgagagcaaggagcagcacaacgtgagcccccgggacagcgctgagggcaatgacagctactag

SEQ ID NO: 170541 - DNA, 2295 bp, Artificial Sequence
  Description of Artificial Sequence: Synthetic coding sequence
atgattgagccctttggaaaccagtacatcgtggcccggcctgtgtacagcaccaatgcctttgaggagaaccacaagaagacaggccgccaccacaagaccttcctggaccacctgaaggtgtgctgcagctgcagcccccagaaggccaagagaattgtgctgagcctcttccccatcgcctcctggctgcctgcctaccgcctgaaggagtggctgctgagtgacatcgtgtctggcatcagcactggaattgtggccgtgctgcagggcctggcctttgccctgctggtggacatcccccctgtgtatggcctgtatgccagcttcttccctgccatcatctacctgttcttcggcaccagccgccacatctctgtgggccccttccccatcctgtccatgatggtgggcctggccgtgtctggagctgtgtccaaggctgtgcctgacagaaatgccaccaccctgggcctgcccaacaacagcaacaacagcagcctgctggatgatgagcgggtgcgggtggccgctgctgcctctgtgacagtgctgagcggcatcatccagctggccttcggcatcctgcgcatcggctttgtggtgatctacctgtctgagagcctcatcagcggcttcaccacagctgctgctgtgcacgtgctggtgtcccagctgaagttcatcttccagctgactgtgcccagccacacagatcctgtgtccatcttcaaggtgctgtacagcgtcttcagccagatcgagaagaccaacattgctgacctggtgacagccctgattgtgctgctggtggtgtccatcgtgaaggagatcaaccagcgcttcaaggacaagctgcctgtgcccatccccatcgagttcatcatgacagtgattgctgctggggtgtcctatggctgtgacttcaagaaccgcttcaaggtggccgtggtgggggacatgaaccctggcttccagccccccatcaccccagatgtggagaccttccagaacacagtgggggactgcttcggcatcgccatggtggcctttgctgtggccttctctgtggcctctgtgtacagcctgaagtatgactaccccctggatggcaaccaggagctgattgccctgggcctgggcaacatcgtgtgtggggtcttccggggctttgctggcagcacagccctgagccgctctgctgtgcaggagagcactggaggcaagacccagattgctggcctcatcggggccatcatcgtgctgattgtggtgctggccatcggcttcctgctggcccccctgcagaagtctgtgctggccgccctggccctgggcaacctgaagggcatgctgatgcagtttgctgagatcggccgcctgtggaggaaggacaagtatgactgcctgatctggatcatgaccttcatcttcaccatcgtgctgggcctgggcctgggcctggccgcctctgtggccttccagctgctgaccatcgtgttccgcacccagttccccaagtgcagcaccctggccaacatcggccgcaccaacatctacaagaacaagaaggactactatgacatgtatgagcctgagggcgtgaagatcttccgctgccccagccccatctactttgccaacatcggcttcttccggaggaagctgattgatgctgtgggcttcagccccctgcgcatcctgaggaagaggaacaaggccctgaggaagatcaggaagctgcagaagcagggcctgctgcaggtgacccccaagggcttcatctgcaccgtggacaccatcaaggacagtgatgaggagctggacaacaaccagatcgaggtgctggaccagcccatcaacaccacagacctgcccttccacatcgactggaatgatgacctgcccctgaacatcgaggtgcccaagatcagcctgcacagcctcatcctggacttctctgctgtgtccttcctggatgtgtcctctgtgcggggcctgaagagcatcctgcaggagttcatccgcatcaaggtggatgtgtacatcgtgggcacagatgatgacttcatcgagaagctgaacagatatgagttctttgatggagaggtgaagagcagcatcttcttcctgaccatccatgatgctgtgctgcacatcctgatgaagaaggactacagcaccagcaagttcaaccccagccaggagaaggatggcaagattgacttcaccatcaacaccaacggcggcctgaggaacagagtgtatgaggtgcctgtggagaccaagttctag

SEQ ID NO: 170542 - DNA, 1956 bp, Artificial Sequence
  Description of Artificial Sequence: Synthetic coding sequence
atgctgctgaggaagatcatcaagaggcaggaggacatcatccgccacttctggatcatcagcaaatgtgtggtggcctcctggctgcctgcctaccgcctgaaggagtggctgctgagtgacatcgtgtctggcatcagcacaggcatcgtggccgtgctgcagggcctggcctttgccctgctggtggacatcccccctgtgtatggcctgtatgccagcttcttccctgccatcatctacctgttcttcggcaccagccgccacatctctgtgggccccttccccatcctgtccatgatggtgggcctggccgtgtctggagctgtgtccaaggctgtgcctgacagaaatgccaccaccctgggcctgcccaacaacagcaacaacagcagcctgctggatgatgagcgggtgcgggtggccgccgccgcctctgtgacagtgctgagcggcatcatccagctggccttcggcatcctgagaattggatttgtggtgatctacctgtctgagagcctcatcagcggcttcaccacagctgctgctgtgcacgtgctggtgtcccagctgaagttcatcttccagctgactgtgcccagccacacagatcctgtgtccatcttcaaggtgctgtacagcgtcttcagccagatcgagaagaccaacattgctgacctggtgacagccctgattgtgctgctggtggtgtccatcgtgaaggagatcaaccagcgcttcaaggacaagctgcctgtgcccatccccatcgagttcatcatgacagtgattgctgctggggtgtcctatggctgtgacttcaagaaccgcttcaaggtggccgtggtgggggacatgaaccctggcttccagccccccatcaccccagatgtggagaccttccagaacacagtgggggactgctttggaattgccatggtggcctttgctgtggccttctctgtggcctctgtgtacagcctgaagtatgactaccccctggatggcaaccaggagctgattgccctgggcctgggcaacatcgtgtgtggggtcttccggggctttgctggcagcacagccctgagccgctctgctgtgcaggagagcactggaggcaagacccagattgctggcctgattggagccatcatcgtgctgattgtggtgctggccatcggcttcctgctggcccccctgcagaagtctgtgctggccgccctggccctgggcaacctgaagggcatgctgatgcagtttgctgagatcggccgcctgtggaggaaggacaagtatgactgcctgatctggatcatgaccttcatcttcaccatcgtgctgggcctgggcctgggcctggccgcctctgtggccttccagctgctgaccatcgtgttccgcacccagttccccaagtgcagcaccctggccaacattggaagaaccaacatctacaagaacaagaaggactactatgacatgtatgagcctgagggcgtgaagatcttccgctgccccagccccatctactttgccaacatcggcttcttccggaggaagctgattgatgctgtgggcttcagccccctgcgcatcctgaggaagaggaacaaggccctgaggaagatcaggaagctgcagaagcagggcctgctgcaggtgacccccatcctgcaggagttcatccgcatcaaggtggatgtgtacatcgtgggcacagatgatgacttcatcgagaagctgaacagatatgagttctttgatggagaggtgaagagcagcatcttcttcctgaccatccatgatgctgtgctgcacatcctgatgaagaaggactacagcaccagcaagttcaaccccagccaggagaaggatggcaagattgacttcaccatcaacaccaatggaggcctgaggaacagagtgtatgaggtgcctgtggagaccaagttctag

SEQ ID NO: 170543 - DNA, 363 bp, Artificial Sequence
  Description of Artificial Sequence: Synthetic coding sequence
atgattgagccctttggaaaccagtacatcgtggcccggcctgtgtacagcaccaatgcctttgaggagaaccacaagaagacaggccgccaccacaagaccttcctggaccacctgaaggtgtgctgcagctgcagcccccagaaggccaagagaattgtgctgagcctcttccccatcgcctcctggctgcctgcctaccgcctgaaggagtggctgctgagtgacatcgtgtctggcatcagcactggaattgtggccgtgctgcagggcctggcctttgccctgctggtggacatcccccctgtgtatggcctgtatgccagcttcttccctgccatcatctacctgttctttggatag

SEQ ID NO: 170544 - DNA, 2343 bp, Artificial Sequence
  Description of Artificial Sequence: Synthetic coding sequence
atggccgcccctgggggccgctctgagcccccccagctgcctgagtacagctgcagctacatggtgtccaggcctgtgtacagcgagctggccttccagcagcagcacgagcggcggctgcaggagaggaagaccctgcgggagagcctggccaagtgctgcagctgcagcaggaagagggccttcggcgtgctgaagaccctggtgcccatcctggagtggctgcccaagtacagagtgaaggagtggctgctgagtgatgtgatcagcggcgtgtccacaggcctggtggccaccctgcagggcatggcctatgccctgctggccgctgtgcctgtgggctacggcctgtacagcgccttcttccccatcctgacctacttcatcttcggcaccagccgccacatctctgtgggccccttccctgtggtgtccctgatggtgggctctgtggtgctgtccatggccccagatgagcacttcctggtgagcagcagcaatggaacagtgctgaacaccaccatgattgacacagctgcccgggacacagcccgggtgctgattgccagcgccctgaccctgctggtgggcatcatccagctgatctttggaggcctgcagatcggcttcatcgtgcgctacctggccgaccccctggtgggcggcttcaccacagctgctgccttccaggtgctggtgtcccagctgaagatcgtgctgaatgtgtccaccaagaactacaacggggtgctgagcatcatctacaccctggtggagatcttccagaacatcggggacaccaacctggccgacttcaccgctggcctgctgaccatcgtggtgtgcatggctgtgaaggagctgaatgaccgcttccgccacaagatccctgtgcccatccccatcgaggtgattgtgaccatcatcgccacagccatctcctatggagccaacctggagaagaactacaatgccggcatcgtgaagagcatcccccggggcttcctgcccccagagctgccccctgtgtccctcttcagcgagatgctggccgccagcttcagcattgctgtggtggcctatgccatcgctgtgtctgtgggcaaggtgtatgccaccaagtatgactacaccattgatggcaaccaggagttcatcgccttcggcatcagcaacatcttcagcggcttcttcagctgctttgtggccaccacagccctgagcaggacagctgtgcaggagagcactggaggcaagacccaggtggccggcatcatctctgctgccatcgtgatgattgccatcctggccctgggcaagctgctggagcccctgcagaagtctgtgctggccgctgtggtgattgccaacctgaagggcatgttcatgcagctgtgtgacatcccccggctgtggaggcagaacaagattgatgctgtgatctgggtgttcacctgcatcgtgtccatcatcctgggcctggacctgggcctgctggccggcctcatcttcggcctgctgactgtggtgctgcgggtgcagttccccagctggaatggcctgggcagcatccccagcacagacatctacaagagcaccaagaactacaagaacatcgaggagccccagggcgtgaagatcctgcgcttcagcagccccatcttctatggaaatgtggatggcttcaagaagtgcatcaagagcacagtgggctttgatgccatccgggtgtacaacaagaggctgaaggccctgaggaagatccagaagctgatcaagagcggccagctgcgggccaccaagaatggcatcatcagtgatgctgtgtccaccaacaatgcctttgagccagatgaagatattgaggacctggaggagctggacatccccaccaaggagattgagatccaggtggactggaacagcgagctgcctgtgaaggtgaatgtgcccaaggtgcccatccacagcctggtgctggactgtggggccatctccttcctggatgtggtgggcgtgcgcagcctgcgggtgattgtgaaggagttccagagaattgatgtgaatgtgtactttgccagcctgcaggactatgtgattgagaagctggagcagtgtggcttctttgatgacaacatcaggaaggacaccttcttcctgactgtgcatgatgccatcctgtacctgcagaaccaggtgaagagccaggagggccagggcagcatcctggagaccatcaccctcatccaggactgcaaggacaccctggagctgattgaaacagagctgacagaggaggagctggatgtgcaggatgaggccatgaggaccctggccagctag

SEQ ID NO: 170545 - DNA, 396 bp, Artificial Sequence
  Description of Artificial Sequence: Synthetic coding sequence
atggccgcccctgggggccgctctgagcccccccagctgcctgagtacagctgcagctacatggtgtccaggcctgtgtacagcgagctggccttccagcagcagcacgagcggcggctgcaggagaggaagaccctgcgggagagcctggccaagtgctgcagctgcagcaggaagagggccttcggcgtgctgaagaccctggtgcccatcctggagtggctgcccaagtacagagtgaaggagtggctgctgagtgatgtgatcagcggcgtgtccacaggcctggtggccaccctgcagggcatggcctatgccctgctggccgctgtgcctgtgggctacggcctgtacagcgccttcttccccatcctgacctacttcatcttcggctag

SEQ ID NO: 170546 - DNA, 1026 bp, Artificial Sequence
  Description of Artificial Sequence: Synthetic coding sequence
atgagacatggcctggccgtgcccagcgtgctggccgctgtggtgattgccaacctgaagggcatgttcatgcagctgtgtgacatcccccggctgtggaggcagaacaagattgatgctgtgatctgggtgttcacctgcatcgtgtccatcatcctgggcctggacctgggcctgctggccggcctcatcttcggcctgctgactgtggtgctgcgggtgcagttccccagctggaatggcctgggcagcatccccagcacagacatctacaagagcaccaagaactacaagaacatcgaggagccccagggcgtgaagatcctgcgcttcagcagccccatcttctatggaaatgtggatggcttcaagaagtgcatcaagagcacagtgggctttgatgccatccgggtgtacaacaagaggctgaaggccctgaggaagatccagaagctgatcaagagcggccagctgcgggccaccaagaatggcatcatcagtgatgctgtgtccaccaacaatgcctttgagccagatgaggacatcgaggacctggaggagctggacatccccaccaaggagattgagatccaggtggactggaacagcgagctgcctgtgaaggtgaatgtgcccaaggtgcccatccacagcctggtgctggactgtggggccatctccttcctggatgtggtgggcgtgcgcagcctgcgggtcatcgtgaaggagttccagagaattgatgtgaatgtgtactttgccagcctgcaggactatgtgattgagaagctggagcagtgtggcttctttgatgacaacatcaggaaggacaccttcttcctgactgtgcatgatgccatcctgtacctgcagaaccaggtgaagagccaggagggccagggcagcatcctggagaccatcaccctcatccaggactgcaaggacaccctggagctgattgaaacagagctgacagaggaggagctggatgtgcaggatgaggccatgaggaccctggccagctag

SEQ ID NO: 170547 - DNA, 1050 bp, Artificial Sequence
  Description of Artificial Sequence: Synthetic coding sequence
atgattgccatcctggccctgggcaagctgctggagcccctgcagaagtctgtgctggccgctgtggtgattgccaacctgaagggcatgttcatgcagctgtgtgacatcccccggctgtggaggcagaacaagattgatgctgtgatctgggtgttcacctgcatcgtgtccatcatcctgggcctggacctgggcctgctggccggcctcatcttcggcctgctgactgtggtgctgcgggtgcagttccccagctggaatggcctgggcagcatccccagcacagacatctacaagagcaccaagaactacaagaacatcgaggagccccagggcgtgaagatcctgcgcttcagcagccccatcttctatggaaatgtggatggcttcaagaagtgcatcaagagcacagtgggctttgatgccatccgggtgtacaacaagaggctgaaggccctgaggaagatccagaagctgatcaagagcggccagctgcgggccaccaagaatggcatcatcagtgatgctgtgtccaccaacaatgcctttgagccagatgaggacatcgaggacctggaggagctggacatccccaccaaggagattgagatccaggtggactggaacagcgagctgcctgtgaaggtgaatgtgcccaaggtgcccatccacagcctggtgctggactgtggggccatctccttcctggatgtggtgggcgtgcgcagcctgcgggtcatcgtgaaggagttccagagaattgatgtgaatgtgtactttgccagcctgcaggactatgtgattgagaagctggagcagtgtggcttctttgatgacaacatcaggaaggacaccttcttcctgactgtgcatgatgccatcctgtacctgcagaaccaggtgaagagccaggagggccagggcagcatcctggagaccatcaccctcatccaggactgcaaggacaccctggagctgattgaaacagagctgacagaggaggagctggatgtgcaggatgaggccatgaggaccctggccagctag

SEQ ID NO: 170548 - DNA, 1104 bp, Artificial Sequence
  Description of Artificial Sequence: Synthetic coding sequence
atgagacatggcctggccgtgcctgtggccggcatcatctctgctgccatcgtgatgattgccatcctggccctgggcaagctgctggagcccctgcagaagtctgtgctggccgctgtggtgattgccaacctgaagggcatgttcatgcagctgtgtgacatcccccggctgtggaggcagaacaagattgatgctgtgatctgggtgttcacctgcatcgtgtccatcatcctgggcctggacctgggcctgctggccggcctcatcttcggcctgctgactgtggtgctgcgggtgcagttccccagctggaatggcctgggcagcatccccagcacagacatctacaagagcaccaagaactacaagaacatcgaggagccccagggcgtgaagatcctgcgcttcagcagccccatcttctatggaaatgtggatggcttcaagaagtgcatcaagagcacagtgggctttgatgccatccgggtgtacaacaagaggctgaaggccctgaggaagatccagaagctgatcaagagcggccagctgcgggccaccaagaatggcatcatcagtgatgctgtgtccaccaacaatgcctttgagccagatgaggacatcgaggacctggaggagctggacatccccaccaaggagattgagatccaggtggactggaacagcgagctgcctgtgaaggtgaatgtgcccaaggtgcccatccacagcctggtgctggactgtggggccatctccttcctggatgtggtgggcgtgcgcagcctgcgggtcatcgtgaaggagttccagagaattgatgtgaatgtgtactttgccagcctgcaggactatgtgattgagaagctggagcagtgtggcttctttgatgacaacatcaggaaggacaccttcttcctgactgtgcatgatgccatcctgtacctgcagaaccaggtgaagagccaggagggccagggcagcatcctggagaccatcaccctcatccaggactgcaaggacaccctggagctgattgaaacagagctgacagaggaggagctggatgtgcaggatgaggccatgaggaccctggccagctag

SEQ ID NO: 170549 - DNA, 2235 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccaggccgtgctgagcgccatcgtgattgtgaacctgaagggcatgttcatgcagttcagtgacctgcccttcttctggaggaccagcaagattgagctgaccatctggctgaccacctttgtgagcagcctcttcctgggcctggactatggcctcatcacagctgtgatcatcgccctgctgaccgtcatctaccgcacccagagccccagctacaaggtgctgggcaagctgcctgagacagatgtgtacattgatattgatgcctatgaggaggtgaaggagatccctggcatcaagatcttccagatcaatgcccccatctactatgccaacagcgacctgtacagcaatgccctgaagaggaagacaggagtgaacccagctgtgatcatgggcgcccggaggaaggccatgaggaaatatgccaaggaggtgggcaatgccaacatggccaatgccaccgtggtgaaggcagatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcatcgacagcgtgggcgtgaagaccctggccggcatcgtgaaggagtatggagatgtgggcatctacgtgtacctggccggctgcagcgcccaggtggtgaatgacctgaccaggaaccgcttctttgagaacccagccctgtgggagctgctcttccacagcatccatgatgctgtgctgggcagccagctgcgggaggccctggccgagcaggaggccagcgccccacccagccaggaggacctggagcccaatgccaccccagccaccccagaggcctag

SEQ ID NO: 170550 - DNA, 2058 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccaggccgtgctgagcgccatcgtgattgtgaacctgaagggcatgttcatgcagttcagtgacctgcccttcttctggaggaccagcaagattgagctgaccatctggctgaccacctttgtgagcagcctcttcctgggcctggactatggcctcatcacagctgtgatcatcgccctgctgaccgtcatctaccgcacccagagccccagctacaaggtgctgggcaagctgcctgagacagatgtgtacattgatattgatgcctatgaggaggtgaaggagatccctggcatcaagatcttccagatcaatgcccccatctactatgccaacagcgacctgtacagcaatgccctgaagaggaagacaggagtgaacccagctgtgatcatgggcgcccggaggaaggccatgaggaaatatgccaaggaggtgggcaatgccaacatggccaatgccaccgtggtgaaggcagatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcatcgacagcgtgggcgtgaagaccctggccggcatcgtgaaggagtatggagatgtgggcatctacgtgtacctggccggctgcagcgccttcatccagaggtag

SEQ ID NO: 170551 - DNA, 534 bp, Artificial Sequence
  Description of Artificial Sequence: Synthetic coding sequence
atgggcgcccggaggaaggccatgaggaaatatgccaaggaggtgggcaatgccaacatggccaatgccaccgtggtgaaggcagatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcattgattctgtgggcgtgaagaccctggccggcatcgtgaaggagtatggagatgtgggcatctacgtgtacctggccggctgcagcgcccaggtggtgaatgacctgaccaggaaccgcttctttgaaaatcctgccctgtgggagctgctcttccacagcatccatgatgctgtgctgggcagccagctgcgggaggccctggccgagcaggaggccagcgccccacccagccaggaggacctggagcccaatgccaccccagccaccccagaggcctag

SEQ ID NO: 170552 - DNA, 1008 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcttccacacagagatgacccggcgctggaggccctag

SEQ ID NO: 170553 - DNA, 2145 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccagaccatctggctgaccacctttgtgagcagcctcttcctgggcctggactatggcctcatcacagctgtgatcatcgccctgctgaccgtcatctaccgcacccagagccccagctacaaggtgctgggcaagctgcctgagacagatgtgtacattgatattgatgcctatgaggaggtgaaggagatccctggcatcaagatcttccagatcaatgcccccatctactatgccaacagcgacctgtacagcaatgccctgaagaggaagacaggagtgaacccagctgtgatcatgggcgcccggaggaaggccatgaggaaatatgccaaggaggtgggcaatgccaacatggccaatgccaccgtggtgaaggccacccaggatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcatcgacagcgtgggcgtgaagaccctggccggcatcgtgaaggagtatggagatgtgggcatctacgtgtacctggccggctgcagcgcccaggtggtgaatgacctgaccaggaaccgcttctttgagaacccagccctgtgggagctgctcttccacagcatccatgatgctgtgctgggcagccagctgcgggaggccctggccgagcaggaggccagcgccccacccagccaggaggacctggagcccaatgccaccccagccaccccagaggcctag

SEQ ID NO: 170554 - DNA, 2241 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccaggccgtgctgagcgccatcgtgattgtgaacctgaagggcatgttcatgcagttcagtgacctgcccttcttctggaggaccagcaagattgagctgaccatctggctgaccacctttgtgagcagcctcttcctgggcctggactatggcctcatcacagctgtgatcatcgccctgctgaccgtcatctaccgcacccagagccccagctacaaggtgctgggcaagctgcctgagacagatgtgtacattgatattgatgcctatgaggaggtgaaggagatccctggcatcaagatcttccagatcaatgcccccatctactatgccaacagcgacctgtacagcaatgccctgaagaggaagacaggagtgaacccagctgtgatcatgggcgcccggaggaaggccatgaggaaatatgccaaggaggtgggcaatgccaacatggccaatgccaccgtggtgaaggccacccaggatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcatcgacagcgtgggcgtgaagaccctggccggcatcgtgaaggagtatggagatgtgggcatctacgtgtacctggccggctgcagcgcccaggtggtgaatgacctgaccaggaaccgcttctttgagaacccagccctgtgggagctgctcttccacagcatccatgatgctgtgctgggcagccagctgcgggaggccctggccgagcaggaggccagcgccccacccagccaggaggacctggagcccaatgccaccccagccaccccagaggcctag

SEQ ID NO: 170555 - DNA, 2124 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcccctttgctgtgatcagcctgatgattggaggagtggccgtgcggctggtgcctgatgacatcgtcatccctgggggcgtgaatgccaccaatggaacagaggccagagatgccctgcgggtgaaggtggccatgtctgtgaccctgctgagcggcatcatccagttctgcctgggcgtgtgccgctttggatttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcactggaggcaagacccagctggccggctgcctggccagcctgatgatcctgctggtgatcctggccaccggcttcctgtttgagagcctgccccaggccgtgctgagcgccatcgtcatcgtgaacctgaagggcatgttcatgcagttcagtgacctgcccttcttctggaggaccagcaagattgagctgaccatctggctgaccacctttgtgagcagcctcttcctgggcctggactatggcctcatcacagctgtgatcatcgccctgctgaccgtcatctaccgcacccagagccccagctacaaggtgctgggcaagctgcctgagacagatgtgtacatcgacattgatgcctatgaggaggtgaaggagatccctggcatcaagatcttccagatcaatgcccccatctactatgccaacagcgacctgtacagcaatgccctgaagaggaagacaggagtgaacccagctgtgatcatgggcgcccggaggaaggccatgaggaaatatgccaaggaggtgggcaatgccaacatggccaatgccaccgtggtgaaggcagatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcattgattctgtgggcgtgaagaccctggccggcatcgtgaaggagtatggagatgtgggcatctacgtgtacctggccggctgcagcgcccaggtggtgaatgacctgaccaggaaccgcttctttgaaaatcctgccctgtgggagctgctcttccacagcatccatgatgctgtgctgggcagccagctgcgggaggccctggccgagcaggaggccagcgccccacccagccaggaggacctggagcccaatgccaccccagccaccccagaggcctag

SEQ ID NO: 170556 - DNA, 2139 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccagaccatctggctgaccacctttgtgagcagcctcttcctgggcctggactatggcctcatcacagctgtgatcatcgccctgctgaccgtcatctaccgcacccagagccccagctacaaggtgctgggcaagctgcctgagacagatgtgtacattgatattgatgcctatgaggaggtgaaggagatccctggcatcaagatcttccagatcaatgcccccatctactatgccaacagcgacctgtacagcaatgccctgaagaggaagacaggagtgaacccagctgtgatcatgggcgcccggaggaaggccatgaggaaatatgccaaggaggtgggcaatgccaacatggccaatgccaccgtggtgaaggcagatgctgaggtggatggagaagatgccaccaagccagaggaggaggatggagaggtgaagtacccacccatcgtcatcaagagcaccttccctgaggagatgcagcgcttcatgcctcctggggacaacgtgcacacagtcatcctggacttcacccaggtgaacttcatcgacagcgtgggcgtgaagaccctggccggcatcgtgaaggagtatggagatgtgggcatctacgtgtacctggccggctgcagcgcccaggtggtgaatgacctgaccaggaaccgcttctttgagaacccagccctgtgggagctgctcttccacagcatccatgatgctgtgctgggcagccagctgcgggaggccctggccgagcaggaggccagcgccccacccagccaggaggacctggagcccaatgccaccccagccaccccagaggcctag

SEQ ID NO: 170557 - DNA, 1551 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccaggccgtgctgagcgccatcgtgattgtgaacctgaagggcatgttcatgcagttcagtgacctgcccttcttctggaggaccagcaagattgagctgaccatctggctgaccacctttgtgagcagcctcttcctgggcctggactatggcctcatcacagctgtgatcatcgccctgctgaccgtcatctaccgcacccagagcttccacacagagatgacccggcgctggaggccctag

SEQ ID NO: 170558 - DNA, 1422 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagctggccggctgcctggccagcctgatgatcctgctggtgatcctggccaccggcttcctgtttgagagcctgccccagaccatctggctgaccacctttgtgagcagcctcttcctgggcctggactatggcctcatcacagctgtgatcatcgccctgctgaccgtcatctaccgcacccagaggtag

SEQ ID NO: 170559 - DNA, 2139 bp, Artificial Sequence; identical to SEQ ID NO: 170556
  Description of Artificial Sequence: Synthetic coding sequence

SEQ ID NO: 170560 - DNA, 1344 bp, Artificial Sequence
  Description of Artificial Sequence: Synthetic coding sequence
atggaccacgccgaggagaatgagatcctggccgccacccagcgctactacgtggagcggcccatcttcagccaccctgtgctgcaggagcggctgcacaccaaggacaaggtgcctgacagcattgctgacaagctgaagcaggccttcacctgcacccccaagaagatccggaacatcatctacatgttcctgcccatcaccaagtggctgcctgcctacaagttcaaggagtatgtgctgggggacctggtgtctggcatcagcactggagtgctgcagctgccccagggcctggcctttgccatgctggccgctgtgccccccatcttcggcctgtacagcagcttctaccctgtgatcatgtactgcttcctgggcaccagccgccacatcagcatcggcccctttgctgtgatcagcctgatgattggaggagtggccgtgcggctggtgcctgatgacatcgtcatccctggaggagtgaatgccaccaacggcacagaggccagagatgccctgcgggtgaaggtggccatgtctgtgaccctgctgagcggcatcatccagttctgcctgggcgtgtgccgcttcggctttgtggccatctacctgacagagcccctggtgcggggcttcaccacagctgctgctgtgcacgtgttcacctccatgctgaagtacctgtttggagtgaagaccaagcgctacagcggcatcttctctgtggtgtacagcacagtggccgtgctgcagaatgtgaagaacctgaatgtgtgcagcctgggcgtgggcctgatggtgtttggcctgctgctgggcggcaaggagttcaatgaacgcttcaaggagaagctgcctgcccccatccccctggagttctttgctgtggtgatgggcaccggcatctctgctggcttcaacctgaaggagagctacaacgtggatgtggtgggcaccctgcccctgggcctgctgcccccagccaacccagacaccagcctcttccacctggtgtatgtggatgccatcgccatcgccatcgtgggcttctctgtgaccatctccatggccaagaccctggccaacaagcacggctaccaggtggatggcaaccaggagctgattgccctgggcctgtgcaacagcatcggcagcctcttccagaccttcagcatcagctgcagcctgagccgcagcctggtgcaggagggcaccggcggcaagacccagaccatctggctgaccacctttgtgagcagcctcttcctgggcctggactatggcctcatcacagctgtgatcatcgccctgctgaccgtcatctaccgcacccagaggtag

SEQ ID NO: 170561 - DNA, 1956 bp, Artificial Sequence
  Description of Artificial Sequence: Synthetic coding sequence
atgggcctggctgatgccagcggcccccgggacacccaggccctgctgagcgccacccaggccatggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccagggcctggcctatgccctgctggccggcctgccccctgtgtttggcctgtacagcagcttctaccctgtgttcatctacttcctgtttggcaccagccgccacatctctgtggtgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctcatcggggccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccgccagccccaagggggcctctgtgtccatcaacgtgaacaccagcctggaggacatgaggagcaacaacgtggaggactgcaagatgatggtgtcctctggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170562 - DNA, 2217 bp, Artificial Sequence
  Description of Artificial Sequence: Synthetic coding sequence
atggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccagggcctggcctatgccctgctggccggcctgccccctgtgtttggcctgtacagcagcttctaccctgtgttcatctacttcctgtttggcaccagccgccacatctctgtgggcacctttgctgtgatgtctgtgatggtgggctctgtgacagagagcctggccccccaggccctgaatgacagcatgatcaatgaaacagccagagatgctgcccgggtgcaggtggccagcaccctgtctgtgctggtgggcctcttccaggtgggcctgggcctcatccacttcggctttgtggtgacctacctgtctgagcccctggtgcggggctacaccacagctgctgctgtgcaggtgtttgtgtcccagctgaagtatgtgtttggcctgcacctgagcagccacagcggccccctgagcctcatctacacagtgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctcatcggggccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccgccagccccaagggggcctctgtgtccatcaacgtgaacaccagcctggaggacatgaggagcaacaacgtggaggactgcaagatgatgcaggtgagcagcggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170563 - DNA, 2223 bp, Artificial Sequence
  Description of Artificial Sequence: Synthetic coding sequence
atgggcctggctgatgccagcggcccccgggacacccaggccctgctgagcgccacccaggccatggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccagggcctggcctatgccctgctggccggcctgccccctgtgtttggcctgtacagcagcttctaccctgtgttcatctacttcctgtttggcaccagccgccacatctctgtgggcacctttgctgtgatgtctgtgatggtgggctctgtgacagagagcctggccccccaggccctgaatgacagcatgatcaatgaaacagccagagatgctgcccgggtgcaggtggccagcaccctgtctgtgctggtgggcctcttccaggtgggcctgggcctcatccactttggatttgtggtgacctacctgtctgagcccctggtgcggggctacaccacagctgctgctgtgcaggtgtttgtgtcccagctgaagtatgtgtttggcctgcacctgagcagccacagcggccccctgagcctcatctacacagtgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctgattggagccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccggccccctgctgagcgcctgcctggccccccagcaggtgagcagcggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170564 - DNA, 2280 bp, Artificial Sequence
  Description of Artificial Sequence: Synthetic coding sequence
atgggcctggctgatgccagcggcccccgggacacccaggccctgctgagcgccacccaggccatggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccagggcctggcctatgccctgctggccggcctgccccctgtgtttggcctgtacagcagcttctaccctgtgttcatctacttcctgtttggcaccagccgccacatctctgtgggcacctttgctgtgatgtctgtgatggtgggctctgtgacagagagcctggccccccaggccctgaatgacagcatgatcaatgaaacagccagagatgctgcccgggtgcaggtggccagcaccctgtctgtgctggtgggcctcttccaggtgggcctgggcctcatccactttggatttgtggtgacctacctgtctgagcccctggtgcggggctacaccacagctgctgctgtgcaggtgtttgtgtcccagctgaagtatgtgtttggcctgcacctgagcagccacagcggccccctgagcctcatctacacagtgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctgattggagccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccgccagccccaagggggcctctgtgtccatcaacgtgaacaccagcctggaggacatgaggagcaacaacgtggaggactgcaagatgatgcaggtgtcctctggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170565 - DNA, 2277 bp, Artificial Sequence
  Description of Artificial Sequence: Synthetic coding sequence
atgggcctggctgatgccagcggcccccgggacacccaggccctgctgagcgccacccaggccatggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccagggcctggcctatgccctgctggccggcctgccccctgtgtttggcctgtacagcagcttctaccctgtgttcatctacttcctgtttggcaccagccgccacatctctgtgggcacctttgctgtgatgtctgtgatggtgggctctgtgacagagagcctggccccccaggccctgaatgacagcatgatcaatgaaacagccagagatgctgcccgggtgcaggtggccagcaccctgtctgtgctggtgggcctcttccaggtgggcctgggcctcatccactttggatttgtggtgacctacctgtctgagcccctggtgcggggctacaccacagctgctgctgtgcaggtgtttgtgtcccagctgaagtatgtgtttggcctgcacctgagcagccacagcggccccctgagcctcatctacacagtgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctgattggagccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccgccagccccaagggggcctctgtgtccatcaacgtgaacaccagcctggaggacatgaggagcaacaacgtggaggactgcaagatgatggtgagcagcggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170566 - DNA, 2262 bp, Artificial Sequence
  Description of Artificial Sequence: Synthetic coding sequence
atgggcctggctgatgccagcggcccccgggacacccaggccctgctgagcgccacccaggccatggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccaggacctgctgagccggctgcactgctaccacagcaccctgggcctggcctatgccctgctggccggcctgccccctgtgtttggcctgtacagcagcttctaccctgtgttcatctacttcctgtttggcaccagccgccacatctctgtgggcacctttgctgtgatgtctgtgatggtgggctctgtgacagagagcctggccccccaggccctgaatgacagcatgatcaatgaaacagccagagatgctgcccgggtgcaggtggccagcaccctgtctgtgctggtgggcctcttccaggtgggcctgggcctcatccacttcggctttgtggtgacctacctgtctgagcccctggtgcggggctacaccacagctgctgctgtgcaggtgtttgtgtcccagctgaagtatgtgtttggcctgcacctgagcagccacagcggccccctgagcctcatctacacagtgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctcatcggggccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccggccccctgctgagcgcctgcctggccccccagcaggtgtcctctggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170567 - DNA, 2172 bp, Artificial Sequence
  Description of Artificial Sequence: Synthetic coding sequence
atgggcctggctgatgccagcggcccccgggacacccaggccctgctgagcgccacccaggccatggacctgcggcggcgggactaccacatggagcggcccctgctgaaccaggagcacctggaggagctgggccgctggggcagcgcccccaggacccaccagtggaggacctggctgcagtgcagccgggcccgggcctatgccctgctgctgcagcacctgcctgtgctggtgtggctgccccgctaccctgtgcgggactggctgctgggggacctgctgagcggcctgtctgtggccatcatgcagctgccccagggcctggcctatgccctgctggccggcctgccccctgtgtttggcctgtacagcagcttctaccctgtgttcatctacttcctgtttggcaccagccgccacatctctgtggccaccccaggccccctgcccctgctgacagcccctggccggcccaccggcggggccggccctgaccccctgcggctgcggggccacctgcctgtgaggaccagctgcccccggctgtaccacagctgcagctgtgccggcctgcggctgacagcccaggtgtgtgtgtggccacccagcgagcagcccctgtgggccaccgtgccccacctgctgctggaggtgtgctggaagctgccccagagcaaggtgggcaccgtggtgacagctgctgtggccggcgtggtgctggtggtggtgaagctgctgaatgacaagctgcagcagcagctgcccatgcccatccctggagagctgctgaccctgattggagccaccggcatctcctatggcatgggcctgaagcacagatttgaggtggatgtggtgggcaacatcccagctggcctggtgccccctgtggcccccaacacccagctgttcagcaagctggtgggcagcgccttcaccatcgctgtggtgggctttgccatcgccatcagcctgggcaagatctttgccctgcggcacggctacagagtggacagcaaccaggagctggtggccctgggcctgagcaacctgattggaggcatcttccagtgcttccctgtgtcctgcagcatgagccgcagcctggtgcaggagagcactggaggcaacagccaggtggccggggccatcagcagcctcttcatcctgctgatcatcgtgaagctgggggagctgttccatgacctgcccaaggctgtgctggccgccatcatcatcgtgaacctgaagggcatgctgcggcagctgagtgacatgaggagcctgtggaaggccaacagagctgacctgctgatctggctggtgaccttcaccgccaccatcctgctgaacctggacctgggcctggtggtggccgtcatcttcagcctgctgctggtggtggtgaggacccagatgccccactacagcgtgctgggccaggtgcctgacacagacatctacagagatgtggccgagtacagcgaggccaaggaggtgcggggcgtgaaggtgttccgcagcagcgccaccgtgtactttgccaatgctgagttctacagtgatgccctgaagcagagatgtggggtggatgtggacttcctgatcagccagaagaagaagctgctgaagaagcaggagcagctgaagctgaagcagctgcagaaggaggagaagctgaggaagcaggccgccagccccaagggggcctctgtgtccatcaacgtgaacaccagcctggaggacatgaggagcaacaacgtggaggactgcaagatgatgcaggtgtcctctggggacaagatggaggatgccacagccaacggccaggaggacagcaaggccccagatggcagcaccctgaaggccctgggcctgccccagcctgacttccacagcctcatcctggacctgggcgccctgagctttgtggacacagtgtgcctgaagagcctgaagaacatcttccatgacttccgggagattgaggtggaggtgtacatggccgcctgccacagccctgtggtgtcccagctggaggccggccacttctttgatgccagcatcaccaagaagcacctgtttgcctctgtgcatgatgctgtgacctttgccctgcagcaccccaggcctgtgcctgacagccctgtgtctgtgacccggctgtag

SEQ ID NO: 170568 - DNA, 1941 bp, Artificial Sequence
  Description of Artificial Sequence: Synthetic coding sequence
atgagggcccctggggccggggccgcctctgtggtgtccctggccctgctgtggctgctgggcctgccctggacctggagcgctgctgctgccctgggcgtgtatgtgggcagcggcggctggaggttcctgcgcatcgtgtgcaagacagcccggcgggacctgtttggcctgtctgtgctgatccgggtgcggctggagctgcggcggcaccagagagctggccacaccatcccccgcatcttccaggccgtggtgcagaggcagcctgagcggctggccctggtggatgctggcaccggggagtgctggacctttgcccagctggatgcctacagcaatgctgtggccaacctcttccggcagctgggctttgcccctggagatgtggtggccatcttcctggagggccggcctgagtttgtgggcctgtggctgggcctggccaaggccggcatggaggccgccctgctgaatgtgaacctgcggcgggagcccctggccttctgcctgggcaccagcggggccaaggccctgatctttggaggagagatggtggccgctgtggccgaggtgtctggccacctgggcaagagcctcatcaagttctgcagcggggacctgggccctgagggcatcctgcctgacacccacctgctggaccccctgctgaaggaggccagcacagcccccctggcccagatccccagcaagggcatggatgacaggctcttctacatctacaccagcggcaccaccggcctgcccaaggccgccatcgtggtgcacagccgctactacaggatggccgccttcggccaccacgcctacaggatgcaggccgcagatgtgctgtatgactgcctgcccctgtaccacagcgctggcaacatcattggagtgggccagtgcctgatctacggcctgactgtggtgctgaggaagaagttcagcgccagccgcttctgggatgactgcatcaagtacaactgcaccgtggtgcagtacatcggggagatctgccgctacctgctgaagcagcctgtgcgggaggccgagcggcggcaccgggtgcggctggccgtgggcaatggcctgcggcctgccatctgggaggagttcacagagcgcttcggcgtgcggcagattggagagttctatggagccacagagtgcaactgcagcatcgccaacatggatggcaaggtgggcagctgtggcttcaacagccgcatcctgccccacgtgtaccccatccggctggtgaaggtgaatgaagacaccatggagctgctgagagatgcccagggcctgtgcatcccctgccaggccggggagcccggcctgctggtgggccagatcaaccagcaggaccccctgcggagatttgatggctacgtgtctgagagcgccaccagcaagaagatcgcccacagcgtcttcagcaaaggagacagcgcctacctgtctggagatgtgctggtgatggatgagctgggctacatgtacttccgggacagaagtggggacaccttccgctggagaggagaaaatgtgtccaccacagaggtggagggcgtgctgagccggctgctgggccagacagatgtggccgtgtatggagtggccgtgcctggggtggagggcaaggccggcatggctgctgtggccgacccccacagcctgctggaccccaatgccatctaccaggagctgcagaaggtgctggccccctatgcccggcccatcttcctgcggctgctgccccaggtggacaccaccggcaccttcaagatccagaagacccggctgcagcgggagggctttgacccccggcagaccagtgacaggctcttcttcctggacctgaagcagggccactacctgcccctgaatgaggccgtgtacacccgcatctgcagcggggcctttgccctgtag

SEQ ID NO: 170569 - DNA, 723 bp, Artificial Sequence
  Description of Artificial Sequence: Synthetic coding sequence
cctgagtttgtgggcctgtggctgggcctggccaaggccggcatggaggccgccctgctgaatgtgaacctgcggcgggagcccctggccttctgcctgggcaccagcggggccaaggccctgatctttggaggagagatggtggccgctgtggccgaggtgtctggccacctgggcaagagcctcatcaagttctgcagcggggacctgggccctgagggcatcctgcctgacacccacctgctggaccccctgctgaaggaggccagcacagcccccctggcccagatccccagcaagggcatggatgacaggctcttctacatctacaccagcggcaccaccggcctgcccaaggccgccatcgtggtgcacagccgctactacaggatggccgccttcggccaccacgcctacaggatgcaggccgcagatgtgctgtatgactgcctgcccctgtaccacagcgctggcaacatcattggagtgggccagtgcctgatctacggcctgactgtggtgctgaggaagaagttcagcgccagccgcttctgggatgactgcatcaagtacaactgcacctggcacggccccagctggacagagaagctggagccccagaggaacccctgcctgtctgctgccctggtgcccctgtgcctgccccccctgcctgccttccagcccctgagccccagcatccctgtgcctgtgtggccctag

SEQ ID NO: 170570 - DNA, 1941 bp, Artificial Sequence; identical to SEQ ID NO: 170568
  Description of Artificial Sequence: Synthetic coding sequence

SEQ ID NO: 170571 - DNA, 1863 bp, Artificial Sequence
  Description of Artificial Sequence: Synthetic coding sequence
atgctgagcgccatctacacagtgctggccggcctgctcttcctgcccctgctggtgaacctgtgctgcccctacttcttccaggacatcggctacttcctgaaggtggccgctgtgggcagaagagtgcgctcctatggcaagagaagacctgcccggaccatcctgcgggccttcctggagaaggcccggcagaccccccacaagcccttcctgctcttcagagatgagaccctgacctacgcccaggtggaccggcgcagcaaccaggtggcccgggccctgcatgaccacctgggcctgcggcagggcgactgtgtggccctgctgatgggaaatgaaccagcctacgtgtggctgtggctgggcctggtgaagctgggctgtgccatggcctgcctgaactacaacatccgggccaagagcctgctgcactgcttccagtgctgcggggccaaggtgctgctggtgtccccagagctgcaggccgctgtggaggagatcctgcccagcctgaagaaggatgatgtgtccatctactacgtgtccaggaccagcaacacagatggcatcgacagcttcctggacaaggtggatgaggtgtccacagagcccatccctgagagctggaggtctgaggtgaccttcagcaccccagccctgtacatctacaccagcggcaccaccggcctgcccaaggccgccatgatcacccaccagaggatctggtacggcaccggcctgacctttgtgtctggcctgaaggcagatgatgtgatctacatcaccctgcccttctaccacagcgctgccctgctgattggcatccacggctgcatcgtggccggggccaccctggccctgcggaccaagttcagcgccagccagttctgggatgactgcaggaagtacaacgtgaccgtcatccagtacatcggggagctgctgcgctacctgtgcaacagcccccagaagcccaatgaccgggaccacaaggtgcggctggccctgggcaatggcctgcggggagatgtgtggaggcagtttgtgaagagatttggagacatctgcatctatgagttctatgctgccacagagggcaacatcggcttcatgaactatgccaggaaggtgggcgctgtgggccgggtgaactacctgcagaagaagatcatcacctatgacctgatcaagtatgatgtggagaaggatgagcctgtgagagatgaaaatggctactgtgtgcgggtgcccaagggggaggtgggcctgctggtgtgcaagatcacccagctgacccccttcaacggctacgccggggccaaggcccagacagagaagaagaagctgagagatgtgttcaagaagggggacctgtacttcaacagcggggacctgctgatggtggaccacgagaacttcatctacttccatgacagagtgggggacaccttccgctggaagggggagaatgtggccaccacagaggtggccgacacagtgggcctggtggactttgtgcaggaggtgaatgtgtatggagtgcacgtgcctgaccacgagggccgcatcggcatggccagcatcaagatgaaggaaaatcatgaatttgatggcaagaagctgttccagcacatcgctgactacctgcccagctatgcccggccccgcttcctgcgcatccaggacaccatcgagatcaccggcaccttcaagcacaggaagatgaccctggtggaggagggcttcaacccagctgtgatcaaggatgccctgtacttcctggatgacacagccaagatgtatgtgcccatgacagaggacatctacaatgccatcagcgccaagaccctgaagctgtag

SEQ ID NO: 170572 - DNA, 1704 bp, Artificial Sequence
  Description of Artificial Sequence: Synthetic coding sequence
atgctgagcgccatctacacagtgctggccggcctgctcttcctgcccctgctggtgaacctgtgctgcccctacttcttccaggacatcggctacttcctgaaggtggccgctgtgggcagaagagtgcgctcctatggcaagagaagacctgcccggaccatcctgcgggccttcctggagaaggcccggcagaccccccacaagcccttcctgctcttcagagatgagaccctgacctacgcccaggtggaccggcgcagcaaccaggtggcccgggccctgcatgaccacctgggcctgcggcagggcgactgtgtggccctgctgatgggaaatgaaccagcctacgtgtggctgtggctgggcctggtgaagctgggctgtgccatggcctgcctgaactacaacatccgggccaagagcctgctgcactgcttccagtgctgcggggccaaggtgctgctggtgtccccagagctgcaggccgctgtggaggagatcctgcccagcctgaagaaggatgatgtgtccatctactacgtgtccaggaccagcaacacagatggcatcgacagcttcctggacaaggtggatgaggtgtccacagagcccatccctgagagctggaggtctgaggtgaccttcagcaccccagccctgtacatctacaccagcggcaccactggagccaccctggccctgcggaccaagttcagcgccagccagttctgggatgactgcaggaagtacaacgtgaccgtcatccagtacatcggggagctgctgcgctacctgtgcaacagcccccagaagcccaatgaccgggaccacaaggtgcggctggccctgggcaatggcctgcggggagatgtgtggaggcagtttgtgaagagatttggagacatctgcatctatgagttctacgccgccacagagggcaacatcggcttcatgaactatgccaggaaggtgggcgctgtgggccgggtgaactacctgcagaagaagatcatcacctatgacctgatcaagtatgatgtggagaaggatgagcctgtgagagatgaaaatggctactgtgtgcgggtgcccaagggggaggtgggcctgctggtgtgcaagatcacccagctgacccccttcaacggctacgccggggccaaggcccagacagagaagaagaagctgagagatgtgttcaagaagggggacctgtacttcaacagcggggacctgctgatggtggaccacgagaacttcatctacttccatgacagagtgggggacaccttccgctggaagggagaaaatgtggccaccacagaggtggccgacacagtgggcctggtggactttgtgcaggaggtgaatgtgtatggagtgcacgtgcctgaccacgagggcagaattggcatggccagcatcaagatgaaggagaaccacgagtttgatggcaagaagctgttccagcacatcgctgactacctgcccagctatgcccggccccgcttcctgcgcatccaggacaccatcgagatcaccggcaccttcaagcacaggaagatgaccctggtggaggagggcttcaacccagctgtgatcaaggatgccctgtacttcctggatgacacagccaagatgtatgtgcccatgacagaggacatctacaatgccatcagcgccaagaccctgaagctgtag

SEQ ID NO: 170573 - DNA, 2436 bp, Artificial Sequence
  Description of Artificial Sequence: Synthetic coding sequence
atgcccaagccacccaagcccaggaacaacctggaggacagacacaaccctggcatccagggccggcgggagcacaggcctggccctggccgggtgcgggccgccagcagccctgggggcagcgcccccagggctgagcggcggctgtggggcgagggctgggagagcggggccgccccccacccccacagcagccgggtgtctgccctgcggccctgtggggtggtgggcgcctgggtgggcatgggcgtgtgccagaggacccgggccccctggaaggagaagagccagctggagagagctgccctgggcttcagaaaaggaggcagcggcatgtttgccagcggctggaaccagacagtgcccatcgaggaggccggctccatggccgccctgctgctgctgcccctgctgctgctgctgcccctgctgctgctgaagctgcacctgtggccccagctgcgctggctgcctgctgacctggcctttgctgtgcgggccctgtgctgcaagagggccctgcgggcccgggccctggccgctgctgctgctgaccctgagggccctgagggcggctgcagcctggcctggaggctggccgagctggcccagcagagagctgcccacaccttcctgatccacggcagccgccgcttctcctacagcgaggccgagcgggagagcaacagagctgcccgggccttcctgcgggccctgggctgggactggggcccagatggaggagacagcggggagggcagcgctggggagggggagagagctgcccctggagctggagatgctgctgctggcagcggggctgagtttgctggaggagatggagctgcccggggcggcggcgctgctgcccccctgagccctggggccaccgtggccctgctgctgcctgctggccctgagttcctgtggctgtggtttggcctggccaaggccggcctgaggacagcctttgtgcccacagccctgcggcggggccccctgctgcactgcctgcggagctgtggggcccgggccctggtgctggcccctgagttcctggagagcctggagccagacctgcctgccctgcgggccatgggcctgcacctgtgggccgccggccctggcacccaccctgctggcatcagtgacctgctggccgaggtgtctgctgaggtggatggccctgtgcccggctacctgagcagcccccagagcatcacagacacctgcctgtacatcttcaccagcggcaccaccggcctgcccaaggccgcccgcatcagccacctgaagatcctgcagtgccagggcttctaccagctgtgtggggtgcaccaggaggatgtgatctacctggccctgcccctgtaccacatgagcggcagcctgctgggcatcgtgggctgcatgggcattggagccaccgtggtgctgaagagcaagttctctgctggccagttctgggaggactgccagcagcaccgggtgaccgtcttccagtacatcggggagctgtgccgctacctggtgaaccagccccccagcaaggccgagcggggccacaaggtgcggctggccgtgggcagcggcctgcggccagacacctgggagagatttgtgcggcgcttcggccccctgcaggtgctggagacctacggcctgacagagggcaatgtggccaccatcaactacacaggccagagaggagctgtgggccgggcctcctggctgtacaagcacatcttccccttcagcctcatccgctatgatgtgaccaccggggagcccatccgggacccccagggccactgcatggccaccagccctggagagcccggcctgctggtggcccctgtgtcccagcagagccccttcctgggctacgccggcggccctgagctggcccagggcaagctgctgaaggatgtgttccggcctggagatgtgttcttcaacacaggagacctgctggtgtgtgatgaccagggcttcctgcgcttccatgacagaactggagacaccttccgctggaagggagaaaatgtggccaccacagaggtggccgaggtgtttgaggccctggacttcctgcaggaggtgaatgtgtatggagtgacagtgcccggccacgagggccgggccggcatggccgccctggtgctgcggcccccccacgccctggacctgatgcagctgtacacccacgtgtctgagaacctgcccccctatgcccggccccgcttcctgcggctgcaggagagcctggccaccacagagaccttcaagcagcagaaggtgaggatggccaatgaaggatttgaccccagcaccctgagtgaccccctgtatgtgctggaccaggccgtgggcgcctacctgcccctgaccacagcccgctacagcgccctgctggccggcaacctgcgcatctag

SEQ ID NO: 170574 - DNA, 2193 bp, Artificial Sequence
  Description of Artificial Sequence: Synthetic coding sequence
atgggcgtgtgccagaggacccgggccccctggaaggagaagagccagctggagcgggccgccctgggcttcaggaagggcggcagcggcatgtttgccagcggctggaaccagacagtgcccatcgaggaggccggctccatggccgccctgctgctgctgcccctgctgctgctgctgcccctgctgctgctgaagctgcacctgtggccccagctgcgctggctgcctgctgacctggcctttgctgtgcgggccctgtgctgcaagagggccctgcgggcccgggccctggccgctgctgctgctgaccctgagggccctgagggcggctgcagcctggcctggaggctggccgagctggcccagcagagagctgcccacaccttcctgattcatggcagccgccgcttctcctacagcgaggccgagcgggagagcaacagagctgcccgggccttcctgcgggccctgggctgggactggggcccagatggaggagacagcggggagggcagcgctggggagggggagcgggccgcccctggagctggagatgctgctgctggcagcggggctgagtttgctggaggagatggagctgcccggggcggcggggccgccgcccccctgagccctggggccaccgtggccctgctgctgcctgctggccctgagttcctgtggctgtggtttggcctggccaaggccggcctgaggacagcctttgtgcccacagccctgcggcggggccccctgctgcactgcctgcggagctgtggggcccgggccctggtgctggcccctgagttcctggagagcctggagccagacctgcctgccctgcgggccatgggcctgcacctgtgggccgccggccctggcacccaccctgctggcatcagtgacctgctggccgaggtgtctgctgaggtggatggccctgtgcccggctacctgagcagcccccagagcatcacagacacctgcctgtacatcttcaccagcggcaccaccggcctgcccaaggccgcccgcatcagccacctgaagatcctgcagtgccagggcttctaccagctgtgtggggtgcaccaggaggatgtgatctacctggccctgcccctgtaccacatgagcggcagcctgctgggcatcgtgggctgcatgggcatcggggccaccgtggtgctgaagagcaagttctctgctggccagttctgggaggactgccagcagcaccgggtgacagtgttccagtacatcggggagctgtgccgctacctggtgaaccagccccccagcaaggccgagcggggccacaaggtgcggctggccgtgggcagcggcctgcggccagacacctgggagagatttgtgagaagatttggccccctgcaggtgctggagacctacggcctgacagagggcaatgtggccaccatcaactacacaggccagagaggagctgtgggccgggcctcctggctgtacaagcacatcttccccttcagcctcatccgctatgatgtgaccactggagagcccatccgggacccccagggccactgcatggccaccagccctggagagcccggcctgctggtggcccctgtgtcccagcagagccccttcctgggctacgccggcggccctgagctggcccagggcaagctgctgaaggatgtgttccggcctggagatgtgttcttcaacacaggagacctgctggtgtgtgatgaccagggcttcctgcgcttccatgacagaactggagacaccttccgctggaagggggagaatgtggccaccacagaggtggccgaggtgtttgaggccctggacttcctgcaggaggtgaatgtgtatggagtgacagtgcccggccacgagggccgggccggcatggccgccctggtgctgcggccccctcatgccctggacctgatgcagctgtacacccacgtgtctgagaacctgcccccctatgcccggccccgcttcctgcggctgcaggagagcctggccaccacagagaccttcaagcagcagaaggtgaggatggccaatgaaggatttgaccccagcaccctgagtgaccccctgtatgtgctggaccaggccgtgggcgcctacctgcccctgaccacagcccgctacagcgccctgctggccggcaacctgcgcatctag

SEQ ID NO: 170575 - DNA, 1932 bp, Artificial Sequence
  Description of Artificial Sequence: Synthetic coding sequence
atgctgctgggcgccagcctggtgggcgtgctgctcttcagcaagctggtgctgaagctgccctggacccaggtgggcttcagcctgctcttcctgtacctgggcagcggcggctggaggttcatccgggtcttcatcaagaccatccggcgggacatctttggaggcctggtgctgctgaaggtgaaggccaaggtgcggcagtgcctgcaggagaggagaacagtgcccatcctgtttgccagcacagtgagaagacacccagacaagacagccctgatctttgagggcacagacacccactggaccttccggcagctggatgagtacagcagctctgtggccaacttcctgcaggcccggggcctggccagcggagatgtggccgccatcttcatggagaacagaaatgaatttgtgggcctgtggctgggcatggccaagctgggcgtggaggccgccctgatcaacaccaacctgcggagagatgccctgctgcactgcctgaccaccagccgggcccgggccctggtgtttggaagtgagatggccagcgccatctgtgaggtgcacgccagcctggaccccagcctgagcctcttctgcagcggctcctgggagcccggggctgtgccccccagcacagagcacctggaccccctgctgaaggatgcccccaagcacctgcccagctgcccagacaagggcttcacagacaagctgttctacatctacaccagcggcaccaccggcctgcccaaggccgccatcgtggtgcacagccgctactacaggatggccgccctggtgtactacggcttcaggatgaggcccaatgacatcgtgtatgactgcctgcccctgtaccacagcgctggcaacatcgtgggcatcggccagtgcctgctgcacggcatgacagtggtgatcaggaagaagttcagcgccagccgcttctgggatgactgcatcaagtacaactgcaccatcgtgcagtacatcggggagctgtgccgctacctgctgaaccagcccccccgggaggccgagaaccagcaccaggtgaggatggccctgggcaatggcctgcggcagagcatctggaccaacttcagcagccgcttccacatcccccaggtggccgagttctacggggccacagagtgcaactgcagcctgggcaactttgacagccaggtgggcgcctgtggcttcaacagccgcatcctgagctttgtgtaccccatccggctggtgcgggtgaatgaagacaccatggagctgatccggggcccagatggagtgtgcatcccctgccagcctggagagcccggccagctggtgggccgcatcatccagaaggaccccctgcggagatttgatggctacctgaaccagggcgccaacaacaagaagatcgccaaggatgtgttcaagaagggggaccaggcctacctgactggagatgtgctggtgatggatgagctgggctacctgtacttccgggacagaactggagacaccttccgctggaagggggagaatgtgtccaccacagaggtggagggcaccctgagccggctgctggacatggctgatgtggccgtgtatggagtggaggtgcccggcacagagggccgggccggcatggctgctgtggccagccccactggaaactgtgacctggagagatttgcccaggtgctggagaaggagctgcccctgtatgcccggcccatcttcctgcggctgctgcctgagctgcacaagacaggcacctacaagttccagaagacagagctgaggaaggagggctttgatcctgccatcgtgaaggaccccctcttctacctggatgcccagaagggccgctacgtgcccctggaccaggaggcctacagccgcatccaggccggggaggagaagctgtag

SEQ ID NO: 170576 - DNA, 714 bp, Artificial Sequence
  Description of Artificial Sequence: Synthetic coding sequence
atgcccctgaccctgagcaccctgctgcagcccggccgcatctggacaggccggcgggctgctgagcccaccccaggccacaatgctgcctggagcctgagcggcggcggcgctgctgtgctgcaggccggggctgagacagccctggaccccggcggcatcctgcctgtggtgcccctgctgggcatctggaggctggccctgcaccctggcctgcaccaggaccaccaggcctacctgactggagatgtgctggtgatggatgagctgggctacctgtacttccgggacagaactggagacaccttccgctggaagggggagaatgtgtccaccacagaggtggagggcaccctgagccggctgctggacatggctgatgtggccgtgtatggagtggaggtgcccggcacagagggccgggccggcatggctgctgtggccagccccactggaaactgtgacctggagagatttgcccaggtgctggagaaggagctgcccctgtatgcccggcccatcttcctgcggctgctgcctgagctgcacaagacaggcacctacaagttccagaagacagagctgaggaaggagggctttgatcctgccatcgtgaaggaccccctcttctacctggatgcccagaagggccgctacgtgcccctggaccaggaggcctacagccgcatccaggccggggaggagaagctgtag

SEQ ID NO: 170577 - DNA, 2073 bp, Artificial Sequence
  Description of Artificial Sequence: Synthetic coding sequence
atgggcgtgcggcagcagctggccctgctgctgctgctgctgctgctgctgtggggcctgggccagcctgtgtggcctgtggccgtggccctgaccctgcgctggctgctgggggaccccacctgctgcgtgctgctgggcctggccatgctggcccggccctggctgggcccctgggtgccccacggcctgagcctggccgctgctgccctggccctgaccctgctgcctgcccggctgcccccaggcctgcgctggctgcctgcagatgtgatcttcctggccaagatcctgcacctgggcctgaagatccggggctgcctgagccggcagcccccagacacctttgtggatgcctttgagcggcgggcccgggcccagcccggccgggccctgctggtgtggacaggccctggggccggctctgtgacctttggagagctggatgcccgggcctgccaggccgcctgggccctgaaggccgagctgggggaccctgccagcctgtgtgccggggagcccacagccctgctggtgctggccagccaggccgtgcctgccctgtgcatgtggctgggcctggccaagctgggctgccccacagcctggatcaacccccacggccggggcatgcccctggcccacagcgtgctgagcagcggggcccgggtgctggtggtggaccctgacctgcgggagagcctggaggagatcctgcccaagctgcaggccgagaacatccgctgcttctacctgagccacaccagccccaccccaggagtgggcgccctgggcgccgccctggatgctgcccccagccaccctgtgcctgctgacctgcgggccggcatcacctggaggagccctgccctcttcatctacaccagcggcaccaccggcctgcccaagccagccatcctgacccatgagcgggtgctgcagatgagcaagatgctgagcctgagcggggccacagcagatgatgtggtgtacacagtgctgcccctgtaccacgtgatgggcctggtggtgggcatcctgggctgcctggacctgggcgccacctgtgtgctggcccccaagttcagcaccagctgcttctgggatgactgccggcagcacggcgtgaccgtcatcctgtatgtgggggagctgctgcgctacctgtgcaacatcccccagcagcctgaggacaggacccacacagtgcggctggccatgggaaatggcctgcgggcagatgtgtgggagaccttccagcagagatttggccccatccgcatctgggaggtgtatggcagcacagagggcaacatgggcctggtgaactacgtgggccgctgtggggccctgggcaagatgagctgcctgctgaggatgctgagcccctttgagctggtgcagtttgacatggaggccgctgagcctgtgcgggacaaccagggcttctgcatccctgtgggcctgggggagcccggcctgctgctgaccaaggtggtgtcccagcagccctttgtgggctaccggggcccccgggagctgtctgagaggaagctggtgagaaatgtgcggcagagcggagatgtgtactacaacacaggagatgtgctggccatggaccgggagggcttcctgtacttccgggaccggctgggggacaccttccgctggaagggggagaatgtgtccacccatgaggtggagggcgtgctgagccaggtggacttcctgcagcaggtgaatgtgtatggagtgtgtgtgcccggctgtgagggcaaggtgggcatggctgctgtgcagctggcccctggccagacctttgatggagagaagctgtaccagcacgtgcgggcctggctgcctgcctatgccaccccccacttcatccgcatccaggatgccatggaggtgaccagcaccttcaagctgatgaagacccggctggtgcgggagggcttcaacgtgggcatcgtggtggaccccctgtttgtgctggacaacagagcccagagcttccggcccctgacagctgagatgtaccaggccgtgtgtgagggcacctggaggctgtag

SEQ ID NO: 170578 - DNA, 1950 bp, Artificial Sequence
  Description of Artificial Sequence: Synthetic coding sequence
atggagaatgaccccagcagaagaagagagagcatcagcctgacccctgtggccaagggcctggagaacatgggcgctgacttcctggagagcctggaggagggccagctgcccaggagtgacctgagccctgctgagatccgcagctcctggagcgaggccgcccccaagcccttcagccgctggaggaacctgcagcctgccctgcgggcccgctccttctgccgggagcacatgcagctgttccgctggattggaacaggcctgctgtgcaccggcctgagcgccttcctgctggtggcctgcctgctggacttccagagggccctggccctgtttgtgctgacctgtgtggtgctgaccttcctgggccaccggctgctgaagaggctgctgggccccaagctgcggcgcttcctgaagccccagggccacccccggctgctgctgtggttcaagaggggcctggccctggccgccttcctgggcctggtgctgtggctgagcctggacaccagccagaggcctgagcagctggtgtcctttgctggcatctgtgtgtttgtggccctgctgtttgcctgcagcaagcaccactgtgctgtgtcctggagggctgtgtcctggggcctgggcctgcagtttgtgctgggcctgctggtgatcagaacagagcccggcttcatcgcctttgagtggctgggggagcagatccgcatcttcctgagctacaccaaggccggcagcagctttgtgtttggagaggccctggtgaaggatgtgtttgccttccaggtgctgcccatcatcgtgttcttcagctgtgtgatctctgtgctgtaccacgtgggcctgatgcagtgggtgatcctgaagatcgcctggctgatgcaggtgaccatgggcaccacagccacagagaccctgtctgtggccggcaacatctttgtgtcccagacagaggcccccctgctgatccggccctacctggccgacatgaccctgtctgaggtgcacgtggtgatgactggaggctacgccaccatcgccggcagcctgctgggcgcctacatcagctttggaattgatgccaccagcctgattgctgcctctgtgatggccgccccctgtgccctggccctgagcaagctggtgtacccagaggtggaggagagcaagttcagaagagaggagggcgtgaagctgacctatggagatgcccagaacctgattgaagctgccagcactggagctgccatctctgtgaaggtggtggccaacattgctgccaacctgattgccttcctggccgtgctggacttcatcaatgctgccctgtcctggctgggggacatggtggacatccagggcctgtccttccagctgatctgcagctacatcctgcggcctgtggccttcctgatgggcgtggcctgggaggactgccctgtggtggccgagctgctgggcatcaagctgttcctgaatgaatttgtggcctaccaggacctgagcaagtacaagcagaggcggctggccggggctgaggagtgggtgggggacaggaagcagtggatctctgtgcgggcagaggtgctgaccacctttgccctgtgtggctttgccaacttcagcagcatcggcatcatgctgggcggcctgacctccatggtgccccagaggaagagtgacttcagccagatcgtgctgcgggccctcttcaccggggcctgtgtgtccctggtgaatgcctgcatggccggcatcctgtacatgcccagaggagctgaggtggactgcatgagcctgctgaacaccaccctgagcagcagcagctttgagatctaccagtgctgccgggaggccttccagagcgtgaaccctgagttcagccctgaggccctggacaactgctgccgcttctacaaccacaccatctgtgcccagtag

SEQ ID NO: 170579 - DNA, 528 bp, Artificial Sequence
  Description of Artificial Sequence: Synthetic coding sequence
atggagaatgaccccagcagaagaagagagagcatcagcctgacccctgtggccaagggcctggagaacatgggcgctgacttcctggagagcctggaggagggccagctgcccaggagtgacctgagccctgctgagatccgcagctcctggagcgaggccgcccccaagcccttcagccgctggaggaacctgcagcctgccctgcgggcccgctccttctgccgggagcacatgcagctgttccgctggattggaacaggcctgctgtgcaccggcctgagcgccttcctgctggtggcctgcctgctggacttccagagggccctggccctgtttgtgctgacctgtgtggtgctgaccttcctgggccaccggctgctgaagaggctgctgggccccaagctgcggcgcttcctgaagccccagggccacccccggctgctgctgtggttcaagagggacccccggccctggagcaaggagggccccaaccagtacctgccccagatcacctggacagtgtag

SEQ ID NO: 170580 - DNA, 1950 bp, Artificial Sequence; identical to SEQ ID NO: 170578
  Description of Artificial Sequence: Synthetic coding sequence

SEQ ID NO: 170581 - DNA, 1632 bp, Artificial Sequence
  Description of Artificial Sequence: Synthetic coding sequence
atggagaatgaccccagcagaagaagagagagcatcagcctgacccctgtggccaagggcctggagaacatgggcgctgacttcctggagagcctggaggagggccagctgcccaggagtgacctgagccctgctgagatccgcagctcctggagcgaggccgcccccaagcccttcagccgctggaggaacctgcagcctgccctgcgggcccgctccttctgccgggagcacatgcagctgttccgctggattggaacaggcctgctgtgcaccggcctgagcgccttcctgctggtggcctgcctgctggacttccagagggccctggccctgtttgtgctgacctgtgtggtgctgaccttcctgggccaccggctgctgaagaggctgctgggccccaagctgcggcgcttcctgaagccccagggccacccccggctgctgctgtggttcaagaggggcctggccctggccgccttcctgggcctggtgctgtggctgagcctggacaccagccagaggcctgagcagctggtgtcctttgctggcatctgtgtgtttgtggccctgctgtttgcctgcagcaagcaccactgtgctgtgtcctggagggctgtgtcctggggcctgggcctgcagtttgtgctgggcctgctggtgatcagaacagagcccggcttcatcgcctttgagtggctgggggagcagatccgcatcttcctgagctacaccaaggccggcagcagctttgtgtttggagaggccctggtgaaggatgtgtttgccttccaggtgctgcccatcatcgtgttcttcagctgtgtgatctctgtgctgtaccacgtgggcctgatgcagtgggtgatcctgaagatcgcctggctgatgcaggtgaccatgggcaccacagccacagagaccctgtctgtggccggcaacatctttgtgtcccagacagaggcccccctgctgatccggccctacctggccgacatgaccctgtctgaggtgcacgtggtgatgactggaggctacgccaccatcgccggcagcctgctgggcgcctacatcagctttggaattgatgccaccagcctgattgctgcctctgtgatggccgccccctgtgccctggccctgagcaagctggtgtacccagaggtggaggagagcaagttcagaagagaggagggcgtgaagctgacctatggagatgcccagaacctgattgaagctgccagcactggagctgccatctctgtgaaggtggtggccaacattgctgccaacctgattgccttcctggccgtgctggacttcatcaatgctgccctgtcctggctgggggacatggtggacatccagggcctgtccttccagctgatctgcagctacatcctgcggcctgtggccttcctgatgggcgtggcctgggaggactgccctgtggtggccgagctgctgggcatcaagctgttcctgaatgaatttgtggcctaccaggacctgagcaagtacaagcagaggcggctggccggggctgaggagtgggtgggggacaggaagcagtggatcagccggcggggcctggccatgctgacccggctggtgctgaacagctggccctag

SEQ ID NO: 170582 - DNA, 1911 bp, Artificial Sequence
  Description of Artificial Sequence: Synthetic coding sequence
atggagaatgaccccagcagaagaagagagagcatcagcctgacccctgtggccaagggcctggagaacatgggcgctgacttcctggagagcctggaggagggccagctgcccaggagtgacctgagccctgctgagatccgcagctcctggagcgaggccgcccccaagcccttcagccgctggaggaacctgcagcctgccctgcgggcccgctccttctgccgggagcacatgcagctgttccgctggattggaacaggcctgctgtgcaccggcctgagcgccttcctgctggtggcctgcctgctggacttccagagggccctggccctgtttgtgctgacctgtgtggtgctgaccttcctgggccaccggctgctgaagaggctgctgggccccaagctgcggcgcttcctgaagccccagggccacccccggctgctgctgtggttcaagaggggcctggccctggccgccttcctgggcctggtgctgtggctgagcctggacaccagccagaggcctgagcagctggtgtcctttgctggcatctgtgtgtttgtggccctgctgtttgcctgcagcaagcaccactgtgctgtgtcctggagggctgtgtcctggggcctgggcctgcagtttgtgctgggcctgctggtgatcagaacagagcccggcttcatcgcctttgagtggctgggggagcagatccgcatcttcctgagctacaccaaggccggcagcagctttgtgtttggagaggccctggtgaaggatgtgtttgccttccaggtgctgcccatcatcgtgttcttcagctgtgtgatctctgtgctgtaccacgtgggcctgatgcagtgggtgatcctgaagatcgcctggctgatgcaggtgaccatgggcaccacagccacagagaccctgtctgtggccggcaacatctttgtgtcccagacagaggcccccctgctgatccggccctacctggccgacatgaccctgtctgaggtgcacgtggtgatgactggaggctacgccaccatcgccggcagcctgctgggcgcctacatcagctttggaattgatgccaccagcctgattgctgcctctgtgatggccgccccctgtgccctggccctgagcaagctggtgtacccagaggtggaggagagcaagttcagaagagaggagggcgtgaagctgacctatggagatgcccagaacctgattgaagctgccagcactggagctgccatctctgtgaaggtggtggccaacattgctgccaacctgattgccttcctggccgtgctggacttcatcaatgctgccctgtcctggctgggggacatggtggacatccagggcctgtccttccagctgatctgcagctacatcctgcggcctgtggccttcctgatgggcgtggcctgggaggactgccctgtggtggccgagctgctgggcatcaagctgttcctgaatgaatttgtggcctaccaggacctgagcaagtacaagcagaggcggctggccggggctgaggagtgggtgggggacaggaagcagtggatctctgtgcgggcagaggtgctgaccacctttgccctgtgtggctttgccaacttcagcagcatcggcatcatgctgggcggcctgacctccatggtgccccagaggaagagtgacttcagccagatcgtgctgcgggccctcttcaccggggcctgtgtgtccctggtgaatgcctgcatggccggcatcctgtacatgcccagaggagctgaggtggactgcatgagcctgctgaacaccaccctgagcagcagcagctttgagatctaccagtgctgccgggaggccttccagaggatcttcaagagcaccccagctgagagccagccctag

SEQ ID NO: 170583 - DNA, 864 bp, Artificial Sequence
  Description of Artificial Sequence: Synthetic coding sequence
atgcagctgttccgctggattggaacaggcctgctgtgcaccggcctgagcgccttcctgctggtggcctgcctgctggacttccagagggccctggccctgtttgtgctgacctgtgtggtgctgaccttcctgggccaccggctgctgaagaggctgctgggccccaagctgcggcgcttcctgaagccccagggccacccccggctgctgctgtggttcaagaggggcctggccctggccgccttcctgggcctggtgctgtggctgagcctggacaccagccagaggcctgagcagctggtgtcctttgctggcatctgtgtgtttgtggccctgctgtttgcctgcagcaagcaccactgtgctgtgtcctggagggctgtgtcctggggcctgggcctgcagtttgtgctgggcctgctggtgatcagaacagagcccggcttcatcgcctttgagtggctgggggagcagatccgcatcttcctgagctacaccaaggccggcagcagctttgtgtttggagaggccctggtgaaggatgtgtttgccttccaggtgctgcccatcatcgtgttcttcagctgtgtgatctctgtgctgtaccacgtgggcctgatgcagtgggtgatcctgaagatcgcctggctgatgcaggtgaccatgggcaccacagccacagagaccctgtctgtggccggcaacatctttgtgtcccagacagaggcccccctgctgatccggccctacctggccgacatgaccctgtctgaggtgcacgtggtgatgactggaggctacgccaccatcgccggcagcctgctgggcgcctacatcagctttggcctggagaagctgtag

SEQ ID NO: 170584 - DNA, 1452 bp, Artificial Sequence
  Description of Artificial Sequence: Synthetic coding sequence
atggagaatgaccccagcagaagaagagagagcatcagcctgacccctgtggccaagggcctggagaacatgggcgctgacttcctggagagcctggaggagggccagctgcccaggagtgacctgagccctgctgagatccgcagctcctggagcgaggccgcccccaagcccttcagccgctggaggaacctgcagcctgccctgcgggcccgctccttctgccgggagcacatgcagctgttccgctggattggaacaggcctgctgtgcaccggcctgagcgccttcctgctggtggcctgcctgctggacttccagagggccctggccctgtttgtgctgacctgtgtggtgctgaccttcctgggccaccggctgctgaagaggctgctgggccccaagctgcggcgcttcctgaagccccagggccacccccggctgctgctgtggttcaagaggggcctggccctggccgccttcctgggcctggtgctgtggctgagcctggacaccagccagaggcctgagcagctggtgtcctttgctggcatctgtgtgtttgtggccctgctgtttgcctgcagcaagcaccactgtgctgtgtcctggagggctgtgtcctggggcctgggcctgcagtttgtgctgggcctgctggtgatcagaacagagcccggcttcatcgcctttgagtggctgggggagcagatccgcatcttcctgagctacaccaaggccggcagcagctttgtgtttggagaggccctggtgaaggatgtgtttgccttccaggtgctgcccatcatcgtgttcttcagctgtgtgatctctgtgctgtaccacgtgggcctgatgcagtgggtgatcctgaagatcgcctggctgatgcaggtgaccatgggcaccacagccacagagaccctgtctgtggccggcaacatctttgtgtcccagacagaggcccccctgctgatccggccctacctggccgacatgaccctgtctgaggtgcacgtggtgatgactggaggctacgccaccatcgccggcagcctgctgggcgcctacatcagctttggagtgcgggcagaggtgctgaccacctttgccctgtgtggctttgccaacttcagcagcatcggcatcatgctgggcggcctgacctccatggtgccccagaggaagagtgacttcagccagatcgtgctgcgggccctcttcaccggggcctgtgtgtccctggtgaatgcctgcatggccggcatcctgtacatgcccagaggagctgaggtggactgcatgagcctgctgaacaccaccctgagcagcagcagctttgagatctaccagtgctgccgggaggccttccagagcgtgaaccctgagttcagccctgaggccctggacaactgctgccgcttctacaaccacaccatctgtgcccagtag

SEQ ID NO: 170585 - DNA, 1977 bp, Artificial Sequence
  Description of Artificial Sequence: Synthetic coding sequence
atggagaaggccagcggccggcagagcatcgccctgagcacagtggagactggaacagtgaaccctggcctggagctgatggagaaggaggtggagcctgagggcagcaagaggacagatgcccagggccacagcctgggagatggcctgggccccagcacctaccagaggaggagccgctggcccttcagcaaggcccggagcttctgcaagacccacgccagcctcttcaagaagatcctgctgggcctgctgtgcctggcctatgctgcctacctgctggccgcctgcatcctgaacttccagagggccctggccctcttcgtcatcacctgcctggtgatctttgtgctggtgcacagcttcctgaagaagctgctgggcaagaagctgacccgctgcctgaagccctttgagaacagccggctgcggctgtggaccaagtgggtgtttgctggggtgtccctggtgggcctcatcctgtggctggccctggacacagcccagaggcctgagcagctgatcccctttgctggcatctgcatgttcatcctgatcctgtttgcctgcagcaagcaccacagcgctgtgtcctggaggacagtgttcagcggcctgggcctgcagtttgtgtttggcatcctggtgatcagaacagacctgggctacaccgtcttccagtggctgggggagcaggtgcagatcttcctgaactacacagtggccggcagcagctttgtgtttggagacaccctggtgaaggatgtgtttgccttccaggccctgcccatcatcatcttcttcggctgtgtggtgtccatcctgtactacctgggcctggtgcagtgggtggtgcagaaggtggcctggttcctgcagatcaccatgggcaccacagccacagagaccctggccgtggccggcaacatctttgtgggcatgacagaggcccccctgctgatccggccctacctgggggacatgaccctgtctgagatccatgctgtgatgactggaggctttgccaccatctctggaacagtgctgggcgccttcatcgcctttggagtggatgccagcagcctcatcagcgcctctgtgatggccgccccctgtgccctggccagcagcaagctggcctacccagaggtggaggagagcaagttcaagtctgaggagggcgtgaagctgccccggggcaaggagagaaatgtgctggaggccgccagcaatggagctgtggatgccatcggcctggccaccaacgtggccgccaacctgattgccttcctggccgtgctggccttcatcaatgctgccctgtcctggctgggggagctggtggacatccagggcctgaccttccaggtgatctgcagctacctgctgcggcccatggtgttcatgatgggcgtggagtggacagactgccccatggtggccgagatggtgggcatcaagttcttcatcaatgaatttgtggcctaccagcagctgagccagtacaagaacaagaggctgagcggcatggaggagtggattgaaggagagaagcagtggatctctgtgcgggcagagatcatcaccaccttcagcctgtgtggctttgccaacctgagcagcatcggcatcaccctgggcggcctgaccagcatcgtgccccacaggaagagtgacctgagcaaggtggtggtgcgggccctcttcaccggggcctgtgtgtccctcatcagcgcctgcatggccggcatcctgtatgtgcccagaggagctgaggccgactgtgtgtccttccccaacaccagcttcaccaacagaacctatgagacctacatgtgctgccggggcctcttccagagcaccagcctgaatggcaccaacccccccagcttcagcggcccctgggaggacaaggagttcagcgccatggccctgaccaactgctgcggcttctacaacaacacagtgtgtgcctag

SEQ ID NO: 170586 - DNA, 2076 bp, Artificial Sequence
  Description of Artificial Sequence: Synthetic coding sequence
atggagctgcggagcacagctgcccccagggctgagggctacagcaatgtgggcttccagaatgaggagaacttcctggagaatgaaaacaccagcggcaacaacagcatccgcagcagagctgtgcagagccgggagcacaccaacaccaagcaggatgaggagcaggtgacagtggagcaggacagccccaggaaccgggagcacatggaggatgatgatgaggagatgcagcagaagggctgcctggagaggagatatgacacagtgtgtggcttctgcaggaagcacaagaccaccctgcggcacatcatctggggcatcctgctggccggctacctggtgatggtgatcagcgcctgtgtgctgaacttccaccgggccctgcccctcttcgtcatcaccgtggccgccatcttctttgtggtgtgggaccacctgatggccaagtatgagcacagaattgatgagatgctgagccctggaagaaggctgctgaacagccactggttctggctgaagtgggtgatctggagcagcctggtgctggccgtcatcttctggctggcctttgacacagccaagctgggccagcagcagctggtgtcctttggaggcctcatcatgtacatcgtgctgctcttcctgttcagcaagtaccccaccagggtgtactggaggcctgtgctgtggggcatcggcctgcagttcctgctgggcctgctgatcctgaggacagaccccggcttcatcgcctttgactggctgggccggcaggtgcagaccttcctggagtacacagatgctggggccagctttgtgtttggagagaagtacaaggaccacttctttgccttcaaggtgctgcccatcgtggtgttcttcagcacagtgatgtccatgctgtactacctgggcctgatgcagtggatcatcaggaaggtgggctggatcatgctggtgaccaccggcagcagccccatcgagagcgtggtggccagcggcaacatctttgtgggccagacagagagccccctgctggtgcggccctacctgccctacatcaccaagtctgagctgcacgccatcatgacagctggcttcagcaccatcgccggctctgtgctgggcgcctacatcagctttggagtgcccagcagccacctgctgacagcctctgtgatgtctgccccagccagcctggccgccgccaagctgttctggccagagacagagaagcccaagatcaccctgaagaatgccatgaagatggagagcggggacagcggcaacctgctggaggccgccacccagggcgccagcagcagcatcagcctggtggccaacattgctgtgaacctgattgccttcctggccctgctgtccttcatgaacagcgccctgtcctggtttggaaacatgtttgactacccccagctgagctttgagctgatctgcagctacatcttcatgcccttctccttcatgatgggcgtggagtggcaggacagcttcatggtggcccggctgattggctacaagaccttcttcaatgaatttgtggcctatgagcacctgagcaagtggatccacctgaggaaggagggcggccccaagtttgtgaatggagtgcagcagtacatcagcatccgctctgagatcatcgccacctacgccctgtgtggctttgccaacatcggcagcctgggcatcgtgattggaggcctgacctccatggcccccagcaggaagagggacatcgccagcggggctgtgcgggccctgattgctggcaccgtggcctgcttcatgacagcctgcatcgccggcatcctgagcagcacccctgtggacatcaactgccaccacgtgctggagaatgccttcaacagcaccttccctggcaacaccaccaaggtgattgcctgctgccagagcctgctgagcagcacagtggccaagggccctggagaggtgattcctgggggcaaccacagcctgtacagcctgaagggctgctgcaccctgctgaaccccagcaccttcaactgcaatggcatcagcaacaccttctag

SEQ ID NO: 170587 - DNA, 1869 bp, Artificial Sequence
  Description of Artificial Sequence: Synthetic coding sequence
atggaggatgatgatgaggagatgcagcagaagggctgcctggagcggcgctatgacacagtgtgtggcttctgcaggaagcacaagaccaccctgcggcacatcatctggggcatcctgctggccggctacctggtgatggtgatcagcgcctgtgtgctgaacttccaccgggccctgcccctgtttgtgatcaccgtggccgccatcttctttgtggtgtgggaccacctgatggccaagtatgagcacagaattgatgagatgctgagccctggccggcggctgctgaacagccactggttctggctgaagtgggtgatctggagcagcctggtgctggccgtcatcttctggctggcctttgacacagccaagctgggccagcagcagctggtgtcctttggaggcctcatcatgtacatcgtgctgctcttcctgttcagcaagtaccccaccagggtgtactggaggcctgtgctgtggggcatcggcctgcagttcctgctgggcctgctgatcctgaggacagatcctggcttcatcgcctttgactggctgggccggcaggtgcagaccttcctggagtacacagatgctggggccagctttgtgtttggagagaagtacaaggaccacttctttgccttcaaggtgctgcccatcgtggtgttcttcagcacagtgatgtccatgctgtactacctgggcctgatgcagtggatcatcaggaaggtgggctggatcatgctggtgaccaccggcagcagccccattgaatctgtggtggccagcggcaacatctttgtgggccagacagagagccccctgctggtgcggccctacctgccctacatcaccaagtctgagctgcacgccatcatgacagctggcttcagcaccatcgccggctctgtgctgggcgcctacatcagctttggagtgcccagcagccacctgctgacagcctctgtgatgtctgccccagccagcctggccgccgccaagctgttctggccagagacagagaagcccaagatcaccctgaagaatgccatgaagatggagagcggggacagcggcaacctgctggaggccgccacccagggcgccagcagcagcatcagcctggtggccaacattgctgtgaacctgattgccttcctggccctgctgtccttcatgaacagcgccctgtcctggtttggaaacatgtttgactacccccagctgagctttgagctgatctgcagctacatcttcatgcccttctccttcatgatgggcgtggagtggcaggacagcttcatggtggcccggctcatcggctacaagaccttcttcaatgaatttgtggcctatgagcacctgagcaagtggatccacctgaggaaggagggcggccccaagtttgtgaatggagtgcagcagtacatcagcatccgctctgagatcatcgccacctacgccctgtgtggctttgccaacatcggcagcctgggcatcgtcatcggcggcctgacctccatggcccccagcaggaagagggacatcgccagcggggctgtgcgggccctgattgctggcaccgtggcctgcttcatgacagcctgcatcgccggcatcctgagcagcacccctgtggacatcaactgccaccacgtgctggagaatgccttcaacagcaccttccctggcaacaccaccaaggtgattgcctgctgccagagcctgctgagcagcacagtggccaagggccctggagaggtgattcctgggggcaaccacagcctgtacagcctgaagggctgctgcaccctgctgaaccccagcaccttcaactgcaatggcatcagcaacaccttctag

SEQ ID NO: 170588 - DNA, 1608 bp, Artificial Sequence
  Description of Artificial Sequence: Synthetic coding sequence
atgaggcgggagaggacccggggcccccaggcctgggagttccccagccccaccaagagcggctgcagcctgcagagcctgagccgggacctgcgggagctgcgggagggggagaagccagaggaccaggccgagacagaggagagctggcagggcctggccaggaagacccctgggaaggcctgtgcccctgagggcggcagctgccagcccgggaagacagagaacaccatcaccatgaccaccagccaccagccccaggaccgctacaaggctgtgtggctgatcttcttcatgctgggcctgggcaccctgctgccctggaacttcttcatgacagccacccagtacttcaccaaccggctggacatgagccagaatgtgtccctggtgacagctgagctgagcaaggatgcccaggccagcgctgccccagctgcccccctgcctgagaggaacagcctgagcgccatcttcaacaacgtgatgaccctgtgtgccatgctgcccctgctgctcttcacctacctgaacagcttcctgcaccagaggatcccccagagcgtgcgcatcctgggcagcctggtggccatcctgctggtgttcctgatcacagccatcctggtgaaggtgcagctggatgccctgcccttctttgtgatcaccatgatcaagatcgtgctgatcaacagctttggagccatcctgcagggcagcctgtttggcctggccggcctgctgcctgccagctacacagcccccatcatgagcggccagggcctggccggcttctttgcctctgtggccatgatctgtgccatcgccagcggcagcgagctgtctgagagcgccttcggctacttcatcacagcctgtgctgtgatcatcctgaccatcatctgctacctgggcctgccccggctggagttctaccgctactaccagcagctgaagctggagggccctggagagcaggagaccaagctggacctgatcagcaagggggaggagccccgggccggcaaggaggagagcggcgtgtctgtgagcaacagccagcccaccaatgaaagccacagcatcaaggccatcctgaagaacatctctgtgctggccttctctgtgtgcttcatcttcaccatcaccatcggcatgtttcctgctgtgacagtggaggtgaagagcagcattgctggcagcagcacctgggagcgctacttcatccctgtgtcctgcttcctgaccttcaacatctttgactggctgggccgcagcctgacagctgtgttcatgtggccaggcaaggacagccgctggctgcccagcctggtgctggcccggctggtgtttgtgcccctgctgctgctgtgcaacatcaagccccggcgctacctgactgtggtgtttgaacatgatgcctggttcatcttcttcatggccgcctttgccttcagcaatggctacctggccagcctgtgcatgtgcttcggccccaagaaggtgaagccagctgaggccgagacagctggggccatcatggccttcttcctgtgcctgggcctggccctgggcgctgtgttctccttcctgttccgggccatcgtgtag

SEQ ID NO: 170589 - DNA, 1371 bp, Artificial Sequence
  Description of Artificial Sequence: Synthetic coding sequence
atgaccaccagccaccagccccaggaccgctacaaggctgtgtggctgatcttcttcatgctgggcctgggcaccctgctgccctggaacttcttcatgacagccacccagtacttcaccaaccggctggacatgagccagaatgtgtccctggtgacagctgagctgagcaaggatgcccaggccagcgctgccccagctgcccccctgcctgagaggaacagcctgagcgccatcttcaacaacgtgatgaccctgtgtgccatgctgcccctgctgctcttcacctacctgaacagcttcctgcaccagaggatcccccagagcgtgcgcatcctgggcagcctggtggccatcctgctggtgttcctgatcacagccatcctggtgaaggtgcagctggatgccctgcccttcttcgtcatcaccatgatcaagatcgtgctgatcaacagctttggagccatcctgcagggcagcctgtttggcctggccggcctgctgcctgccagctacacagcccccatcatgagcggccagggcctggccggcttctttgcctctgtggccatgatctgtgccatcgccagcggcagcgagctgtctgagagcgccttcggctacttcatcacagcctgtgccgtcatcatcctgaccatcatctgctacctgggcctgccccggctggagttctaccgctactaccagcagctgaagctggagggccctggagagcaggagaccaagctggacctgatcagcaaaggagaggagcccagggctgggaaggaggagagcggcgtgtctgtgagcaacagccagcccaccaatgaaagccacagcatcaaggccatcctgaagaacatctctgtgctggccttctctgtgtgcttcatcttcaccatcaccatcggcatgtttcctgctgtgacagtggaggtgaagagcagcattgctggcagcagcacctgggagcgctacttcatccctgtgtcctgcttcctgaccttcaacatctttgactggctgggccgcagcctgacagctgtgttcatgtggccaggcaaggacagccgctggctgcccagcctggtgctggcccggctggtgtttgtgcccctgctgctgctgtgcaacatcaagccccggcgctacctgactgtggtgtttgaacatgatgcctggttcatcttcttcatggccgcctttgccttcagcaatggctacctggccagcctgtgcatgtgcttcggccccaagaaggtgaagccagctgaggccgagacagctggggccatcatggccttcttcctgtgcctgggcctggccctgggcgctgtgttctccttcctgttccgggccatcgtgtag

SEQ ID NO: 170590 - DNA, 1371 bp, Artificial Sequence; identical to SEQ ID NO: 170589
  Description of Artificial Sequence: Synthetic coding sequence

SEQ ID NO: 170591 - DNA, 1371 bp, Artificial Sequence; identical to SEQ ID NO: 170589
  Description of Artificial Sequence: Synthetic coding sequence

SEQ ID NO: 170592 - DNA, 1371 bp, Artificial Sequence; identical to SEQ ID NO: 170589
  Description of Artificial Sequence: Synthetic coding sequence

SEQ ID NO: 170593 - DNA, 1371 bp, Artificial Sequence; identical to SEQ ID NO: 170589
  Description of Artificial Sequence: Synthetic coding sequence

SEQ ID NO: 170594 - DNA, 1371 bp, Artificial Sequence; identical to SEQ ID NO: 170589
  Description of Artificial Sequence: Synthetic coding sequence

SEQ ID NO: 170595 - DNA, 1371 bp, Artificial Sequence; identical to SEQ ID NO: 170589
  Description of Artificial Sequence: Synthetic coding sequence

SEQ ID NO: 170596 - DNA, 1371 bp, Artificial Sequence; identical to SEQ ID NO: 170589
  Description of Artificial Sequence: Synthetic coding sequence

SEQ ID NO: 170597 - DNA, 1371 bp, Artificial Sequence; identical to SEQ ID NO: 170589
  Description of Artificial Sequence: Synthetic coding sequence

SEQ ID NO: 170598 - DNA, 510 bp, Artificial Sequence
  Description of Artificial Sequence: Synthetic coding sequence
atgaggcgggagaggacccggggcccccaggcctgggagttccccagccccaccaagagcggctgcagcctgcagagcctgagccgctacaaggctgtgtggctgatcttcttcatgctgggcctgggcaccctgctgccctggaacttcttcatgacagccacccagtacttcaccaaccggctggacatgagccagaatgtgtccctggtgacagctgagctgagcaaggatgcccaggccagcgctgccccagctgcccccctgcctgagaggaacagcctgagcgccatcttcaacaacgtgatgaccctgtgtgccatgctgcccctgctgctcttcacctacctgaacagcttcctgcaccagaggatcccccagagcgtgcgcatcctgggcagcctggtggccatcctgctggtgttcctgatcacagccatcctggtgaaggtgcagctggatgccctgcccttctttgtgatcaccatgatcaagatcgtgctgatctag

SEQ ID NO: 170599 - DNA, 1371 bp, Artificial Sequence
  Description of Artificial Sequence: Synthetic coding sequence
atggcccggggagatgccccccgggacagctaccacctggtgggcatctccttcttcatcctgggcctgggcaccctgctgccctggaacttcttcatcacagccatcccctacttccaggcccggctggccggggccggcaacagcacagcccgcatcctgagcaccaaccacactggaccagaagatgccttcaacttcaacaactgggtgaccctgctgagccagctgcccctgctgctcttcaccctgctgaacagcttcctgtaccagtgtgtgcctgagaccgtgcgcatcctgggcagcctgctggccatcctgctgctgtttgccctgacagctgccctggtgaaggtggacatgagccctggccccttcttcagcatcaccatggcctctgtgtgcttcatcaacagcttctctgctgtgctgcagggcagcctgtttggccagctgggcaccatgcccagcacctacagcaccctcttcctgagcggccagggcctggccggcatctttgctgccctggccatgctgctgtccatggccagcggcgtggatgctgagaccagcgccctgggctacttcatcaccccctgtgtgggcatcctgatgagcatcgtgtgctacctgagcctgccccacctgaagtttgcccgctactacctggccaacaagagcagccaggcccaggcccaggagctggagaccaaggccgagctgctgcagagtgatgaaaatggcatccccagcagcccccagaaggtggccctgaccctggacctggacctggagaaggagcctgagagcgagccagatgagccccagaagccaggcaagcccagcgtcttcaccgtcttccagaagatctggctgacagccctgtgcctggtgctggtgttcaccgtgaccctgagcgtcttccctgccatcacagccatggtgaccagcagcaccagccctgggaagtggagccagttcttcaaccccatctgctgcttcctgctcttcaacatcatggactggctgggccgcagcctgaccagctacttcctgtggccagatgaggacagccggctgctgcccctgctggtgtgcctgcgcttcctgtttgtgcccctcttcatgctgtgccacgtgccccagaggagccggctgcccatcctcttcccccaggatgcctacttcatcaccttcatgctgctgtttgctgtgtccaatggctacctggtgtccctgaccatgtgcctggccccccggcaggtgctgccccatgagcgggaggtggccggggccctgatgaccttcttcctggccctgggcctgagctgtggggccagcctgtccttcctgttcaaggccctgctgtag

SEQ ID NO: 170600 - DNA, 1371 bp, Artificial Sequence; identical to SEQ ID NO: 170599
  Description of Artificial Sequence: Synthetic coding sequence

SEQ ID NO: 170601 - DNA, 1371 bp, Artificial Sequence; identical to SEQ ID NO: 170599
  Description of Artificial Sequence: Synthetic coding sequence

SEQ ID NO: 170602 - DNA, 1428 bp, Artificial Sequence
  Description of Artificial Sequence: Synthetic coding sequence
atggctgtggtgtctgaagatgacttccagcacagcagcaacagcacctaccgcaccaccagcagcagcctgcgggctgaccaggaggccctgctggagaagctgctggacaggcctcctcctggcctgcagaggccagaagatcgcttctgtggcacctacatcatcttcttcagcctgggcatcggcagcctgctgccctggaacttcttcatcacagccaaggagtactggatgttcaagctgaggaacagcagcagccctgccaccggggaggaccctgagggcagtgacatcctgaactactttgagagctacctggccgtggccagcacagtgcccagcatgctgtgcctggtggccaacttcctgctggtgaacagagtggccgtgcacatccgggtgctggccagcctgaccgtcatcctggccatcttcatggtgatcacagccctggtgaaggtggacaccagctcctggacccggggcttctttgctgtgaccatcgtgtgcatggtgatcctgagcggggccagcaccgtcttcagcagcagcatctacggcatgacaggcagcttccccatgaggaacagccaggccctgatctctggaggagccatgggcggcaccgtgtctgctgtggccagcctggtggacctggccgccagcagtgatgtgagaaattctgccctggccttcttcctgacagccaccgtcttcctggtgctgtgcatgggcctgtacctgctgctgagccggctggagtatgcccgctactacatgaggcctgtgctggccgcccacgtgttttctggagaggaggagctgccccaggacagcctgagcgcccccagcgtggccagccgcttcatcgacagccacaccccacccctgcggcccatcctgaagaagacagccagcctgggcttctgtgtgacctacgtgttcttcatcaccagcctcatctacccagccatctgcaccaacatcgagagcctgaacaagggcagcggcagcctgtggaccaccaagttcttcatccccctgaccaccttcctgctgtacaactttgctgacctgtgtggccggcagctgacagcctggatccaggtgcccggccccaacagcaaggccctgcccggctttgtgctgctgcggacctgcctgatccccctgtttgtgctgtgcaactaccagccccgggtgcacctgaagacagtggtgttccagagtgatgtgtacccagccctgctgagcagcctgctgggcctgagcaatggctacctgagcaccctggccctgctgtatggccccaagatcgtgccccgggagctggccgaggccactggagtggtgatgtccttctacgtgtgcctgggcctgaccctgggcagcgcctgcagcaccctgctggtgcacctgatctag

SEQ ID NO: 170603 - DNA, 1590 bp, Artificial Sequence
  Description of Artificial Sequence: Synthetic coding sequence
atgagccaggacacagaggtggacatgaaggaggtggagctgaatgagctggagcctgagaagcagcccatgaatgctgccagcggggccgccatgagcctggccggggctgagaagaatggcctggtgaagatcaaggtggctgaagatgaggccgaggccgctgctgctgccaagttcaccggcctgagcaaggaggagctgctgaaggtggccggcagccctggctgggtgaggacccgctgggccctgctgctgctcttctggctgggctggctgggcatgctggccggggctgtggtgatcatcgtgcgggccccccgctgccgggagctgcctgcccagaagtggtggcacactggagccctgtaccgcatcggggacctgcaggccttccagggccatggagctggcaacctggccggcctgaagggccgcctggactacctgagcagcctgaaggtgaagggcctggtgctgggccccatccacaagaaccagaaggatgatgtggcccagacagacctgctgcagattgaccccaactttggcagcaaagaagattttgacagcctgctgcagagcgccaagaagaagagcatccgggtcatcctggacctgacccccaactacagaggagagaacagctggttcagcacccaggtggacacagtggccaccaaggtgaaggatgccctggagttctggctgcaggccggcgtggatggcttccaggtgcgggacatcgagaacctgaaggatgccagcagcttcctggccgagtggcagaacatcaccaagggcttctctgaagatcggctgctgattgctggcaccaacagcagtgacctgcagcagatcctgagcctgctggagagcaacaaggacctgctgctgaccagcagctacctgagtgacagcggcagcactggagagcacaccaagagcctggtgacccagtacctgaatgccactggaaaccgctggtgctcctggagcctgagccaggcccggctgctgaccagcttcctgcctgcccagctgctgcggctgtaccagctgatgctgttcaccctgcccggcacccctgtgttctcctatggagatgaaattggcctggatgctgctgccctgcccggccagcccatggaggcccctgtgatgctgtgggatgagagcagcttcccagacatccctggagctgtgtctgccaacatgacagtgaagggccagagtgaagatcctggcagcctgctgagcctcttccggcggctgagtgaccagaggagcaaggagaggagcctgctgcatggagacttccacgccttctctgctggccctggcctcttctcctacatccgccactgggaccagaatgaacgcttcctggtggtgctgaactttggagatgtgggcctgtctgctggcctgcaggccagtgacctgcctgccagcgccagcctgcctgccaaggctgacctgctgctgagcacccagcccggccgggaggagggcagccccctggagctggagcggctgaagctggagccccatgagggcctgctgctgcgcttcccctatgctgcctag

SEQ ID NO: 170604 - DNA, 1707 bp, Artificial Sequence
  Description of Artificial Sequence: Synthetic coding sequence
atggagctgcagcccccagaggccagcattgctgtggtgtccatcccccggcagctgcccggcagccacagcgaggccggcgtgcagggcctgtctgctggagatgattctggcaccatgagccaggacacagaggtggacatgaaggaggtggagctgaatgagctggagcctgagaagcagcccatgaatgctgccagcggggccgccatgagcctggccggggctgagaagaatggcctggtgaagatcaaggtggccgaggatgaagctgaggccgctgctgctgccaagttcaccggcctgagcaaggaggagctgctgaaggtggccggcagccctggctgggtgaggacccgctgggccctgctgctgctcttctggctgggctggctgggcatgctggccggggctgtggtgatcatcgtgcgggccccccgctgccgggagctgcctgcccagaagtggtggcacactggagccctgtacagaattggagacctgcaggccttccagggccacggggccggcaacctggccggcctgaagggccgcctggactacctgagcagcctgaaggtgaagggcctggtgctgggccccatccacaagaaccagaaggatgatgtggcccagacagacctgctgcagattgaccccaactttggcagcaaggaggactttgacagcctgctgcagagcgccaagaagaagagcatccgggtcatcctggacctgacccccaactacagaggagaaaattcctggttcagcacccaggtggacacagtggccaccaaggtgaaggatgccctggagttctggctgcaggccggcgtggatggcttccaggtgcgggacatcgagaacctgaaggatgccagcagcttcctggccgagtggcagaacatcaccaagggcttcagcgaggaccggctgctgattgctggcaccaacagcagtgacctgcagcagatcctgagcctgctggagagcaacaaggacctgctgctgaccagcagctacctgagtgacagcggcagcactggagagcacaccaagagcctggtgacccagtacctgaatgccaccggcaaccgctggtgctcctggagcctgagccaggcccggctgctgaccagcttcctgcctgcccagctgctgcggctgtaccagctgatgctgttcaccctgcccggcacccctgtgttctcctatggagatgagatcggcctggatgctgctgccctgcccggccagcccatggaggcccctgtgatgctgtgggatgagagcagcttcccagacatccctggagctgtgtctgccaacatgacagtgaagggccagagcgaggaccccggcagcctgctgagcctcttccggcggctgagtgaccagaggagcaaggagaggagcctgctgcacggggacttccacgccttctctgctggccctggcctcttctcctacatccgccactgggaccagaatgaacgcttcctggtggtgctgaactttggagatgtgggcctgtctgctggcctgcaggccagtgacctgcctgccagcgccagcctgcctgccaaggctgacctgctgctgagcacccagcccggccgggaggagggcagccccctggagctggagcggctgaagctggagccccatgagggcctgctgctgcgcttcccctatgctgcctag

SEQ ID NO: 170605 - DNA, 1893 bp, Artificial Sequence
  Description of Artificial Sequence: Synthetic coding sequence
atggagctgcagcccccagaggccagcattgctgtggtgtccatcccccggcagctgcccggcagccacagcgaggccggcgtgcagggcctgtctgctggagatgattctgagctgggcagccactgtgtggcccagacaggcctggagctgctggccagcggggaccccctgcccagcgccagccagaatgctgagatgattgagaccggcagtgactgtgtgacccaggccggcctgcagctgctggccagcagtgaccccccagccctggccagcaagaatgctgaggtgacaggcaccatgagccaggacacagaggtggacatgaaggaggtggagctgaatgagctggagcctgagaagcagcccatgaatgctgccagcggggccgccatgagcctggccggggctgagaagaatggcctggtgaagatcaaggtggccgaggatgaagctgaggccgctgctgctgccaagttcaccggcctgagcaaggaggagctgctgaaggtggccggcagccctggctgggtgaggacccgctgggccctgctgctgctcttctggctgggctggctgggcatgctggccggggctgtggtgatcatcgtgcgggccccccgctgccgggagctgcctgcccagaagtggtggcacactggagccctgtacagaattggagacctgcaggccttccagggccacggggccggcaacctggccggcctgaagggccgcctggactacctgagcagcctgaaggtgaagggcctggtgctgggccccatccacaagaaccagaaggatgatgtggcccagacagacctgctgcagattgaccccaactttggcagcaaggaggactttgacagcctgctgcagagcgccaagaagaagagcatccgggtcatcctggacctgacccccaactacagaggagaaaattcctggttcagcacccaggtggacacagtggccaccaaggtgaaggatgccctggagttctggctgcaggccggcgtggatggcttccaggtgcgggacatcgagaacctgaaggatgccagcagcttcctggccgagtggcagaacatcaccaagggcttcagcgaggaccggctgctgattgctggcaccaacagcagtgacctgcagcagatcctgagcctgctggagagcaacaaggacctgctgctgaccagcagctacctgagtgacagcggcagcactggagagcacaccaagagcctggtgacccagtacctgaatgccaccggcaaccgctggtgctcctggagcctgagccaggcccggctgctgaccagcttcctgcctgcccagctgctgcggctgtaccagctgatgctgttcaccctgcccggcacccctgtgttctcctatggagatgagatcggcctggatgctgctgccctgcccggccagcccatggaggcccctgtgatgctgtgggatgagagcagcttcccagacatccctggagctgtgtctgccaacatgacagtgaagggccagagcgaggaccccggcagcctgctgagcctcttccggcggctgagtgaccagaggagcaaggagaggagcctgctgcacggggacttccacgccttctctgctggccctggcctcttctcctacatccgccactgggaccagaatgaacgcttcctggtggtgctgaactttggagatgtgggcctgtctgctggcctgcaggccagtgacctgcctgccagcgccagcctgcctgccaaggctgacctgctgctgagcacccagcccggccgggaggagggcagccccctggagctggagcggctgaagctggagccccatgagggcctgctgctgcgcttcccctatgctgcctag

SEQ ID NO: 170606 - DNA, 1896 bp, Artificial Sequence
  Description of Artificial Sequence: Synthetic coding sequence
atggagctgcagcccccagaggccagcattgctgtggtgtccatcccccggcagctgcccggcagccacagcgaggccggcgtgcagggcctgtctgctggagatgattctgaaacaggcagtgactgtgtgacccaggccggcctgcagctgctggccagcagtgaccccccagccctggccagcaagaatgctgaggtgacagtggagaccggcttccaccacgtgtcccaggccgacatcgagttcctgaccagcattgaccccacagccagcgccagcggcagcgctggcatcaccggcaccatgagccaggacacagaggtggacatgaaggaggtggagctgaatgagctggagcctgagaagcagcccatgaatgctgccagcggggccgccatgagcctggccggggctgagaagaatggcctggtgaagatcaaggtggctgaagatgaggccgaggccgctgctgctgccaagttcaccggcctgagcaaggaggagctgctgaaggtggccggcagccctggctgggtgaggacccgctgggccctgctgctgctcttctggctgggctggctgggcatgctggccggggctgtggtgatcatcgtgcgggccccccgctgccgggagctgcctgcccagaagtggtggcacactggagccctgtaccgcatcggggacctgcaggccttccagggccatggagctggcaacctggccggcctgaagggccgcctggactacctgagcagcctgaaggtgaagggcctggtgctgggccccatccacaagaaccagaaggatgatgtggcccagacagacctgctgcagattgaccccaactttggcagcaaagaagattttgacagcctgctgcagagcgccaagaagaagagcatccgggtcatcctggacctgacccccaactacagaggagagaacagctggttcagcacccaggtggacacagtggccaccaaggtgaaggatgccctggagttctggctgcaggccggcgtggatggcttccaggtgcgggacatcgagaacctgaaggatgccagcagcttcctggccgagtggcagaacatcaccaagggcttctctgaagatcggctgctgattgctggcaccaacagcagtgacctgcagcagatcctgagcctgctggagagcaacaaggacctgctgctgaccagcagctacctgagtgacagcggcagcactggagagcacaccaagagcctggtgacccagtacctgaatgccactggaaaccgctggtgctcctggagcctgagccaggcccggctgctgaccagcttcctgcctgcccagctgctgcggctgtaccagctgatgctgttcaccctgcccggcacccctgtgttctcctatggagatgaaattggcctggatgctgctgccctgcccggccagcccatggaggcccctgtgatgctgtgggatgagagcagcttcccagacatccctggagctgtgtctgccaacatgacagtgaagggccagagtgaagatcctggcagcctgctgagcctcttccggcggctgagtgaccagaggagcaaggagaggagcctgctgcatggagacttccacgccttctctgctggccctggcctcttctcctacatccgccactgggaccagaatgaacgcttcctggtggtgctgaactttggagatgtgggcctgtctgctggcctgcaggccagtgacctgcctgccagcgccagcctgcctgccaaggctgacctgctgctgagcacccagcccggccgggaggagggcagccccctggagctggagcggctgaagctggagccccatgagggcctgctgctgcgcttcccctatgctgcctag

SEQ ID NO: 170607 - DNA, 1986 bp, Artificial Sequence
  Description of Artificial Sequence: Synthetic coding sequence
atggagctgcagcccccagaggccagcattgctgtggtgtccatcccccggcagctgcccggcagccacagcgaggccggcgtgcagggcctgtctgctggagatgattctgagctgggcagccactgtgtggcccagacaggcctggagctgctggccagcggggaccccctgcccagcgccagccagaatgctgagatgattgagaccggcagtgactgtgtgacccaggccggcctgcagctgctggccagcagtgaccccccagccctggccagcaagaatgctgaggtgacagaaacaggcttccaccacgtgtcccaggccgacatcgagttcctgaccagcattgaccccacagccagcgccagcggcagcgctggcatcaccggcaccatgagccaggacacagaggtggacatgaaggaggtggagctgaatgagctggagcctgagaagcagcccatgaatgctgccagcggggccgccatgagcctggccggggctgagaagaatggcctggtgaagatcaaggtggctgaagatgaggccgaggccgctgctgctgccaagttcaccggcctgagcaaggaggagctgctgaaggtggccggcagccctggctgggtgaggacccgctgggccctgctgctgctcttctggctgggctggctgggcatgctggccggggctgtggtgatcatcgtgcgggccccccgctgccgggagctgcctgcccagaagtggtggcacactggagccctgtaccgcatcggggacctgcaggccttccagggccatggagctggcaacctggccggcctgaagggccgcctggactacctgagcagcctgaaggtgaagggcctggtgctgggccccatccacaagaaccagaaggatgatgtggcccagacagacctgctgcagattgaccccaactttggcagcaaagaagattttgacagcctgctgcagagcgccaagaagaagagcatccgggtcatcctggacctgacccccaactacagaggagagaacagctggttcagcacccaggtggacacagtggccaccaaggtgaaggatgccctggagttctggctgcaggccggcgtggatggcttccaggtgcgggacatcgagaacctgaaggatgccagcagcttcctggccgagtggcagaacatcaccaagggcttctctgaagatcggctgctgattgctggcaccaacagcagtgacctgcagcagatcctgagcctgctggagagcaacaaggacctgctgctgaccagcagctacctgagtgacagcggcagcactggagagcacaccaagagcctggtgacccagtacctgaatgccactggaaaccgctggtgctcctggagcctgagccaggcccggctgctgaccagcttcctgcctgcccagctgctgcggctgtaccagctgatgctgttcaccctgcccggcacccctgtgttctcctatggagatgaaattggcctggatgctgctgccctgcccggccagcccatggaggcccctgtgatgctgtgggatgagagcagcttcccagacatccctggagctgtgtctgccaacatgacagtgaagggccagagtgaagatcctggcagcctgctgagcctcttccggcggctgagtgaccagaggagcaaggagaggagcctgctgcatggagacttccacgccttctctgctggccctggcctcttctcctacatccgccactgggaccagaatgaacgcttcctggtggtgctgaactttggagatgtgggcctgtctgctggcctgcaggccagtgacctgcctgccagcgccagcctgcctgccaaggctgacctgctgctgagcacccagcccggccgggaggagggcagccccctggagctggagcggctgaagctggagccccatgagggcctgctgctgcgcttcccctatgctgcctag

SEQ ID NO: 170608 - DNA, 1536 bp, Artificial Sequence
  Description of Artificial Sequence: Synthetic coding sequence
atgagccaggacacagaggtggacatgaaggaggtggagctgaatgagctggagcctgagaagcagcccatgaatgctgccagcggggccgccatgagcctggccggggctgagaagaatggcctggtgaagatcaaggtggctgaagatgaggccgaggccgctgctgctgccaagttcaccggcctgagcaaggaggagctgctcttctggctgggctggctgggcatgctggccggggctgtggtgatcatcgtgcgggccccccgctgccgggagctgcctgcccagaagtggtggcacactggagccctgtaccgcatcggggacctgcaggccttccagggccatggagctggcaacctggccggcctgaagggccgcctggactacctgagcagcctgaaggtgaagggcctggtgctgggccccatccacaagaaccagaaggatgatgtggcccagacagacctgctgcagattgaccccaactttggcagcaaagaagattttgacagcctgctgcagagcgccaagaagaagagcatccgggtcatcctggacctgacccccaactacagaggagagaacagctggttcagcacccaggtggacacagtggccaccaaggtgaaggatgccctggagttctggctgcaggccggcgtggatggcttccaggtgcgggacatcgagaacctgaaggatgccagcagcttcctggccgagtggcagaacatcaccaagggcttctctgaagatcggctgctgattgctggcaccaacagcagtgacctgcagcagatcctgagcctgctggagagcaacaaggacctgctgctgaccagcagctacctgagtgacagcggcagcactggagagcacaccaagagcctggtgacccagtacctgaatgccactggaaaccgctggtgctcctggagcctgagccaggcccggctgctgaccagcttcctgcctgcccagctgctgcggctgtaccagctgatgctgttcaccctgcccggcacccctgtgttctcctatggagatgaaattggcctggatgctgctgccctgcccggccagcccatggaggcccctgtgatgctgtgggatgagagcagcttcccagacatccctggagctgtgtctgccaacatgacagtgaagggccagagtgaagatcctggcagcctgctgagcctcttccggcggctgagtgaccagaggagcaaggagaggagcctgctgcatggagacttccacgccttctctgctggccctggcctcttctcctacatccgccactgggaccagaatgaacgcttcctggtggtgctgaactttggagatgtgggcctgtctgctggcctgcaggccagtgacctgcctgccagcgccagcctgcctgccaaggctgacctgctgctgagcacccagcccggccgggaggagggcagccccctggagctggagcggctgaagctggagccccatgagggcctgctgctgcgcttcccctatgctgcctag

SEQ ID NO: 170609 - DNA, 408 bp, Artificial Sequence
  Description of Artificial Sequence: Synthetic coding sequence
atgagccaggacacagaggtggacatgaaggaggtggagctgaatgagctggagcctgagaagcagcccatgaatgctgccagcggggccgccatgagcctggccggggctgagaagaatggcctggtgaagatcaaggtggctgaagatgaggccgaggccgctgctgctgccaagttcaccggcctgagcaaggaggagctgctgaaggtggccggcagccctggctgggtgaggacccgctgggccctgctgctgctcttctggctgggctggctgggcatgctggccggggctgtggtgatcatcgtgcgggccccccgctgccgggagctgcctgcccagaagtggtggcacactggagccctgtaccgcatcggggacctgcaggccttccagggccactag

SEQ ID NO: 170610 - DNA, 2058 bp, Artificial Sequence
  Description of Artificial Sequence: Synthetic coding sequence
atggccgaggacaagagcaagagggacagcattgagatgtccatgaagggctgccagaccaacaacggctttgtgcacaatgaagacatcctggagcagaccccagaccccggcagcagcacagacaacctgaagcacagcacccggggcatcctgggcagccaggagccagacttcaagggcgtgcagccctatgccggcatgcccaaggaggtgctcttccagttcagcggccaggcccgctaccgcatcccccgggagatcctcttctggctgactgtggcctctgtgctggtgctgattgctgccaccatcgccatcatcgccctgagccccaagtgcctggactggtggcaggagggccccatgtaccagatctaccccaggagcttcaaggacagcaacaaggatggaaatggagacctgaagggcatccaggacaagctggactacatcacagccctgaacatcaagacagtgtggatcaccagcttctacaagagcagcctgaaggacttccgctatggagtggaggacttccgggaggtggaccccatcttcggcaccatggaggactttgagaacctggtggccgccatccatgacaagggcctgaagctgatcatcgacttcatccccaaccacaccagtgacaagcacatctggttccagctgagcaggaccaggacaggcaagtacacagactactacatctggcatgactgcacccatgaaaatggcaagaccatcccccccaacaactggctgtctgtgtatggcaacagctcctggcactttgatgaggtgaggaaccagtgctacttccaccagttcatgaaggagcagcctgacctgaacttcaggaacccagatgtgcaggaggagatcaaggagatcctgcgcttctggctgaccaagggcgtggatggcttcagcctggatgctgtgaagttcctgctggaggccaagcacctgagagatgagatccaggtgaacaagacccagatcccagacacagtgacccagtacagcgagctgtaccatgacttcaccaccacccaggtgggcatgcatgacatcgtgcgctccttccggcagaccatggaccagtacagcacagagcccggccgctaccgcttcatgggcacagaggcctatgcagagagcattgacagaacagtgatgtactacggcctgcccttcatccaggaggccgacttccccttcaacaactacctgtccatgctggacacagtgtctggcaacagcgtgtatgaagtcatcacctcctggatggagaacatgcctgagggcaagtggcccaactggatgattggaggccctgacagcagccggctgaccagccggctgggcaaccagtatgtgaatgtgatgaacatgctgctcttcaccctgcccggcacccccatcacctactacggggaggagatcggcatgggcaacatcgtggccgccaacctgaatgaaagctatgacatcaacaccctgcggagcaagagccccatgcagtgggacaacagcagcaatgccggcttcagcgaggccagcaacacctggctgcccaccaacagcgactaccacacagtgaatgtggatgtgcagaagacccagcccaggtctgccctgaagctgtaccaggacctgagcctgctgcacgccaatgagctgctgctgaacagaggctggttctgccacctgagaaatgacagccactacgtggtgtacacccgggagctggatggcatcgaccgcatcttcatcgtggtgctgaactttggagagagcaccctgctgaacctgcacaacatgatcagcggcctgcctgccaagatgaggatccggctgagcaccaacagcgctgacaagggcagcaaggtggacaccagcggcatcttcctggacaagggggagggcctcatctttgagcacaacaccaagaacctgctgcaccggcagacagccttccgggaccgctgctttgtgagcaacagagcctgctacagctctgtgctgaacatcctgtacaccagctgctag

SEQ ID NO: 170611 - DNA, 1866 bp, Artificial Sequence
  Description of Artificial Sequence: Synthetic coding sequence
atgaagaccttctggagccggccccgcatccagttcagcggccaggcccgctaccgcatcccccgggagatcctcttctggctgactgtggcctctgtgctggtgctgattgctgccaccatcgccatcatcgccctgagccccaagtgcctggactggtggcaggagggccccatgtaccagatctaccccaggagcttcaaggacagcaacaaggatggaaatggagacctgaagggcatccaggacaagctggactacatcacagccctgaacatcaagacagtgtggatcaccagcttctacaagagcagcctgaaggacttccgctatggagtggaggacttccgggaggtggaccccatcttcggcaccatggaggactttgagaacctggtggccgccatccatgacaagggcctgaagctgatcatcgacttcatccccaaccacaccagtgacaagcacatctggttccagctgagcaggaccaggacaggcaagtacacagactactacatctggcatgactgcacccatgaaaatggcaagaccatcccccccaacaactggctgtctgtgtatggcaacagctcctggcactttgatgaggtgaggaaccagtgctacttccaccagttcatgaaggagcagcctgacctgaacttcaggaacccagatgtgcaggaggagatcaaggagatcctgcgcttctggctgaccaagggcgtggatggcttcagcctggatgctgtgaagttcctgctggaggccaagcacctgagagatgagatccaggtgaacaagacccagatcccagacacagtgacccagtacagcgagctgtaccatgacttcaccaccacccaggtgggcatgcatgacatcgtgcgctccttccggcagaccatggaccagtacagcacagagcccggccgctaccgcttcatgggcacagaggcctatgcagagagcattgacagaacagtgatgtactacggcctgcccttcatccaggaggccgacttccccttcaacaactacctgtccatgctggacacagtgtctggcaacagcgtgtatgaagtcatcacctcctggatggagaacatgcctgagggcaagtggcccaactggatgattggaggccctgacagcagccggctgaccagccggctgggcaaccagtatgtgaatgtgatgaacatgctgctcttcaccctgcccggcacccccatcacctactacggggaggagatcggcatgggcaacatcgtggccgccaacctgaatgaaagctatgacatcaacaccctgcggagcaagagccccatgcagtgggacaacagcagcaatgccggcttcagcgaggccagcaacacctggctgcccaccaacagcgactaccacacagtgaatgtggatgtgcagaagacccagcccaggtctgccctgaagctgtaccaggacctgagcctgctgcacgccaatgagctgctgctgaacagaggctggttctgccacctgagaaatgacagccactacgtggtgtacacccgggagctggatggcatcgaccgcatcttcatcgtggtgctgaactttggagagagcaccctgctgaacctgcacaacatgatcagcggcctgcctgccaagatgaggatccggctgagcaccaacagcgctgacaagggcagcaaggtggacaccagcggcatcttcctggacaagggggagggcctcatctttgagcacaacaccaagaacctgctgcaccggcagacagccttccgggaccgctgctttgtgagcaacagagcctgctacagctctgtgctgaacatcctgtacaccagctgctag

SEQ ID NO: 170612 - DNA, 1656 bp, Artificial Sequence
  Description of Artificial Sequence: Synthetic coding sequence
atggccgaggacaagagcaagagggacagcattgagatgtccatgaagggctgccagaccaacaacggctttgtgcacaatgaagacatcctggagcagaccccagaccccggcagcagcacagacaacctgaagcacagcacccggggcatcctgggcagccaggagccagacttcaagggcgtgcagccctatgccggcatgcccaaggaggtgctcttccagttcagcggccaggcccgctaccgcatcccccgggagatcctcttctggctgactgtggcctctgtgctggtgctgattgctgccaccatcgccatcatcgccctgagccccaagtgcctggactggtggcaggagggccccatgtaccagatctaccccaggagcttcaaggacagcaacaaggatggaaatggagacctgaagggcatccaggacaagctggactacatcacagccctgaacatcaagacagtgtggatcaccagcttctacaagagcagcctgaaggacttccgctatggagtggaggacttccgggaggtggaccccatcttcggcaccatggaggactttgagaacctggtggccgccatccatgacaagggcctgaagctgatcatcgacttcatccccaaccacaccagtgacaagcacatctggttccagctgagcaggaccaggacaggcaagtacacagactactacatctggcatgactgcacccatgaaaatggcaagaccatcccccccaacaactggctgtctgtgtatggcaacagctcctggcactttgatgaggtgaggaaccagtgctacttccaccagttcatgaaggagcagcctgacctgaacttcaggaacccagatgtgcaggaggagatcaaggagatcctgcgcttctggctgaccaagggcgtggatggcttcagcctggatgctgtgaagttcctgctggaggccaagcacctgagagatgagatccaggtgaacaagacccagatcccagacacagtgacccagtacagcgagctgtaccatgacttcaccaccacccaggtgggcatgcatgacatcgtgcgctccttccggcagaccatggaccagtacagcacagagcccggccgctaccgcttcatgggcacagaggcctatgcagagagcattgacagaacagtgatgtactacggcctgcccttcatccaggaggccgacttccccttcaacaactacctgtccatgctggacacagtgtctggcaacagcgtgtatgaagtcatcacctcctggatggagaacatgcctgagggcaagtggcccaactggatgattggaggccctgacagcagccggctgaccagccggctgggcaaccagtatgtgaatgtgatgaacatgctgctcttcaccctgcccggcacccccatcacctactacggggaggagatcggcatgggcaacatcgtggccgccaacctgaatgaaagctatgacatcaacaccctgcggagcaagagccccatgcagtgggacaacagcagcaatgccggcttcagcgaggccagcaacacctggctgcccaccaacagcgactaccacacagtgaatgtggatgtgctgctgcggcacccctgcagcagcgctgtggcctag

SEQ ID NO: 170613 - DNA, 1524 bp, Artificial Sequence
  Description of Artificial Sequence: Synthetic coding sequence
atgggctgctggggcaggaacagaggccgcctgctgtgcatgctggccctgaccttcatgttcatggtgctggaggtggtggtgtcccgggtgaccagcagcctggccatgctgagtgacagcttccacatgctgagtgatgtgctggccctggtggtggccctggtggccgagagatttgcccggaggacccacgccacccagaagaacaccttcggctggatccgggcagaggtgatgggcgccctggtgaatgccatcttcctgaccggcctgtgctttgccatcctgctggaggccatcgagcgcttcatcgagccccatgagatgcagcagcccctggtggtgctgggcgtgggcgtggccggcctgctggtgaatgtgctgggcctgtgcctcttccaccaccacagcggcttcagccaggacagcggccacggccacagccacggcggccacggccacggccacggcctgcccaagggcccccgggtgaagagcacccggcccggcagcagtgacatcaacgtggcccctggagagcagggccctgaccaggaggagaccaacaccctggtggccaacaccagcaacagcaatggcctgaagctggaccctgctgaccctgagaaccccaggtctggggacacagtggaggtgcaggtgaatggaaacctggtgcgggagccagaccacatggagctggaggaggaccgggccggccagctgaacatgagaggagtcttcctgcacgtgctgggagatgccctgggctctgtgattgtggtggtgaatgccctggtgttctacttctcctggaagggctgcagcgagggggacttctgtgtgaacccctgcttcccagacccctgcaaggcctttgtggagatcatcaacagcacccacgcctctgtgtatgaggccggcccctgctgggtgctgtacctggaccccaccctgtgtgtggtgatggtgtgcatcctgctgtacaccacctaccccctgctgaaggagagcgccctgatcctgctgcagacagtgcccaagcagattgacatccggaacctgatcaaggagctgagaaatgtggagggcgtggaggaggtgcatgagctgcacgtgtggcagctggccggcagccgcatcatcgccacagcccacatcaagtgtgaggaccccaccagctacatggaggtggccaagaccatcaaggatgtgttccacaaccacggcatccacgccaccaccatccagcctgagtttgcctctgtgggcagcaagagctctgtggtgccctgtgagctggcctgcaggacccagtgtgccctgaagcagtgctgcggcaccctgccccaggcccccagcggcaaggatgctgagaagaccccagctgtgtccatcagctgcctggagctgagcaacaacctggagaagaagcccaggaggaccaaggccgagaacatcccagctgtggtgattgagatcaagaacatgcccaacaagcagcctgagagcagcctgtag

SEQ ID NO: 170614 - DNA, 1119 bp, Artificial Sequence
  Description of Artificial Sequence: Synthetic coding sequence
atggaggccaaggagaagcagcacctgctggatgcccggcctgccatccgcagctacacaggcagcctgtggcaggagggcgccggctggatccccctgccccggcccggcctggacctgcaggccatcgagctggccgcccagagcaaccaccactgccacgcccagaagggccctgacagccactgtgaccccaagaagggcaaggcccagaggcagctgtatgtggccagcgccatctgcctgctcttcatgattggagaggtggtgggcggctacctggcccacagcctggccgtgatgacagatgctgcccacctgctgacagactttgcctccatgctgatcagcctcttcagcctgtggatgagcagcaggcctgccaccaagaccatgaactttggctggcagagagctgagatcctgggcgccctggtgtctgtgctgagcatctgggtggtgactggagtgctggtgtacctggccgtggagcggctcatcagcggggactatgaaattgatggcggcaccatgctgatcaccagcggctgtgctgtggccgtgaacatcatcatgggcctgaccctgcaccagagcggccacggccacagccacggcaccaccaaccagcaggaggagaaccccagcgtgcgggccgccttcatccacgtgattggagacttcatgcagagcatgggcgtgctggtggccgcctacatcctgtacttcaagccagagtacaagtatgtggaccccatctgcacctttgtgttcagcatcctggtgctgggcaccaccctgaccatcctgagagatgtgatcctggtgctgatggagggcacccccaagggcgtggacttcaccgctgtgcgggacctgctgctgtctgtggagggcgtggaggccctgcacagcctgcacatctgggccctgactgtggcccagcctgtgctgtctgtgcacatcgccatcgcccagaacacagatgcccaggccgtgctgaagacagccagcagccggctgcagggcaagttccacttccacacagtgaccatccagatcgaggactacagcgaggacatgaaggactgccaggcctgccagggccccagcgactag

SEQ ID NO: 170615 - DNA, 972 bp, Artificial Sequence
  Description of Artificial Sequence: Synthetic coding sequence
atggaggccaaggagaagcagcacctgctggatgcccggcctgccatccgcagctacacaggcagcctgtggcaggagggcgccggctggatccccctgccccggcccggcctggacctgcaggccatcgagctggccgcccagagcaaccaccactgccacgcccagaagggccctgacagccactgtgaccccaagaagggcaaggcccagaggcagctgtatgtggccagcgccatctgcctgctcttcatgattggagaggtggtggagatcctgggcgccctggtgtctgtgctgagcatctgggtggtgactggagtgctggtgtacctggccgtggagcggctcatcagcggggactatgaaattgatggcggcaccatgctgatcaccagcggctgtgctgtggccgtgaacatcatcatgggcctgaccctgcaccagagcggccacggccacagccacggcaccaccaaccagcaggaggagaaccccagcgtgcgggccgccttcatccacgtgattggagacttcatgcagagcatgggcgtgctggtggccgcctacatcctgtacttcaagccagagtacaagtatgtggaccccatctgcacctttgtgttcagcatcctggtgctgggcaccaccctgaccatcctgagagatgtgatcctggtgctgatggagggcacccccaagggcgtggacttcaccgctgtgcgggacctgctgctgtctgtggagggcgtggaggccctgcacagcctgcacatctgggccctgactgtggcccagcctgtgctgtctgtgcacatcgccatcgcccagaacacagatgcccaggccgtgctgaagacagccagcagccggctgcagggcaagttccacttccacacagtgaccatccagatcgaggactacagcgaggacatgaaggactgccaggcctgccagggccccagcgactag

SEQ ID NO: 170616 - DNA, 345 bp, Artificial Sequence
  Description of Artificial Sequence: Synthetic coding sequence
atgggccccaggagaagaagcaggaagccagaggcccccaggagaagaagccccagccccacccccaccccaggccccagccggcggggccccagcctgggcgccagcagccaccagcacagcagaagacggcagggctggctgaaggagatcaggaagctgcagaagagcacccacctgctgatcaggaagctgcccttcagccggctggccgctgaggccttcctggtgcacctgtttgaagatgcctacctgctgaccctgcacgccggccgggtgaccctcttccccaaggatgtgcagctggcccggcgcatccggggcctggaggagggcctgggctag

SEQ ID NO: 170617 - DNA, 300 bp, Artificial Sequence
  Description of Artificial Sequence: Synthetic coding sequence
atgcccttccaccactgccaccgggaccccctgcccccacctggcctgaccccagagcggctgcacgcccggcggcagctgtatgctgcctgtgctgtgtgctttgtgttcatggccggggaggtggtgggcggctacctggcccacagcctggccatcatgacagatgctgcccacctgctggctgatgtgggctccatgatgggcagcctcttcagcctgtggctgagcaccaggcctgccaccaggaccatgaccttcggctggcacaggtctgagaccctgggcgccctggcctag

SEQ ID NO: 170618 - DNA, 723 bp, Artificial Sequence
  Description of Artificial Sequence: Synthetic coding sequence
atgcccttccaccactgccaccgggaccccctgcccccacctggcctgaccccagagcggctgcacgcccggcggcagctgtatgctgcctgtgctgtgtgctttgtgttcatggccggggaggtggtgggcggctacctggcccacagcctggccatcatgacagatgctgcccacctgctggctgatgtgggctccatgatgggcagcctcttcagcctgtggctgagcaccaggcctgccaccaggaccatgaccttcggctggcacaggtctgagaccctgggcgccctggcctctgtggtgtccctgtggatggtgacaggcatcctgctgtacctggcctttgtgcggctgctgcacagcgactaccacatcgagggcggggccatgctgctgacagccagcattgctgtgtgtgccaacctgctgatggcctttgtgctgcaccaggccggccccccccacagccacggcagcagaggagcagaatatgcccccctggaggagggccctgaggagcccctgcccctgggcaacacctctgtgcgggccgcctttgtgcacgtgctgggggacctgctgcagagctttggagtgctggccgccagcatcctgatctacttcaagccccagtacaaggctgctgaccccatcagcaccttcctgttcagcatctgtgccctgggcagcacagcccccaccctgagagatgtgctgtag

SEQ ID NO: 170619 - DNA, 1152 bp, Artificial Sequence
  Description of Artificial Sequence: Synthetic coding sequence
atgagggtggccgccggggcccggggggagaacatcgagcacctgaagctgcggctggaggcccggccccccaccctgctgctcttcacagagcccagcgagcccctgcctgaggagagcaagcctgtggagatgcccttccaccactgccaccgggaccccctgcccccacctggcctgaccccagagcggctgcacgcccggcggcagctgtatgctgcctgtgctgtgtgctttgtgttcatggccggggaggtggtgggcggctacctggcccacagcctggccatcatgacagatgctgcccacctgctggctgatgtgggctccatgatgggcagcctcttcagcctgtggctgagcaccaggcctgccaccaggaccatgaccttcggctggcacaggtctgagaccctgggcgccctggcctctgtggtgtccctgtggatggtgacaggcatcctgctgtacctggcctttgtgcggctgctgcacagcgactaccacatcgagggcggggccatgctgctgacagccagcattgctgtgtgtgccaacctgctgatggcctttgtgctgcaccaggccggccccccccacagccacggcagcagaggagcagaatatgcccccctggaggagggccctgaggagcccctgcccctgggcaacacctctgtgcgggccgcctttgtgcacgtgctgggggacctgctgcagagctttggagtgctggccgccagcatcctgatctacttcaagccccagtacaaggctgctgaccccatcagcaccttcctgttcagcatctgtgccctgggcagcacagcccccaccctgagagatgtgctgcgcatcctgatggagggcaccccaagaaatgtgggctttgagcctgtgcgggacaccctgctgtctgtgcctggggtgcgggccacccatgagctgcacctgtgggccctgaccctgacctaccacgtggccagcgcccacctggccatcgacagcacagctgaccctgaggccgtgctggccgaggccagcagccggctgtacagcagatttggcttcagcagctgcaccctgcaggtggagcagtaccagcctgagatggcccagtgcctgcgctgccaggagcccccccaggcctag

SEQ ID NO: 170620 - DNA, 336 bp, Artificial Sequence
  Description of Artificial Sequence: Synthetic coding sequence
atgcccttccaccactgccaccgggaccccctgcccccacctggcctgaccccagagcggctgcacgcccggcggcagctgtatgctgcctgtgctgtgtgctttgtgttcatggccggggaggtggtgggcggctacctggcccacagcctggccatcatgacagatgctgcccacctgctggctgatgtgggctccatgatgggcagcctcttcagcctgtggctgagcaccaggcctgccaccaggaccatgaccttcggctggcacaggtctgagaccctgggcgccctggcctctgtggtgtccctgtggatggtgacaggcatcctgtag

SEQ ID NO: 170621 - DNA, 1290 bp, Artificial Sequence
  Description of Artificial Sequence: Synthetic coding sequence
atggccggcagcggggcctggaagaggctgaagtccatgctgaggaaggatgatgcccccctcttcctgaatgacaccagcgcctttgacttcagtgatgaagctggagatgagggcctgagccgcttcaacaagctgcgggtggtggtggctgatgatggcagcgaggcccctgagaggcctgtgaatggagcccaccccaccctgcaggctgatgatgacagcctgctggaccaggacctgcccctgaccaacagccagctgagcctgaaggtggacagctgtgacaactgcagcaagcagcgggagatcctgaagcagaggaaggtgaaggcccggctgaccatcgctgctgtgctgtacctgctcttcatgattggagagctggtgggcggctacatcgccaacagcctggccatcatgacagatgccctgcacatgctgacagacctgagcgccatcatcctgaccctgctggccctgtggctgagcagcaagagccccaccaagcgcttcaccttcggcttccaccggctggaggtgctgagcgccatgatctctgtgctgctggtgtacatcctgatgggcttcctgctgtatgaggccgtgcagaggaccatccacatgaactatgagatcaacggggacatcatgctgatcacagctgctgtgggcgtggccgtgaatgtcatcatgggcttcctgctgaaccagagcggccaccgccacagccacagccacagcctgcccagcaacagccccacccggggcagcggctgtgagaggaaccacggccaggacagcctggccgtgcgggccgcctttgtgcacgccctgggggacctggtgcagagcgtgggcgtgctgattgctgcctacatcatccgcttcaagccagagtacaagattgctgaccccatctgcacctacgtgttcagcctgctggtggccttcaccaccttccgcatcatctgggacacagtggtgatcatcctggagggcgtgcccagccacctgaatgtggactacatcaaggaggccctgatgaagattgaagatgtgtacagcgtggaggacctgaacatctggagcctgaccagcggcaagagcacagccatcgtgcacatccagctgatccctggcagcagcagcaagtgggaggaggtgcagagcaaggccaaccacctgctgctgaacaccttcggcatgtaccgctgcaccatccagctgcagagctaccggcaggaggtggacaggacctgtgccaactgccagagcagcagcccctag

SEQ ID NO: 170622 - DNA, 357 bp, Artificial Sequence
  Description of Artificial Sequence: Synthetic coding sequence
atggaggagaagtatggaggagatgtgctggccggccctgggggcggcggcggcctgggccctgtggatgtgcccagcgcccggctgaccaagtacatcgtgctgctgtgcttcaccaagttcctgaaggctgtgggcctgtttgagagctatgacctgctgaaggctgtgcacatcgtgcagttcatcttcatcctgaagctgggcacagccttcttcatggtgctcttccagaagcccttcagcagcggcaagaccatcaccaagcaccagatcatcggcagcctgaagatccctggcaggaaggagttcaaggacaagaagctgaatgaccccaggaagctggtgggcaactag

SEQ ID NO: 170623 - DNA, 2298 bp, Artificial Sequence
  Description of Artificial Sequence: Synthetic coding sequence
atggaggagaagtatggaggagatgtgctggccggccctgggggcggcggcggcctgggccctgtggatgtgcccagcgcccggctgaccaagtacatcgtgctgctgtgcttcaccaagttcctgaaggctgtgggcctgtttgagagctatgacctgctgaaggctgtgcacatcgtgcagttcatcttcatcctgaagctgggcacagccttcttcatggtgctcttccagaagcccttcagcagcggcaagaccatcaccaagcaccagtggatcaagatcttcaagcatgctgtggccggctgcatcatcagcctgctgtggttcttcggcctgaccctgtgtggccccctgcggaccctgctgctgtttgagcacagcgacatcgtggtgatcagcctgctgtctgtgctcttcaccagcagcggcggcggccctgccaagaccagaggagctgccttcttcatcatcgctgtgatctgcctgctgctgtttgacaatgatgacctgatggccaagatggccgagcaccctgagggccaccatgattctgccctgacccacatgctgtacacagccatcgccttcctgggcgtggccgaccacaagggcggcgtgctgctgctggtgctggccctgtgctgcaaggtgggcttccacacagccagcaggaagctgtctgtggatgtgggcggggccaagaggctgcaggccctgagccacctggtgtctgtgctgctgctgtgcccctgggtgattgtgctgtctgtgaccacagagagcaaggtggagagctggttcagcctcatcatgccctttgccaccgtcatcttctttgtgatgatcctggacttctacgtggacagcatctgcagcgtgaagatggaggtgtccaaatgtgcccgctatggcagcttccccatcttcatcagcgccctgctgtttggaaacttctggacccaccccatcacagaccagctgcgggccatgaacaaggccgcccaccaggagagcacagagcacgtgctgtctggaggagtggtggtgtctgccatcttcttcatcctgagcgccaacatcctgagcagccccagcaagaggggccagaagggcaccctgattggctacagccctgagggcacccccctgtacaacttcatgggagatgccttccagcacagcagccagagcatcccccgcttcatcaaggagagcctgaagcagatcctggaggagagtgacagccggcagatcttctacttcctgtgcctgaacctgctcttcacctttgtggagctgttctacggcgtgctgaccaacagcctgggcctcatcagtgatggcttccacatgctgtttgactgcagcgccctggtgatgggcctgtttgctgccctgatgagccgctggaaggccacccgcatcttctcctatggctacggccgcatcgagatcctgagcggcttcatcaatggcctcttcctgattgtgattgccttctttgtgttcatggagagcgtggcccggctgattgaccccccagagctggacacccacatgctgacccctgtgtctgtgggcggcctgattgtgaacctgattggcatctgtgccttcagccacgcccacagccacgcccacggggccagccagggcagctgccacagcagtgaccacagccacagccaccacatgcacggccacagcgaccacggccacggccacagccacggcagcgctgggggcggcatgaatgccaacatgagaggagtcttcctgcacgtgctggccgacaccctgggcagcattggagtgattgtgtccacagtgctgattgagcagtttggctggttcatcgctgaccccctgtgcagcctcttcatcgccatcctgatcttcctgtctgtggtgcccctcatcaaggatgcctgccaggtgctgctgctgcggctgcccccagaatatgagaaggagctgcacatcgccctggagaagatccagaagattgagggcctcatctcctacagagacccccacttctggaggcacagcgccagcatcgtggccggcaccatccacatccaggtgaccagtgatgtgctggagcagagaattgtgcagcaggtgacaggcatcctgaaggatgctggggtgaacaacctgaccatccaggtggagaaggaggcctacttccagcacatgagcggcctgagcacaggcttccatgatgtgctggccatgaccaagcagatggagagcatgaagtactgcaaggatggcacctacatcatgtag

SEQ ID NO: 170624 - DNA, 1083 bp, Artificial Sequence
  Description of Artificial Sequence: Synthetic coding sequence
atgggagatgccttccagcacagcagccagagcatcccccgcttcatcaaggagagcctgaagcagatcctggaggagagtgacagccggcagatcttctacttcctgtgcctgaacctgctcttcacctttgtggagctgttctatggagtgctgaccaacagcctgggcctcatcagtgatggcttccacatgctgtttgactgcagcgccctggtgatgggcctgtttgctgccctgatgagccgctggaaggccacccgcatcttctcctatggctacggcagaattgagatcctgagcggcttcatcaatggcctcttcctgattgtcatcgccttctttgtgttcatggagagcgtggcccggctgattgatcctcctgagctggacacccacatgctgaccccctgccacagccacgcccatggagccagccagggcagctgccacagcagtgaccacagccacagccaccacatgcacggccacagcgaccacggccacggccacagccacggcagcgctgggggcggcatgaatgccaacatgaggggcgtcttcctgcacgtgctggccgacaccctgggcagcattggagtcatcgtgtccacagtgctgattgagcagtttggctggttcatcgctgaccccctgtgcagcctcttcatcgccatcctgatcttcctgtctgtggtgcccctcatcaaggatgcctgccaggtgctgctgctgcggctgcccccagaatatgagaaggagctgcacatcgccctggagaagatccagaagattgagggcctcatctcctacagagacccccacttctggaggcacagcgccagcatcgtggccggcaccatccacatccaggtgaccagtgatgtgctggagcagagaattgtgcagcaggtgacaggcatcctgaaggatgctggggtgaacaacctgaccatccaggtggagaaggaggcctacttccagcacatgagcggcctgagcacaggcttccatgatgtgctggccatgaccaagcagatggagagcatgaagtactgcaaggatggcacctacatcatgtag

SEQ ID NO: 170625 - DNA, 1386 bp, Artificial Sequence
  Description of Artificial Sequence: Synthetic coding sequence
atgggcaccatccacctgttcaggaagccccagaggagcttcttcggcaagctgctgcgggagttccggctggtggccgctgacagaagatcctggaagatcctgctgtttggagtcatcaacctgatctgcaccggcttcctgctgatgtggtgcagcagcaccaacagcatcgccctgacagcctacacctacctgaccatctttgacctcttcagcctgatgacctgcctgatctcctactgggtgaccctgaggaagcccagccctgtgtacagctttggatttgagcggctggaggtgctggccgtgtttgccagcacagtgctggcccagctgggcgccctcttcatcctgaaggagagcgctgagcgcttcctggagcagcctgagatccacacaggccgcctgctggtgggcacctttgtggccctgtgcttcaacctcttcaccatgctgagcatccggaacaagccctttgcctacgtgtctgaggccgccagcacctcctggctgcaggagcacgtggccgacctgagccgcagcctgtgtggcatcatccctggcctgagcagcatcttcctgcccaggatgaacccctttgtgctgattgacctggccggggcctttgccctgtgcatcacctacatgctgattgagatcaacaactactttgctgtggacacagccagcgccatcgccatcgccctgatgaccttcggcaccatgtaccccatgtctgtgtacagcggcaaggtgctgctgcagaccaccccacctcatgtgattggccagctggacaagctgatccgggaggtgtccaccctggatggagtgctggaggtgagaaatgagcacttctggaccctgggcttcggcagcctggccggctctgtgcacgtgcgcatcagaagagatgccaatgagcagatggtgctggcccacgtgaccaaccggctgtacaccctggtgtccaccctgactgtgcagatcttcaaggatgactggatccggcctgccctgctgagcggccctgtggccgccaacgtgctgaacttcagtgaccaccacgtgatccccatgcccctgctgaagggcacagatgacctgaaccctgtgaccagcaccccagccaagcccagcagccccccacctgagttctccttcaacacccctgggaagaatgtgaaccctgtgatcctgctgaacacccagacccggccctacggcttcggcctgaaccacggccacaccccctacagctccatgctgaaccagggcctgggcgtgcccggcattggagccacccagggcctgaggacaggcttcaccaacatccccagccgctatggcaccaacaaccgcatcggccagccccggccctag

SEQ ID NO: 170626 - DNA, 795 bp, Artificial Sequence
  Description of Artificial Sequence: Synthetic coding sequence
atgaacccctttgtgctgattgacctggccggggcctttgccctgtgcatcacctacatgctgattgagatcaacaactactttgctgtggacacagccagcgccatcgccatcgccctgatgaccttcggcaccatgtaccccatgtctgtgtacagcggcaaggtgctgctgcagaccaccccaccccacgtgattggccagctggacaagctgatccgggaggtgtccaccctggatggagtgctggaggtgagaaatgagcacttctggaccctgggcttcggcagcctggccggctctgtgcacgtgcgcatcagaagagatgccaatgagcagatggtgctggcccacgtgaccaacagactctacaccctggtgtccaccctgactgtgcagatcttcaaggatgactggatccggcctgccctgctgagcggccctgtggccgccaacgtgctgaacttcagtgaccaccacgtgatccccatgcccctgctgaagggcacagatgacctgaaccctgtgaccagcaccccagccaagcccagcagccccccacctgagttctccttcaacaccccaggcaagaatgtgaaccctgtgatcctgctgaacacccagacccggccctacggcttcggcctgaaccacggccacaccccctacagctccatgctgaaccagggcctgggcgtgcccggcatcggggccacccagggcctgaggacaggcttcaccaacatccccagccgctatggcaccaacaacagaattggccagccccggccctag

SEQ ID NO: 170627 - DNA, 1506 bp, Artificial Sequence
  Description of Artificial Sequence: Synthetic coding sequence
atgggcaccatccacctgttcaggaagccccagaggagcttcttcggcaagctgctgcgggagttccggctggtggccgctgacagaagatcctggaagatcctgctgtttggagtcatcaacctgatctgcaccggcttcctgctgatgtggtgcagcagcaccaacagcatcgccctgacagcctacacctacctgaccatctttgacctcttcagagatggagtgagccccttctggctgggctggagccagaccccagacctgaagtggagcacccacctgggcctgcccaagtgctgggacaacagaagagagctgccctgcctgagcaacagcctgatgacctgcctgatctcctactgggtgaccctgaggaagcccagccctgtgtacagctttggatttgagcggctggaggtgctggccgtgtttgccagcacagtgctggcccagctgggcgccctcttcatcctgaaggagagcgctgagcgcttcctggagcagcctgagatccacacaggccgcctgctggtgggcacctttgtggccctgtgcttcaacctcttcaccatgctgagcatccggaacaagccctttgcctacgtgtctgaggccgccagcacctcctggctgcaggagcacgtggccgacctgagccgcagcctgtgtggcatcatccctggcctgagcagcatcttcctgcccaggatgaacccctttgtgctgattgacctggccggggcctttgccctgtgcatcacctacatgctgattgagatcaacaactactttgctgtggacacagccagcgccatcgccatcgccctgatgaccttcggcaccatgtaccccatgtctgtgtacagcggcaaggtgctgctgcagaccaccccacctcatgtgattggccagctggacaagctgatccgggaggtgtccaccctggatggagtgctggaggtgagaaatgagcacttctggaccctgggcttcggcagcctggccggctctgtgcacgtgcgcatcagaagagatgccaatgagcagatggtgctggcccacgtgaccaaccggctgtacaccctggtgtccaccctgactgtgcagatcttcaaggatgactggatccggcctgccctgctgagcggccctgtggccgccaacgtgctgaacttcagtgaccaccacgtgatccccatgcccctgctgaagggcacagatgacctgaaccctgtgaccagcaccccagccaagcccagcagccccccacctgagttctccttcaacacccctgggaagaatgtgaaccctgtgatcctgctgaacacccagacccggccctacggcttcggcctgaaccacggccacaccccctacagctccatgctgaaccagggcctgggcgtgcccggcattggagccacccagggcctgaggacaggcttcaccaacatccccagccgctatggcaccaacaaccgcatcggccagccccggccctag

SEQ ID NO: 170628 - DNA, 1164 bp, Artificial Sequence
  Description of Artificial Sequence: Synthetic coding sequence
atgacctgcctgatctcctactgggtgaccctgaggaagcccagccctgtgtacagctttggatttgagcggctggaggtgctggccgtgtttgccagcacagtgctggcccagctgggcgccctcttcatcctgaaggagagcgctgagcgcttcctggagcagcctgagatccacacaggccgcctgctggtgggcacctttgtggccctgtgcttcaacctcttcaccatgctgagcatccggaacaagccctttgcctacgtgtctgaggccgccagcacctcctggctgcaggagcacgtggccgacctgagccgcagcctgtgtggcatcatccctggcctgagcagcatcttcctgcccaggatgaacccctttgtgctgattgacctggccggggcctttgccctgtgcatcacctacatgctgattgagatcaacaactactttgctgtggacacagccagcgccatcgccatcgccctgatgaccttcggcaccatgtaccccatgtctgtgtacagcggcaaggtgctgctgcagaccaccccacctcatgtgattggccagctggacaagctgatccgggaggtgtccaccctggatggagtgctggaggtgagaaatgagcacttctggaccctgggcttcggcagcctggccggctctgtgcacgtgcgcatcagaagagatgccaatgagcagatggtgctggcccacgtgaccaaccggctgtacaccctggtgtccaccctgactgtgcagatcttcaaggatgactggatccggcctgccctgctgagcggccctgtggccgccaacgtgctgaacttcagtgaccaccacgtgatccccatgcccctgctgaagggcacagatgacctgaaccctgtgaccagcaccccagccaagcccagcagccccccacctgagttctccttcaacacccctgggaagaatgtgaaccctgtgatcctgctgaacacccagacccggccctacggcttcggcctgaaccacggccacaccccctacagctccatgctgaaccagggcctgggcgtgcccggcattggagccacccagggcctgaggacaggcttcaccaacatccccagccgctatggcaccaacaaccgcatcggccagccccggccctag

SEQ ID NO: 170629 - DNA, 1317 bp, Artificial Sequence
  Description of Artificial Sequence: Synthetic coding sequence
atgggcaccatccacctgttcaggaagccccagaggagcttcttcggcaagctgctgcgggagttccggctggtggccgctgacagaagatcctggaagatcctgctgtttggagtcatcaacctgatctgcaccggcttcctgctgatgtggtgcagcagcaccaacagcatcgccctgacagcctacacctacctgaccatctttgacctcttcagcctgatgacctgcctgatctcctactgggtgaccctgaggaagcccagccctgtgtacagctttggatttgagcggctggaggtgctggccgtgtttgccagcacagtgctggcccagctgggcgccctcttcatcctgaaggagagcgctgagcgcttcctggagcagcctgagatccacacaggccgcctgctggtgggcacctttgtggccctgtgcttcaacctcttcaccatgctgagcatccggaacaagccctttgcctacgtgtctgaggccgccagcacctcctggctgcaggagcacgtggccgacctgagccgcagcctgtgtggcatcatccctggcctgagcagcatcttcctgcccaggatgaacccctttgtgctgattgacctggccggggcctttgccctgtgcatcacctacatgctgattgagatcaacaactactttgctgtggacacagccagcgccatcgccatcgccctgatgaccttcggcaccatgtaccccatgtctgtgtacagcggcaaggtgctgctgcagaccaccccacctcatgtgattggccagctggacaagctgatccgggaggccggctctgtgcacgtgcgcatcagaagagatgccaatgagcagatggtgctggcccacgtgaccaacagactctacaccctggtgtccaccctgactgtgcagatcttcaaggatgactggatccggcctgccctgctgagcggccctgtggccgccaacgtgctgaacttcagtgaccaccacgtgatccccatgcccctgctgaagggcacagatgacctgaaccctgtgaccagcaccccagccaagcccagcagccccccacctgagttctccttcaacaccccaggcaagaatgtgaaccctgtgatcctgctgaacacccagacccggccctacggcttcggcctgaaccacggccacaccccctacagctccatgctgaaccagggcctgggcgtgcccggcatcggggccacccagggcctgaggacaggcttcaccaacatccccagccgctatggcaccaacaacagaattggccagccccggccctag

SEQ ID NO: 170630 - DNA, 1299 bp, Artificial Sequence
  Description of Artificial Sequence: Synthetic coding sequence
atgtcctggaagatcctgctgtttggagtcatcaacctgatctgcaccggcttcctgctgatgtggtgcagcagcaccaacagcatcgccctgacagcctacacctacctgaccatctttgacctcttcagcctgatgacctgcctgatctcctactgggtgaccctgaggaagcccagccctgtgtacagctttggatttgagcggctggaggtgctggccgtgtttgccagcacagtgctggcccagctgggcgccctcttcatcctgaaggagagcgctgagcgcttcctggagcagcctgagatccacacaggccgcctgctggtgggcacctttgtggccctgtgcttcaacctcttcaccatgctgagcatccggaacaagccctttgcctacgtgtctgaggccgccagcacctcctggctgcaggagcacgtggccgacctgagccgcagcctgtgtggcatcatccctggcctgagcagcatcttcctgcccaggatgaacccctttgtgctgattgacctggccggggcctttgccctgtgcatcacctacatgctgattgagatcaacaactactttgctgtggacacagccagcgccatcgccatcgccctgatgaccttcggcaccatgtaccccatgtctgtgtacagcggcaaggtgctgctgcagaccaccccaccccacgtgattggccagctggacaagctgatccgggaggtgtccaccctggatggagtgctggaggtgagaaatgagcacttctggaccctgggcttcggcagcctggccggctctgtgcacgtgcgcatcagaagagatgccaatgagcagatggtgctggcccacgtgaccaacagactctacaccctggtgtccaccctgactgtgcagatcttcaaggatgactggatccggcctgccctgctgagcggccctgtggccgccaacgtgctgaacttcagtgaccaccacgtgatccccatgcccctgctgaagggcacagatgacctgaaccctgtgaccagcaccccagccaagcccagcagccccccacctgagttctccttcaacaccccaggcaagaatgtgaaccctgtgatcctgctgaacacccagacccggccctacggcttcggcctgaaccacggccacaccccctacagctccatgctgaaccagggcctgggcgtgcccggcatcggggccacccagggcctgaggacaggcttcaccaacatccccagccgctatggcaccaacaacagaattggccagccccggccctag

SEQ ID NO: 170631 - DNA, 1131 bp, Artificial Sequence
  Description of Artificial Sequence: Synthetic coding sequence
atgctgcccctgagcatcaaggatgatgagtacaagccacccaagttcaacctgtttgggaagatcagcggctggttccgcagcatcctgagtgacaagaccagcaggaacctcttcttcttcctgtgcctgaacctgagctttgcctttgtggagctgctgtatggcatctggagcaactgcctgggcctcatcagtgacagcttccacatgttctttgacagcacagccatcctggccggcctggccgccagcgtcatcagcaagtggagggacaatgatgccttctcctatggctacgtgcgggcagaggtgctggccggctttgtgaatggcctcttcctgatcttcaccgccttcttcatcttcagcgagggcgtggagcgggccctggcccccccagatgtgcaccacgagcggctgctgctggtgtccatcctgggctttgtggtgaacctgattggcatctttgtgttcaagcatggaggccacggccacagccacggcagcggccacggccacagccacagcctcttcaacggggccctggaccaggcccacggccacgtggaccactgccacagccatgaggtgaagcacggggccgcccacagccatgaccacgcccacggccacggccacttccacagccatgatggccccagcctgaaggagaccaccggccccagccggcagatcctgcagggcgtcttcctgcacatcctggccgacaccctgggcagcattggagtcatcgccagcgccatcatgatgcagaactttggcctgatgattgctgaccccatctgcagcatcctgattgccatcctgattgtggtgtctgtcatccccctgctgcgggagagcgtgggcatcctgatgcagaggaccccacccctgctggagaacagcctgccccagtgctaccagagggtgcagcagctgcagggcgtgtacagcctgcaggagcagcacttctggaccctgtgcagtgatgtgtatgtgggcaccctgaagctgattgtggccccagatgctgatgcccgctggatcctgagccagacccacaacatcttcacccaggccggcgtgcggcagctgtatgtgcagattgactttgctgccatgtag

SEQ ID NO: 170632 - DNA, 273 bp, Artificial Sequence
  Description of Artificial Sequence: Synthetic coding sequence
tgagtcatccccctgctgcgggagagcgtgggcatcctgatgcagaggaccccacccctgctggagaacagcctgccccagtgctaccagagggtgcagcagctgcagggcgtgtacagcctgcaggagcagcacttctggaccctgtgcagtgatgtgtatgtgggcaccctgaagctgattgtggccccagatgctgatgcccgctggatcctgagccagacccacaacatcttcacccagaagctggaggaggagaatgaaaacctgtag

SEQ ID NO: 170633 - DNA, 1131 bp, Artificial Sequence; identical to SEQ ID NO: 170631
  Description of Artificial Sequence: Synthetic coding sequence

SEQ ID NO: 170634 - DNA, 963 bp, Artificial Sequence
  Description of Artificial Sequence: Synthetic coding sequence
atgtaccactgccacagcggcagcaagcccacagagaagggggccaatgaatatgcctatgccaagtggaagctgtgcagcgccagcgccatctgcttcatcttcatgattgctgaggtggtgggcggccacatcgccggcagcctggccgtggtgacagatgctgcccacctgctgattgacctgaccagcttcctgctgagcctcttcagcctgtggctgagcagcaagccacccagcaagaggctgaccttcggctggcacagagctgagatcctgggcgccctgctgagcatcctgtgcatctgggtggtgactggagtgctggtgtacctggcctgtgagcggctgctgtacccagactaccagatccaggccaccgtgatgatcatcgtgagcagctgtgctgtggccgccaacatcgtgctgactgtggtgctgcaccagcgctgcctgggccacaaccacaaggaggtgcaggccaatgcctctgtgcgggccgcctttgtgcacgccctgggggacctcttccagagcatctctgtgctgatcagcgccctgatcatctacttcaagccagagtacaagattgctgaccccatctgcaccttcatcttcagcatcctggtgctggccagcaccatcaccatcctgaaggacttcagcatcctgctgatggagggcgtgcccaagagcctgaactacagcggcgtgaaggagctgatcctggccgtggatggagtgctgtctgtgcacagcctgcacatctggagcctgaccatgaaccaggtgatcctgagcgcccacgtggccacagctgccagccgggacagccaggtggtgcggcgggagatcgccaaggccctgagcaagagcttcaccatgcacagcctgaccatccagatggagagccctgtggaccaggaccctgactgcctcttctgtgaggacccctgtgactag

SEQ ID NO: 170635 - DNA, 1110 bp, Artificial Sequence
  Description of Artificial Sequence: Synthetic coding sequence
atggagttcctggagaggacctacctggtgaatgacaaggccgccaagatgtatgccttcaccctggagagcgtggagctgcagcagaagcctgtgaacaaggaccagtgcccccgggagaggcctgaggagctggagagcggcggcatgtaccactgccacagcggcagcaagcccacagagaagggggccaatgaatatgcctatgccaagtggaagctgtgcagcgccagcgccatctgcttcatcttcatgattgctgaggtggtgggcggccacatcgccggcagcctggccgtggtgacagatgctgcccacctgctgattgacctgaccagcttcctgctgagcctcttcagcctgtggctgagcagcaagccacccagcaagaggctgaccttcggctggcacagagctgagatcctgggcgccctgctgagcatcctgtgcatctgggtggtgactggagtgctggtgtacctggcctgtgagcggctgctgtacccagactaccagatccaggccaccgtgatgatcatcgtgagcagctgtgctgtggccgccaacatcgtgctgactgtggtgctgcaccagcgctgcctgggccacaaccacaaggaggtgcaggccaatgcctctgtgcgggccgcctttgtgcacgccctgggggacctcttccagagcatctctgtgctgatcagcgccctgatcatctacttcaagccagagtacaagattgctgaccccatctgcaccttcatcttcagcatcctggtgctggccagcaccatcaccatcctgaaggacttcagcatcctgctgatggagggcgtgcccaagagcctgaactacagcggcgtgaaggagctgatcctggccgtggatggagtgctgtctgtgcacagcctgcacatctggagcctgaccatgaaccaggtgatcctgagcgcccacgtggccacagctgccagccgggacagccaggtggtgagaagagagatcgccaaggccctgagcaagagcttcaccatgcacagcctgaccatccagatggagagccctgtggaccaggaccctgactgcctcttctgtgaggacccctgtgactag

SEQ ID NO: 170636 - DNA, 1458 bp, Artificial Sequence
  Description of Artificial Sequence: Synthetic coding sequence
atgggccgctacagcggcaagacctgccgcctgctcttcatgctggtgctgactgtggccttctttgtggccgagctggtgtctggctacctgggcaacagcatcgccctgctgagtgacagcttcaacatgctgagtgacctgatcagcctgtgtgtgggcctgtctgctggctacatcgcccggcggcccacccggggcttcagcgccacctacggctacgcccgggcagaggtggtgggcgccctgagcaatgctgtgttcctgacagccctgtgcttcaccatctttgtggaggccgtgctgcggctggcccggcctgagagaattgatgatcctgagctggtgctgattgtgggcgtgctgggcctgctggtgaatgtggtgggcctgctgatcttccaggactgtgccgcctggtttgcctgctgcctgcggggccgcagccggcggctgcagcagaggcagcagctggccgagggctgtgtgcctggggcctttggaggcccccagggcgctgaggaccccaggagagctgctgaccccacagcccctggcagtgacagcgctgtgaccctgcggggcacctctgtggagaggaagcgggagaagggggccaccgtgtttgccaacgtggccggggacagcttcaacacccagaatgaacctgaggacatgatgaagaaggagaagaagtctgaggccctgaacatccggggcgtgctgctgcacgtgatgggagatgccctgggctctgtggtggtggtgatcacagccatcatcttctacgtgctgcccctgaagtctgaggacccctgcaactggcagtgctacatcgaccccagcctgactgtgctgatggtgatcatcatcctgagcagcgccttccccctcatcaaggagacagctgccatcctgctgcagatggtgcccaagggcgtgaacatggaggagctgatgagcaagctgtctgctgtgcccggcatcagctctgtgcatgaggtgcacatctgggagctggtgtctgggaagatcatcgccaccctgcacatcaagtaccccaaggaccggggctaccaggatgccagcaccaagatccgggagatcttccaccacgccggcatccacaacgtgaccatccagtttgaaaatgtggacctgaaggagcccctggagcagaaggacctgctgctgctgtgcaacagcccctgcatcagcaagggctgtgccaagcagctgtgctgccccccaggggccctgcccctggcccacgtgaatggctgtgccgagcacaacggcggccccagcctggacacctacggcagtgatggcctgagcagaagagatgcccgggaggtggccatcgaggtgtccctggacagctgcctgagtgaccacggccagagcctgaacaagacccaggaggaccagtgctacgtgaacagaacccacttctag

SEQ ID NO: 170637 - DNA, 723 bp, Artificial Sequence
  Description of Artificial Sequence: Synthetic coding sequence
atgggagatgccctgggctctgtggtggtggtgatcacagccatcatcttctacgtgctgcccctgaagtctgaggacccctgcaactggcagtgctacatcgaccccagcctgactgtgctgatggtgatcatcatcctgagcagcgccttccccctcatcaaggagacagctgccatcctgctgcagatggtgcccaagggcgtgaacatggaggagctgatgagcaagctgtctgctgtgcccggcatcagctctgtgcatgaggtgcacatctgggagctggtgtctgggaagatcatcgccaccctgcacatcaagtaccccaaggaccggggctaccaggatgccagcaccaagatccgggagatcttccaccacgccggcatccacaacgtgaccatccagtttgaaaatgtggacctgaaggagcccctggagcagaaggacctgctgctgctgtgcaacagcccctgcatcagcaagggctgtgccaagcagctgtgctgccccccaggggccctgcccctggcccacgtgaatggctgtgccgagcacaatggaggccccagcctggacacctacggcagtgatggcctgagcagaagagatgcccgggaggtggccatcgaggtgtccctggacagctgcctgagtgaccacggccagagcctgaacaagacccaggaggaccagtgctacgtgaacagaacccacttctag

SEQ ID NO: 170638 - DNA, 672 bp, Artificial Sequence
  Description of Artificial Sequence: Synthetic coding sequence
atgggccgctacagcggcaagacctgccgcctgctcttcatgctggtgctgactgtggccttctttgtggccgagctggtgtctggctacctgggcaacagcatcgccctgctgagtgacagcttcaacatgctgagtgacctgatcagcctgtgtgtgggcctgtctgctggctacatcgcccggcggcccacccggggcttcagcgccacctacggctacgcccgggcagaggtggtgggcgccctgagcaatgctgtgttcctgacagccctgtgcttcaccatctttgtggaggccgtgctgcggctggcccggcctgagagaattgatgatcctgagctggtgctgattgtgggcgtgctgggcctgctggtgaatgtggtgggcctgctgatcttccaggactgtgccgcctggtttgcctgctgcctgcggggccgcagccggcggctgcagcagaggcagcagctggccgagggctgtgtgcctggggcctttggaggcccccagggcgctgaggaccccaggagagctgctgaccccacagcccctggcagtgacagcgctgtgaccctgcggggcacctctgtggagaggaagcgggagaagggggccaccgtgtttgccaacgtggccgagctgatccacaacacccgcttcctgctgtag

SEQ ID NO: 170639 - DNA, 567 bp, Artificial Sequence
  Description of Artificial Sequence: Synthetic coding sequence
atggaccacagccaccacatgggcatgagctacatggacagcaacagcaccatgcagcccagccaccaccaccccaccaccagcgccagccacagccatggaggaggagacagctccatgatgatgatgcccatgaccttctacttcggcttcaagaatgtggagctgctcttcagcggcctggtgatcaacacagctggggagatggccggggcctttgtggccgtgttcctgctggccatgttttatgagggcctgaagatcgcccgggagagcctgctgaggaagagccaggtgtccatccgctacaacagcatgcctgtgcccggccccaacggcaccatcctgatggagacccacaagacagtgggccagcagatgctgtccttcccccacctgctgcagacctgctgggactacagacatgagcccccccacctgagcctgagccccagctactacagcgacctgaactaccccaagaaggccaaggtgctgctgcgggtgtctgtggagctgatgatccaggaggccctgatgatcacagctggggacagcctgtgctag

SEQ ID NO: 170640 - DNA, 573 bp, Artificial Sequence
  Description of Artificial Sequence: Synthetic coding sequence
atggaccacagccaccacatgggcatgagctacatggacagcaacagcaccatgcagcccagccaccaccaccccaccaccagcgccagccacagccatggaggaggagacagctccatgatgatgatgcccatgaccttctacttcggcttcaagaatgtggagctgctcttcagcggcctggtgatcaacacagctggggagatggccggggcctttgtggccgtgttcctgctggccatgttttatgagggcctgaagatcgcccgggagagcctgctgaggaagagccaggtgtccatccgctacaacagcatgcctgtgcccggccccaacggcaccatcctgatggagacccacaagacagtgggccagcagatgctgtccttcccccacctgctgcagacagtgctgcacatcatccaggtggtgatctcctacttcctgatgctgatcttcatgacctacaacggctacctgtgcatcgctgtggccgccggggccggcaccggctacttcctgttctcctggaagaaggctgtggtggtggacatcacagagcactgccactag

SEQ ID NO: 170641 - DNA, 432 bp, Artificial Sequence
  Description of Artificial Sequence: Synthetic coding sequence
atggccatgcacttcatcttcagtgacacagctgtgctgctgtttgacttctggagcgtgcacagccctgctggcatggccctgtctgtgctggtgctgctgctgctggccgtgctgtatgagggcatcaaggtgggcaaggccaagctgctgaaccaggtgctggtgaacctgcccaccagcatcagccagcagaccatcgccgagacagatggagacagcgctggcagtgacagcttccctgtgggccgcacccaccaccgctggtacctgtgccacttcggccagagcctcatccacgtgatccaggtggtgattggctacttcatcatgctggccgtgatgagctacaacacctggatcttcctgggcgtggtgctgggcagcgctgtgggctactacctggcctaccccctgctgagcacagcctag

SEQ ID NO: 170642 - DNA, 1650 bp, Artificial Sequence
  Description of Artificial Sequence: Synthetic coding sequence
atgagccccaccatcagccacaaggacagcagccggcagaggcggcccggcaacttcagccacagcctggacatgaagagcggccccctgcccccaggcggctgggatgacagccacctggacagcgctggccgggagggggaccgggaggccctgctgggggacaccggcaccggggacttcctgaaggccccccagagcttccgggcagagctgagcagcatcctgctgctgctcttcctgtatgtgctgcagggcatccccctgggcctggccggcagcatccccctcatcctgcagagcaagaatgtgtcctacacagaccaggccttcttctcctttgtgttctggcccttcagcctgaagctgctgtgggcccccctggtggatgctgtgtatgtgaagaactttggaagaaggaagtcctggctggtgcccacccagtacatcctgggcctcttcatgatctacctgagcacccaggtggaccggctgctgggcaacacagatgacaggaccccagatgtgattgccctgactgtggccttcttcctgtttgagttcctggccgccacccaggacattgctgtggatggctgggccctgaccatgctgagccgggagaatgtgggctacgccagcacctgcaacagcgtgggccagacagctggctacttcctgggcaatgtgctcttcctggccctggagagcgctgacttctgcaacaagtacctgcgcttccagccccagccccggggcatcgtgaccctgagtgacttcctgttcttctggggcaccgtcttcctgatcaccaccaccctggtggccctgctgaagaaggaaaatgaggtgtctgtggtgaaggaggagacccagggcatcacagacacctacaagctgctgtttgccatcatcaagatgcctgctgtgctgaccttctgcctgctgatcctgacagccaagattggcttctctgctgctgatgctgtgacaggcctgaagctggtggaggagggcgtgcccaaggagcacctggccctgctggccgtgcccatggtgcccctgcagatcatcctgcccctcatcatcagcaagtacacagctggcccccagcccctgaacaccttctacaaggccatgccctaccgcctgctgctgggcctggagtatgccctgctggtgtggtggacccccaaggtggagcaccagggcggcttccccatctactactacatcgtggtgctgctgtcctatgccctgcaccaggtgacagtgtacagcatgtatgtgtccatcatggccttcaatgccaaggtgtctgaccccctcatcggcggcacctacatgaccctgctgaacacagtgagcaacctgggcggcaactggcccagcacagtggccctgtggctggtggaccccctgactgtgaaggaatgtgtgggcgccagcaaccagaactgcaggaccccagatgctgtggagctgtgcaagaagctgggcggcagctgtgtgacagccctggatggctactacgtggagagcatcatctgtgtgttcatcggcttcggctggtggttcttcctgggccccaagttcaagaagctgcaggatgagggcagcagctcctggaagtgcaagaggaacaactag

SEQ ID NO: 170643 - DNA, 1650 bp, Artificial Sequence; identical to SEQ ID NO: 170642
  Description of Artificial Sequence: Synthetic coding sequence

SEQ ID NO: 170644 - DNA, 1920 bp, Artificial Sequence
  Description of Artificial Sequence: Synthetic coding sequence
atgctgtcctatggagagcggctgggcagccctgctgtgagccccctgcctgtgcggggcggccacgtgatgaggggcacagcctttgcctacgtgcccagcccccaggtgctgcaccgcatccctggcaccagcgcctatgccttccccagcctgggccctgtggccctggccgagcacacctgcccctgtggggaggtgctggagagacatgagcccctgcctgccaagctggccctggaggaggagcagaagccagagagccggctggtgcccaagctgcggcaggccggggccatgctgctgaaggtgcccctgatgctgaccttcctgtacctgtttgtgtgcagcctggacatgctgagcagcgccttccagctggccggcggcaaggtggccggggacatcttcaaggacaatgccatcctgagcaaccctgtggccggcctggtggtgggcatcctggtgacagtgctggtgcagagcagcagcaccagcaccagcatcatcgtgtccatggtgagcagcggcctgctggaggtgtcctctgccatccccatcatcatgggcagcaacatcggcacctctgtgaccaacaccatcgtggccctgatgcaggccggggacagaacagacttccggcgggcctttgctggggccaccgtgcatgactgcttcaactggctgtctgtgctggtgctgctgcccctggaggccgccaccggctacctgcaccacatcacccggctggtggtggccagcttcaacatccacggcggcagagatgccccagacctgctgaagatcatcacagagcccttcaccaagctgatcatccagctggatgagagcgtcatcaccagcatcgccactggagatgagagcctgaggaaccacagcctcatccagatctggtgccacccagacagcctgcaggcccccacctccatgagcagagctgaggccaacagcagccagaccctgggcaatgccaccatggagaagtgcaaccacatctttgtggacaccggcctgcctgacctggccgtgggcctcatcctgctggccggcagcctggtgctgctgtgcacctgcctgatcctgctggtgaagatgctgaacagcctgctgaagggccaggtggccaaggtgatccagaaggtgatcaacacagacttccctgcccccttcacctgggtgacaggctactttgccatggtggtgggcgcctccatgacctttgtggtgcagagcagcagcgtcttcaccagcgccatcacccccctcatcggcctgggcgtcatcagcattgagcgggcctaccccctgaccctgggcagcaacatcggcaccaccaccacagccatcctggccgccctggccagcccccgggagaagctgagcagcgccttccagatcgccctgtgccacttcttcttcaacatcagcggcatcctgctgtggtaccctgtgccctgcacccggctgcccatccgcatggccaaggccctgggcaagaggacagccaagtaccgctggtttgctgtgctgtacctgctggtgtgcttcctgctgctgcccagcctggtgtttggcatctccatggccggctggcaggtgatggtgggcgtgggcaccccatttggagccctgctggcctttgtggtgctgatcaacgtgctgcagagccgcagccctggccacctgcccaagtggctgcagacctgggacttcctgccccgctggatgcacagcctgaagcccctggaccacctgatcacccgggccaccctgtgctgtgcccggcctgagcccaggagcccccccctgccccccagggtcttcctggaggagctgcccccagccacccccagcccccggctggccctgcctgcccaccacaatgccacccggctgtag

SEQ ID NO: 170645 - DNA, 330 bp, Artificial Sequence
  Description of Artificial Sequence: Synthetic coding sequence
atgctgtcctatggagagcggctgggcagccctgctgtgagccccctgcctgtgcggggcggccacgtgatgaggggcacagcctttgcctacgtgcccagcccccaggtgctgcaccgcatccctggcaccagcgcctatgccttccccagcctgggccctgtggccctggccgagcacacctgcccctgtggggaggtgctggagagacatgagcccctgcctgccaagctggccctggaggaggagcagaagccagagagccggctggtgcccaagctgcggcaggccggggccatgctgctgaaggtgcccctgatgctgacctag

SEQ ID NO: 170646 - DNA, 1023 bp, Artificial Sequence
  Description of Artificial Sequence: Synthetic coding sequence
atgctgtcctatggagagcggctgggcagccctgctgtgagccccctgcctgtgcggggcggccacgtgatgaggggcacagcctttgcctacgtgcccagcccccaggtgctgcaccgcatccctggcaccagcgcctatgccttccccagcctgggccctgtggccctggccgagcacacctgcccctgtggggaggtgctggagagacatgagcccctgcctgccaagctggccctggaggaggagcagaagccagagagccggctggtgcccaagctgcggcaggccggggccatgctgctgaaggtgcccctgatgctgaccttcctgtacctgtttgtgtgcagcctggacatgctgagcagcgccttccagctggccggcggcaaggtggccggggacatcttcaaggacaatgccatcctgagcaaccctgtggccggcctggtggtgggcatcctggtgacagtgctggtgcagagcagcagcaccagcaccagcatcatcgtgtccatggtgagcagcggcctgctggaggtgtcctctgccatccccatcatcatgggcagcaacatcggcacctctgtgaccaacaccatcgtggccctgatgcaggccggggacagaacagacttccggcgggcctttgctggggccaccgtgcatgactgcttcaactggctgtctgtgctggtgctgctgcccctggaggccgccaccggctacctgcaccacatcacccggctggtggtggccagcttcaacatccacggcggcagagatgccccagacctgctgaagatcatcacagagcccttcaccaagctgatcatccagctggatgagagcgtcatcaccagcatcgccactggagatgagagcctgaggaaccacagcctcatccagatctggtgccacccagacagcctgcagcagaacctggagggccgggagatcacccactttgacctgaggaagaagcaggccatggaggacagctctgtgccccactgcccctag

SEQ ID NO: 170647 - DNA, 2073 bp, Artificial Sequence
  Description of Artificial Sequence: Synthetic coding sequence
atggccccctggccagagctgggagatgcccagcccaacccagacaagtacctggagggcgccgccggccagcagcccacagccccagacaagagcaaggagaccaacaagacagacaacacagaggcccctgtgaccaagattgagctgctgcccagctacagcacagccaccctgattgatgagcccacagaggtggatgacccctggaacctgcccaccctgcaggacagcggcatcaagtggagcgagcgggacaccaagggcaagatcctgtgcttcttccagggcatcggccgcctcatcctgctgctgggcttcctgtacttctttgtgtgcagcctggacatcctgagcagcgccttccagctggtgggcggcaagatggccggccagttcttcagcaacagcagcatcatgagcaaccccctgctgggcctggtgattggagtgctggtgacagtgctggtgcagagcagcagcaccagcaccagcatcgtggtgtccatggtgagcagcagcctgctgactgtgcgggccgccatccccatcatcatgggcgccaacatcggcaccagcatcaccaacaccatcgtggccctgatgcaggtgggggacagaagtgagttcagaagagcctttgctggggccaccgtgcatgacttcttcaactggctgtctgtgctggtgctgctgcctgtggaggtggccacccactacctggagatcatcacccagctgattgtggagagcttccacttcaagaatggagaagatgccccagacctgctgaaggtgatcaccaagcccttcaccaagctgattgtgcagctggacaagaaggtgatcagccagatcgccatgaatgatgagaaggccaagaacaagagcctggtgaagatctggtgcaagaccttcaccaacaagacccagatcaacgtgacagtgcccagcacagccaactgcaccagccccagcctgtgctggacagatggcatccagaactggaccatgaagaatgtgacctacaaggaaaatattgccaagtgccagcacatctttgtgaacttccacctgcctgacctggccgtgggcaccatcctgctgatcctgagcctgctggtgctgtgtggctgcctgatcatgattgtgaagatcctgggctctgtgctgaagggccaggtggccaccgtcatcaagaagaccatcaacacagacttccccttcccctttgcctggctgaccggctacctggccatcctggtgggcgccggcatgaccttcatcgtgcagagcagcagcgtcttcaccagcgccctgacccccctcatcggcatcggggtcatcaccatcgagcgggcctaccccctgaccctgggcagcaacatcggcaccaccaccacagccatcctggccgccctggccagccctggaaatgccctgcggagcagcctgcagatcgccctgtgccacttcttcttcaacatcagcggcatcctgctgtggtaccccatccccttcacccggctgcccatccgcatggccaagggcctgggcaacatcagcgccaagtaccgctggtttgctgtgttctacctgatcatcttcttcttcctgatccccctgactgtgtttggcctgagcctggccggctggagggtgctggtgggcgtgggcgtgcctgtggtgttcatcatcatcctggtgctgtgcctgcggctgctgcagagccgctgcccccgggtgctgcccaagaagctgcagaactggaacttcctgcccctgtggatgaggagcctgaagccctgggatgctgtggtgtccaagttcaccggctgcttccagatgcgctgctgctgctgctgccgggtgtgctgccgggcctgctgcctgctgtgtgactgccccaagtgctgccgctgcagcaagtgctgtgaggacctggaggaggcccaggagggccaggatgtgcctgtgaaggcccctgagacctttgacaacatcaccatcagccgggaggcccagggcgaggtgcctgccagtgacagcaagacagagtgcacagccctgtag

SEQ ID NO: 170648 - DNA, 2070 bp, Artificial Sequence
  Description of Artificial Sequence: Synthetic coding sequence
atggccccctggccagagctgggagatgcccagcccaacccagacaagtacctggagggcgccgccggccagcagcccacagccccagacaagagcaaggagaccaacaagaacaacacagaggcccctgtgaccaagattgagctgctgcccagctacagcacagccaccctgattgatgagcccacagaggtggatgacccctggaacctgcccaccctgcaggacagcggcatcaagtggagcgagcgggacaccaagggcaagatcctgtgcttcttccagggcatcggccgcctcatcctgctgctgggcttcctgtacttctttgtgtgcagcctggacatcctgagcagcgccttccagctggtgggcggcaagatggccggccagttcttcagcaacagcagcatcatgagcaaccccctgctgggcctggtgattggagtgctggtgacagtgctggtgcagagcagcagcaccagcaccagcatcgtggtgtccatggtgagcagcagcctgctgactgtgcgggccgccatccccatcatcatgggcgccaacatcggcaccagcatcaccaacaccatcgtggccctgatgcaggtgggggacagaagtgagttccggcgggcctttgctggggccaccgtgcatgacttcttcaactggctgtctgtgctggtgctgctgcctgtggaggtggccacccactacctggagatcatcacccagctgattgtggagagcttccacttcaagaatggagaagatgccccagacctgctgaaggtgatcaccaagcccttcaccaagctgattgtgcagctggacaagaaggtgatcagccagatcgccatgaatgatgagaaggccaagaacaagagcctggtgaagatctggtgcaagaccttcaccaacaagacccagatcaacgtgacagtgcccagcacagccaactgcaccagccccagcctgtgctggacagatggcatccagaactggaccatgaagaatgtgacctacaaggagaacatcgccaagtgccagcacatctttgtgaacttccacctgcctgacctggccgtgggcaccatcctgctgatcctgagcctgctggtgctgtgtggctgcctgatcatgattgtgaagatcctgggctctgtgctgaagggccaggtggccaccgtcatcaagaagaccatcaacacagacttccccttcccctttgcctggctgaccggctacctggccatcctggtgggcgccggcatgaccttcatcgtgcagagcagctctgtgttcaccagcgccctgacccccctgattggaattggagtcatcaccatcgagcgggcctaccccctgaccctgggcagcaacatcggcaccaccaccacagccatcctggccgccctggccagccctggaaatgccctgcggagcagcctgcagatcgccctgtgccacttcttcttcaacatcagcggcatcctgctgtggtaccccatccccttcacccggctgcccatccgcatggccaagggcctgggcaacatcagcgccaagtaccgctggtttgctgtgttctacctgatcatcttcttcttcctgatccccctgactgtgtttggcctgagcctggccggctggagggtgctggtgggcgtgggcgtgcctgtggtgttcatcatcatcctggtgctgtgcctgcggctgctgcagagccgctgcccccgggtgctgcccaagaagctgcagaactggaacttcctgcccctgtggatgaggagcctgaagccctgggatgctgtggtgtccaagttcaccggctgcttccagatgcgctgctgctgctgctgccgggtgtgctgccgggcctgctgcctgctgtgtgactgccccaagtgctgccgctgcagcaagtgctgtgaggacctggaggaggcccaggagggccaggatgtgcctgtgaaggcccctgagacctttgacaacatcaccatcagccgggaggcccagggcgaggtgcctgccagtgacagcaagacagaatgtacagccctgtag

SEQ ID NO: 170649 - DNA, 2070 bp, Artificial Sequence; identical to SEQ ID NO: 170648
  Description of Artificial Sequence: Synthetic coding sequence

SEQ ID NO: 170650 - DNA, 486 bp, Artificial Sequence
  Description of Artificial Sequence: Synthetic coding sequence
atggccccctggccagagctgggagatgcccagcccaacccagacaagtacctggagggcgccgccggccagcagcccacagccccagacaagagcaaggagaccaacaagacagacaacacagaggcccctgtgaccaagattgagctgctgcccagctacagcacagccaccctgattgatgagcccacagaggtggatgacccctggaacctgcccaccctgcaggacagcggcatcaagtggagcgagcgggacaccaagggcaagatcctgtgcttcttccagggcatcggccgcctcatcctgctgctgggcttcctgtacttctttgtgtgcagcctggacatcctgagcagcgccttccagctggtgggcggcaagatggccggccagttcttcagcaacagcagcatcatgagcaaccccctgctgggcctggtgattggagtgctggtgacagtgctggtgcagagcagcagctag

SEQ ID NO: 170651 - DNA, 492 bp, Artificial Sequence
  Description of Artificial Sequence: Synthetic coding sequence
atggccccctggccagagctgggagatgcccagcccaacccagacaagtacctggagggcgccgccggccagcagcccacagccccagacaagagcaaggagaccaacaagaacaacacagaggcccctgtgaccaagattgagctgctgcccagctacagcacagccaccctgattgatgagcccacagaggtggatgacccctggaacctgcccaccctgcaggacagcggcatcaagtggagcgagcgggacaccaagggcaagatcctgtgcttcttccagggcatcggccgcctcatcctgctgctgggcttcctgtacttctttgtgtgcagcctggacatcctgagcagcgccttccagctggtgggcggcaagatggccggccagttcttcagcaacagcagcatcatgagcaaccccctgctgggcctggtgattggagtgctggtgacagtgctggtgcagagcagcagcaccagcacctag

SEQ ID NO: 170652 - DNA, 1800 bp, Artificial Sequence
  Description of Artificial Sequence: Synthetic coding sequence
atgcccagcagcctgcccggcagccaggtgccccaccccaccctggatgctgtggacctggtggagaagaccctgagaaatgaaggcaccagcagcagcgcccctgtgctggaggagggggacacagacccctggaccctgccccagctgaaggacaccagccagccctggaaggagctgcgggtggccggccgcctgcggcgggtggccggctctgtgctgaaggcctgtggcctgctgggcagcctgtacttcttcatctgcagcctggatgtgctgagcagcgccttccagctgctgggcagcaaggtggccggggacatcttcaaggacaacgtggtgctgagcaaccctgtggccggcctggtgattggagtgctggtgacagccctggtgcagagcagcagcaccagcagcagcatcgtggtgtccatggtggccgccaagctgctgactgtgcgggtgtctgtgcccatcatcatgggcgtgaatgtgggcaccagcatcaccagcaccctggtgtccatggcccagagcggggacagagatgagttccagagggccttcagcggcagcgctgtgcacggcatcttcaactggctgactgtgctggtgctgctgcccctggagagcgccacagccctgctggagcggctgtctgagctggccctgggcgccgccagcctgaccccccgggcccaggccccagacatcctgaaggtgctgaccaagcccctgacccacctgattgtgcagctggacagcgacatgatcatgagcagcgccactggaaatgccaccaacagcagcctcatcaagcactggtgtggcaccaccggccagcccacccaggagaacagcagctgtggggccttcggcccctgcacagagaagaacagcacagccccagctgaccggctgccctgccgccacctgtttgctggaacagagctgacagacctggccgtgggctgcatcctgctggccggcagcctgctggtgctgtgtggctgcctggtgctgattgtgaagctgctgaacagcgtgctgcggggccgggtggcccaggtggtgaggacagtcatcaatgctgacttccccttccccctgggctggctgggcggctacctggccgtgctggccggggccggcctgacctttgccctgcagagcagctctgtgttcaccgctgctgtggtgcccctgatgggcgtgggcgtcatcagcctggaccgggcctaccccctgctgctgggcagcaacatcggcaccaccaccacagccctgctggccgccctggccagccctgctgacaggatgctgagcgccctgcaggtggccctgatccacttcttcttcaacctggccggcatcctgctgtggtacctggtgcctgccctgcggctgcccatccccctggcccggcactttggagtggtgacagcccgctaccgctgggtggccggcgtgtacctgctgctgggcttcctgctgctgcccctggccgccttcggcctgagcctggccggcggcatggagctggccgctgtgggcggccccctggtgggcctggtgctgctggtgatcctggtgacagtgctgcagaggagaagacctgcctggctgcctgtgcggctgcgctcctgggcctggctgcctgtgtggctgcacagcctggagccctgggaccggctggtgacccgctgctgcccctgcaatgtgtgcagcccccccaaggccaccaccaaggaggcctactgctatgaaaatcctgagatcctggccagccagcagctgtag

SEQ ID NO: 170653 - DNA, 1800 bp, Artificial Sequence; identical to SEQ ID NO: 170652
  Description of Artificial Sequence: Synthetic coding sequence

SEQ ID NO: 170654 - DNA, 570 bp, Artificial Sequence
  Description of Artificial Sequence: Synthetic coding sequence
atgaccctgatggctgctgtgtacaccatcgccctgcgctacaccaggaccagtgacaaggagctgtacttcagcaccacagctgtgtgcatcacagaggtgatcaagctgctgctgtctgtgggcatcctggccaaggagaccggcagcctgggccgcttcaaggccagcctgcgggagaatgtgctgggcagccccaaggagctgctgaagctgtctgtgcccagcctggtgtatgctgtgcagaacaacatggccttcctggccctgagcaacctggatgctgctgtgtaccaggtgacctaccagctgaagatcccctgcacagccctgtgcaccgtgctgatgctgaacagaaccctgagcaagctgcagtgggtgtctgtgttcatgctgtgtgccggcgtgaccctggtgcagtggaagccagcccaggccaccaaggtggtggagtacatcctgaagaagttcaaggagttccgctacttcagcctgggggagaagcacagcaatgtgtccatccgggactactgtgacatctcctggaggctgctggtgcgctggagctag

SEQ ID NO: 170655 - DNA, 1014 bp, Artificial Sequence
  Description of Artificial Sequence: Synthetic coding sequence
atggccgccccccgggacaacgtgaccctgctcttcaagctgtactgcctggccgtgatgaccctgatggctgctgtgtacaccatcgccctgcgctacaccaggaccagtgacaaggagctgtacttcagcaccacagctgtgtgcatcacagaggtgatcaagctgctgctgtctgtgggcatcctggccaaggagaccggcagcctgggccgcttcaaggccagcctgagagaaaatgtgctgggcagccccaaggagctgctgaagctgtctgtgcccagcctggtgtatgctgtgcagaacaacatggccttcctggccctgagcaacctggatgctgctgtgtaccaggtgacctaccagctgaagatcccctgcacagccctgtgcaccgtgctgatgctgaacagaaccctgagcaagctgcagtgggtgtctgtgttcatgctgtgtgccggcgtgaccctggtgcagtggaagccagcccaggccaccaaggtggtggtggagcagaaccccctgctgggctttggagccatcgccatcgctgtgctgtgcagcggctttgctggggtgtactttgagaaggtgctgaagagcagtgacaccagcctgtgggtgaggaacatccagatgtacctgagcggcatcatcgtgaccctggccggcgtgtacctgagtgatggagctgagatcaaggagaagggcttcttctacggctacacctactacgtgtggtttgtgatcttcctggcctctgtgggcggcctgtacacctctgtggtggtgaagtacacagacaacatcatgaagggcttctctgctgctgctgccatcgtgctgagcaccatcgcctctgtgatgctgtttggcctgcagatcaccctgacctttgccctgggcaccctgctggtgtgtgtgtccatctacctgtatggcctgccccggcaggacaccaccagcatccagcagggcgagacagccagcaaggagcgggtgattggagtgtag

SEQ ID NO: 170656 - DNA, 837 bp, Artificial Sequence
  Description of Artificial Sequence: Synthetic coding sequence
atggccgccccccgggacaacgtgaccctgctcttcaagctgtactgcctggccgtgatgaccctgatggctgctgtgtacaccatcgccctgcgctacaccaggaccagtgacaaggagctgtacttcagcaccacagctgtgtgcatcacagaggtgatcaagctgctgctgtctgtgggcatcctggccaaggagaccggcagcctgggccgcttcaaggccagcctgagagaaaatgtgctgggcagccccaaggagctgctgaagctgtctgtgcccagcctggtgtatgctgtgcagaacaacatggccttcctggccctgagcaacctggatgctgctgtgtaccaggtgacctaccagctgaagatcccctgcacagccctgtgcaccgtgctgatgctgaacagaaccctgagcaagctgcagtgggtgtctgtgttcatgctgtgtgccggcgtgaccctggtgcagtggaagccagcccaggccaccaaggtggtggtggagcagaaccccctgctgggctttggagccatcgccatcgctgtgctgtgcagcggctttgctgtgctggcctctgtgggcggcctgtacacctctgtggtggtgaagtacacagacaacatcatgaagggcttctctgctgctgctgccatcgtgctgagcaccatcgcctctgtgatgctgtttggcctgcagatcaccctgacctttgccctgggcaccctgctggtgtgtgtgtccatctacctgtatggcctgccccggcaggacaccaccagcatccagcagggcgagacagccagcaaggagagggtcatcggcgtgtag

SEQ ID NO: 170657 - DNA, 570 bp, Artificial Sequence
  Description of Artificial Sequence: Synthetic coding sequence
atggccgccccccgggacaacgtgaccctgctcttcaagctgtactgcctggccgtgatgaccctgatggctgctgtgtacaccatcgccctgcgctacaccaggaccagtgacaaggagctgtacttcagcaccacagctgtgtgcatcacagaggtgatcaagctgctgctgtctgtgggcatcctggccaaggagaccggcagcctgggccgcttcaaggccagcctgagagaaaatgtgctgggcagccccaaggagctgctgaagctgtctgtgcccagcctggtgtatgctgtgcagaacaacatggccttcctggccctgagcaacctggatgctgctgtgtaccaggtgacctaccagctgaagatcccctgcacagccctgtgcaccgtgctgatgctgaacagaaccctgagcaagctgcagtgggtgtctgtgttcatgctgtgtgccggcgtgaccctggtgcagtggaagccagcccaggccaccaaggtggtgttcctgcaggtgctggtggccagcaccctgctgctgtggctgagcacccagaccaccagctag

SEQ ID NO: 170658 - DNA, 537 bp, Artificial Sequence
  Description of Artificial Sequence: Synthetic coding sequence
atggccgccccccgggacaacgtgaccctgctcttcaagctgtactgcctggccgtgatgaccctgatggctgctgtgtacaccatcgccctgcgctacaccaggaccagtgacaaggagctgtacttcagcaccacagctgtgtgcatcacagaggtgatcaagctgctgctgtctgtgggcatcctggccaaggagaccggcagcctgggccgcttcaaggccagcctgagagaaaatgtgctgggcagccccaaggagctgctgaagctgtctgtgcccagcctggtgtatgctgtgcagaacaacatggccttcctggccctgagcaacctggatgctgctgtgtaccaggtgacctaccagctgaagatcccctgcacagccctgtgcaccgtgctgatgctgaacagaaccctgagcaagctgcagaagaaggacttctccatggtgacccacatcatgagcggcctgagctctgtgtccatccaggagctgaaggtgctgagccgctccttcatcttcttcctgtcctag

SEQ ID NO: 170659 - DNA, 612 bp, Artificial Sequence
  Description of Artificial Sequence: Synthetic coding sequence
atgctgaacagaaccctgagcaagctgcagtgggtgtctgtgttcatgctgtgtgccggcgtgaccctggtgcagtggaagccagcccaggccaccaaggtggtggtggagcagaaccccctgctgggctttggagccatcgccatcgctgtgctgtgcagcggctttgctggggtgtactttgagaaggtgctgaagagcagtgacaccagcctgtgggtgaggaacatccagatgtacctgagcggcatcatcgtgaccctggccggcgtgtacctgagtgatggagctgagatcaaggagaagggcttcttctacggctacacctactacgtgtggtttgtgatcttcctggcctctgtgggcggcctgtacacctctgtggtggtgaagtacacagacaacatcatgaagggcttctctgctgctgctgccatcgtgctgagcaccatcgcctctgtgatgctgtttggcctgcagatcaccctgacctttgccctgggcaccctgctggtgtgtgtgtccatctacctgtatggcctgccccggcaggacaccaccagcatccagcagggcgagacagccagcaaggagcgggtgattggagtgtag

SEQ ID NO: 170660 - DNA, 1191 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctgcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccaggtgacctaccagctgaagatcctgaccacagccctcttctctgtgctgatgctgaacagaagcctgagccggctgcagtgggccagcctgctgctgctcttcaccggggtggccatcgtgcaggcccagcaggccggcggcggcggcccccggcccctggaccagaaccctggagctggcctggccgctgtggtggccagctgcctgagcagcggctttgctggggtgtactttgagaagatcctgaagggcagcagcggctctgtgtggctgaggaacctgcagctgggcctgtttggaacagccctgggcctggtgggcctgtggtgggccgagggcacagctgtggccacccggggcttcttcttcggctacaccccagctgtgtggggcgtggtgctgaaccaggccttcggcggcctgctggtggccgtggtggtgaagtatgctgacaacatcctgaagggctttgccaccagcctgagcatcgtgctgagcacagtggccagcatccggctgtttggcttccacgtggaccccctgtttgccctgggcgccggcctggtgattggagctgtgtacctgtacagcctgcccaggggggccgccaaggccatcgccagcgccagcgccagcgccagcggcccctgtgtgcaccagcagcccccaggccagcccccaccaccccagctgagcagccacagaggagacctgatcacagagcccttcctgcccaagctgctgaccaaggtgaagggcagctag

SEQ ID NO: 170661 - DNA, 492 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctgcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccaggtgagccccaagcccagcatggcccctgaggagctgaccggcctgggcactggagtgtgggagtag

SEQ ID NO: 170662 - DNA, 657 bp, Artificial Sequence
  Description of Artificial Sequence: Synthetic coding sequence
atgaagctgtgcagagatgcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccagcccagcccccgctgcagccagagccacagcctgtgcctgtgcctgcggctgcgggccctgcggagccctgctgccagccgggccgccaccaccacagctgctgtgtttcctccctggaggccccaccacggggccctgagcgccaaggtgtctgctggggaggtgcgggccggcagcaatggaggcacccagggccggggcaccggggtggagggcgtgggccacctgcaggaccccagccgccaccccccaggccctggcagcagcggcttcggccgctggagcttcctgcccggccactag

SEQ ID NO: 170663 - DNA, 1182 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctgcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccaggtgacctaccagctgaagatcctgaccacagccctcttctctgtgctgatgctgaacagaagcctgagccggctgcagtgggccagcctgctgctgctcttcaccggggtggccatcgtgcaggcccagcaggccggcggcggcggcccccggcccctggaccagaaccctggagctggcctggccgctgtggtggccagctgcctgagcagcggctttgctggggtgtactttgagaagatcctgaagggcagcagcggctctgtgtggctgaggaacctgcagctgggcctgtttggaacagccctgggcctggtgggcctgtggtgggccgagggcacagctgtggccacccggggcttcttcttcggctacaccccagctgtgtggggcgtggtgctgaaccaggccttcggcggcctgctggtggccgtggtggtgaagtatgctgacaacatcctgaagggctttgccaccagcctgagcatcgtgctgagcacagtggccagcatccggctgtttggcttccacgtggaccccctgtttgccctgggcgccggcctggtgattggagctgtgtacctgtacagcctgcccaggggggccgccaaggccatcgccagcgccagcgccagcgccagcggcccctgtgtgcaccagcagcccccaggccagcccccaccaccccagctgagcagccacagaggagacctgatcacagagcccttcctgcccaagtctgtgctggtgaagtag

SEQ ID NO: 170664 - DNA, 675 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctgcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccagcccagcccccgctgcagccagagccacagcctgtgcctgtgcctgcggctgcgggccctgcggagccctgctgccagccgggccgccaccaccacagctgctgtgtttcctccctggaggccccaccacggggccctgagcgccaaggtggcccaccagggcgagggcttcctggccgccggcattgaagatattggcctggccagcttcagcctgctggccctgggccctgctggcaccaagctgtag

SEQ ID NO: 170665 - DNA, 999 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctggaaatgtgaagcacctggtgctcttcctgcatgaagctgtgctggtgcagtatgtggacaccctgaagctggccgtgcccagcctcatctacaccctgcagaacaacctgcagtatgtggccatcagcaacctgcctgctgccaccttccaggtgacctaccagctgaagatcctgaccacagccctcttctctgtgctgatgctgaacagaagcctgagccggctgcagtgggccagcctgctgctgctcttcaccggggtggccatcgtgcaggcccagcaggccggcggcggcggcccccggcccctggaccagaaccctggggccggcctggccgctgtggtggccagctgcctgagcagcggctttgctggggtgtactttgagaagatcctgaagggcagcagcggctctgtgtggctgaggaacctgcagctgggcctgtttggaacagccctgggcctggtgggcctgtggtgggccgagggcacagctgtggccacccggggcttcttcttcggctacaccccagctgtgtggggcgtggtgctgaaccaggcctttggaggcctgctggtggccgtggtggtgaagtatgctgacaacatcctgaagggctttgccaccagcctgagcatcgtgctgagcacagtggccagcatccggctgtttggcttccacgtggaccccctgtttgccctgggcgccggcctggtgattggagctgtgtacctgtacagcctgcccagaggagctgccaaggccatcgccagcgccagcgccagcgccagcggcccctgtgtgcaccagcagcccccaggccagcccccaccaccccagctgagcagccacagaggagacctgatcacagagcccttcctgcccaagtctgtgctggtgaagtag

SEQ ID NO: 170666 - DNA, 729 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctgcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccagcccagcccccgctgcagccagagccacagcctgtgcctgtgcctgcggctgcgggccctgcggagccctgctgccagccgggccgccaccaccacagctgctgtgtttcctccctggaggccccaccacggggccctgagcgccaaggtgtctgctggggaggtgcgggccggcagcaatggaggcacccagggccggggcaccggggtggagggcgtgggccacctgcaggaccccagccgccaccccccaggccctggcagcagcggcttcggccgctggagcttcctgcccggccactag

SEQ ID NO: 170667 - DNA, 531 bp, Artificial Sequence
  Description of Artificial Sequence: Synthetic coding sequence
atggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccaggtgacctaccagctgaagatcctgaccacagccctcttctctgtgctgatgctgaacagaagcctgagccggctgcagtgggccagcctgctgctgctcttcaccggggtggccatcgtgcaggcccagcaggccggcggcggcggcccccggcccctggaccagaaccctggagctggcctggccgctgtggtggccagctgcctgagcagcggctttgctggggtgtactttgagaagatcctgaagggcagcagcggctctgtgtggctgaggaacctgcagctgggcctgtttggaacagccctgggcctggtgtag

SEQ ID NO: 170668 - DNA, 1266 bp, Artificial Sequence
  Description of Artificial Sequence: Synthetic coding sequence
atggctgctgtgggcgctgggggcagcacagctgcccctggccctggagctgtgtctgctggggccctggagcctggaacagccagcgctgagctgctgctgacctgggaggaggccgaggcccggggccagggcctgccccagcccctgcctgacacctctgtgcgcatcccagcccaccggcggctgaagtacatcagcctggccgtgctggtggtgcagaatgccagcctcatcctgagcatccgctatgcccggaccctgcccggggaccgcttctttgccaccacagctgtggtgatggccgaggtgctgaagggcctgacctgcctgctgctgctgtttgcccagaagagaggaaatgtgaagcacctggtgctcttcctgcacgaggccgtgctggtgcagtatgtggacaccctgaagctggccgtgcccagcctcatctacaccctgcagaacaacctgcagtatgtggccatcagcaacctgcctgctgccaccttccaggtgacctaccagctgaagatcctgaccacagccctcttctctgtgctgatgctgaacagaagcctgagccggctgcagtgggccagcctgctgctgctcttcaccggggtggccatcgtgcaggcccagcaggccggcggcggcggcccccggcccctggaccagaaccctggagctggcctggccgctgtggtggccagctgcctgagcagcggctttgctggggtgtactttgagaagatcctgaagggcagcagcggctctgtgtggctgaggaacctgcagctgggcctgtttggaacagccctgggcctggtgggcctgtggtgggccgagggcacagctgtggccacccggggcttcttcttcggctacaccccagctgtgtggggcgtggtgctgaaccaggccttcggcggcctgctggtggccgtggtggtgaagtatgctgacaacatcctgaagggctttgccaccagcctgagcatcgtgctgagcacagtggccagcatccggctgtttggcttccacgtggaccccctgtttgccctgggcgccggcctggtgattggagctgtgtacctgtacagcctgcccaggggggccgccaaggccatcgccagcgccagcgccagcgccagcggcccctgtgtgcaccagcagcccccaggccagcccccaccaccccagctgagcagccacagaggagacctgatcacagagcccttcctgcccaagtctgtgctggtgaagtag

SEQ ID NO: 170669 - DNA, 1068 bp, Artificial Sequence
  Description of Artificial Sequence: Synthetic coding sequence
atggccgaggtgcaccggcggcagcacgcccgggtgaagggggaggccccagccaagagcagcaccctgagagatgaggaggagctgggcatggccagcgctgagaccctgaccgtcttcctgaagctgctggccgccggcttctatggagtgtcctccttcctgattgtggtggtgaacaagtctgtgctgaccaactaccgcttccccagcagcctgtgtgtgggcctgggccagatggtggccaccgtggccgtgctgtgggtgggcaaggccctgcgggtggtgaagttcccagacctggacagaaatgtgcccaggaagaccttccccctgcccctgctgtactttggaaaccagatcaccggcctcttcagcaccaagaagctgaacctgcccatgttcaccgtgctgcggcgcttcagcatcctcttcaccatgtttgctgagggcgtgctgctgaagaagaccttctcctggggcatcaagatgacagtgtttgccatgatcattggagcctttgtggccgccagcagtgacctggcctttgacctggagggctacgccttcatcctgatcaatgatgtgctgacagctgccaatggagcctacgtgaagcagaagctggacagcaaggagctgggcaagtatggcctgctgtactacaatgccctcttcatgatcctgcccaccctggccatcgcctacttcaccggagatgcccagaaggctgtggagtttgagggctgggccgacaccctcttcctgctgcagttcaccctgagctgtgtgatgggcttcatcctgatgtatgccaccgtgctgtgcacccagtacaacagcgccctgaccaccaccatcgtgggctgcatcaagaacatcctgatcacctacatcggcatggtgtttggaggagactacatcttcacctggaccaacttcatcggcctgaacatcagcattgctggcagcctggtgtacagctacatcaccttcacagaggagcagctgagcaagcagagcgaggccaacaacaagctggacatcaagggcaaaggagctgtgtag

SEQ ID NO: 170670 - DNA, 783 bp, Artificial Sequence
  Description of Artificial Sequence: Synthetic coding sequence
atggtggccaccgtggccgtgctgtgggtgggcaaggccctgcgggtggtgaagttcccagacctggacagaaatgtgcccaggaagaccttccccctgcccctgctgtacttcggcaaccagatcaccggcctcttcagcaccaagaagctgaacctgcccatgttcaccgtgctgcggcgcttcagcatcctcttcaccatgtttgctgagggcgtgctgctgaagaagaccttctcctggggcatcaagatgacagtgtttgccatgatcatcggggcctttgtggccgccagcagtgacctggcctttgacctggagggctacgccttcatcctgatcaatgatgtgctgacagctgccaacggggcctacgtgaagcagaagctggacagcaaggagctgggcaagtatggcctgctgtactacaatgccctcttcatgatcctgcccaccctggccatcgcctacttcaccggagatgcccagaaggctgtggagtttgagggctgggccgacaccctcttcctgctgcagttcaccctgagctgtgtgatgggcttcatcctgatgtatgccaccgtgctgtgcacccagtacaacagcgccctgaccaccaccatcgtgggctgcatcaagaacatcctgatcacctacatcggcatggtgtttggaggagactacatcttcacctggaccaacttcatcggcctgaacatcagctgcatctgccaccggggcctgtgtgagctgcgggtgggcagcgccaccctgggcggctag

SEQ ID NO: 170671 - DNA, 1104 bp, Artificial Sequence
  Description of Artificial Sequence: Synthetic coding sequence
atgagcagccgctctgtgctgagccctgtggtgggcacagatgccccagaccagcacctggagctgaagaagccccaggagctgaaggagatggagcggctgcccctggccaatgaagacaagaccatgtttgccaacctgaagtatgtgtccctgggcatcctggtgttccagaccaccagcctggtgctgaccatgagatacagcaggaccctgaaggaggagggcccccgctacctgagcagcacagctgtggtggtggccgagctgctgaagatcatggcctgcatcctgctggtgtacaaggacagcaagtgcagcctgcgggccctgaacagagtgctgcatgatgagatcctgaacaagcccatggagaccctgaagctggccatccccagcggcatctacaccctgcagaacaacctgctgtatgtggccctgagcaacctggatgctgccacctaccaggtgacctaccagctgaagatcctgaccacagccctcttctctgtgtccatgctgagcaagaagctgggcgtgtaccagtggctgagcctggtgatcctgatgactggagtggcctttgtgcagtggcccagcgacagccagctggacagcaaggagctgtctgctggcagccagtttgtgggcctgatggctgtgctgacagcctgcttcagcagcggctttgctggggtgtactttgagaagatcctgaaggagaccaagcagagcgtgtggatccggaacatccagctgggcttcttcggcagcatcttcggcctgatgggcgtgtacatctatgatggagagctggtgtccaagaatggcttcttccagggctacaaccggctgacctggatcgtggtggtgctgcaggccctgggcggcctggtgattgctgctgtgatcaagtatgctgacaacatcctgaagggctttgccaccagcctgagcatcatcctgagcaccctcatctcctacttctggctgcaggactttgtgcccaccagcgtcttcttcctgggcgccatcctggtgatcacagccaccttcctgtatggctatgaccccaagccagctggcaaccccaccaaggcctag

SEQ ID NO: 170672 - DNA, 978 bp, Artificial Sequence
  Description of Artificial Sequence: Synthetic coding sequence
atgtttgccaacctgaagtatgtgtccctgggcatcctggtgttccagaccaccagcctggtgctgaccatgagatacagcaggaccctgaaggaggagggcccccgctacctgagcagcacagctgtggtggtggccgagctgctgaagatcatggcctgcatcctgctggtgtacaaggacagcaagtgcagcctgcgggccctgaacagagtgctgcatgatgagatcctgaacaagcccatggagaccctgaagctggccatccccagcggcatctacaccctgcagaacaacctgctgtatgtggccctgagcaacctggatgctgccacctaccaggtgacctaccagctgaagatcctgaccacagccctcttctctgtgtccatgctgagcaagaagctgggcgtgtaccagtggctgagcctggtgatcctgatgactggagtggcctttgtgcagtggcccagcgacagccagctggacagcaaggagctgtctgctggcagccagtttgtgggcctgatggctgtgctgacagcctgcttcagcagcggctttgctggggtgtactttgagaagatcctgaaggagaccaagcagagcgtgtggatccggaacatccagctgggcttcttcggcagcatcttcggcctgatgggcgtgtacatctatgatggagagctggtgtccaagaatggcttcttccagggctacaaccggctgacctggatcgtggtggtgctgcaggccctgggcggcctggtgattgctgctgtgatcaagtatgctgacaacatcctgaagggctttgccaccagcctgagcatcatcctgagcaccctcatctcctacttctggctgcaggactttgtgcccaccagcgtcttcttcctgggcgccatcctggtgatcacagccaccttcctgtatggctatgaccccaagccagctggcaaccccaccaaggcctag

SEQ ID NO: 170673 - DNA, 675 bp, Artificial Sequence
  Description of Artificial Sequence: Synthetic coding sequence
atgtttgccaacctgaagtatgtgtccctgggcatcctggtgttccagaccaccagcctggtgctgaccatgagatacagcaggaccctgaaggaggagggcccccgctacctgagcagcacagctgtggtggtggccgagctgctgaagatcatggcctgcatcctgctggtgtacaaggacagcaagtgcagcctgcgggccctgaacagagtgctgcatgatgagatcctgaacaagcccatggagaccctgaagctggccatccccagcggcatctacaccctgcagaacaacctgctgtatgtggccctgagcaacctggatgctgccacctaccaggtgacctaccagctgaagatcctgaccacagccctcttctctgtgtccatgctgagcaagaagctgggcgtgtaccagtggctgagcctggtgatcctgatgactggagtggcctttgtgcagtggcccagcgacagccagctggacagcaaggagctgtctgctggcagccagtttgtgggcctgatggctgtgctgacagcctgcttcagcagcggctttgctggggtgtactttgagaagatcctgaaggagaccaagcagagcgtgtggatccggaacatccagctgggcttcttcggcagcatcttcggcctgatgggcgtgtactag

SEQ ID NO: 170674 - DNA, 978 bp, Artificial Sequence; identical to SEQ ID NO: 170672
  Description of Artificial Sequence: Synthetic coding sequence

SEQ ID NO: 170675 - DNA, 663 bp, Artificial Sequence
  Description of Artificial Sequence: Synthetic coding sequence
atgtttgccaacctgaagtatgtgtccctgggcatcctggtgttccagaccaccagcctggtgctgaccatgagatacagcaggaccctgaaggaggagggcccccgctacctgagcagcacagctgtggtggtggccgagctgctgaagatcatggcctgcatcctgctggtgtacaaggacagcaagtgcagcctgcgggccctgaacagagtgctgcatgatgagatcctgaacaagcccatggagaccctgaagctggccatccccagcggcatctacaccctgcagaacaacctgctgtatgtggccctgagcaacctggatgctgccacctaccaggtgacctaccagctgaagatcctgaccacagccctcttctctgtgtccatgctgagcaagaagctgggcgtgtaccagtggctgagcctggtgatcctgatgactggagtggcctttgtgcagtggcccagcgacagccagctggacagcaaggagctgtctgctggcagccagtttgtgggcctgatggctgtgctgacagcctgcttcagcagcggctttgctggggtgtactttgagaagatcctgaaggagaccaagcagagcgtgtggatccggaacatccagctggtgtccttcagcctggagcccagcctgtag

SEQ ID NO: 170676 - DNA, 258 bp, Artificial Sequence
  Description of Artificial Sequence: Synthetic coding sequence
atgtttgccaacctgaagtatgtgtccctgggcatcctggtgttccagaccaccagcctggtgctgaccatgagatacagcaggaccctgaaggaggagggcccccgctacctgagcagcacagctgtggtggtggccgagctgctgaagatcatggcctgcatcctgctggtgtacaaggacagcaagtgcagcctgcgggccctgaacagagtgctgcatgatgagatcctgaacaagcccatggagaccctgtag

SEQ ID NO: 170677 - DNA, 1104 bp, Artificial Sequence; identical to SEQ ID NO: 170671
  Description of Artificial Sequence: Synthetic coding sequence

SEQ ID NO: 170678 - DNA, 969 bp, Artificial Sequence
  Description of Artificial Sequence: Synthetic coding sequence
atggccagcagcagcagcctggtgcctgaccggctgcggctgcccctgtgcttcctgggcgtgtttgtgtgctacttctactacggcatcctgcaggagaagatcacccggggcaagtacggggagggcgccaagcaggagaccttcacctttgccctgaccctggtgttcatccagtgtgtgatcaatgctgtgtttgccaagatcctgatccagttctttgacacagcccgggtggacaggaccaggtcctggctgtatgctgcctgcagcatctcctacctgggcgccatggtgagcagcaacagcgccctgcagtttgtgaactaccccacccaggtgctgggcaagagctgcaagcccatccctgtgatgctgctgggcgtgaccctgctgaagaagaagtaccccctggccaagtacctgtgtgtgctgctgattgtggccggcgtggccctcttcatgtacaagcccaagaaggtggtgggcatcgaggagcacacagtgggctatggagagctgctgctgctgctgagcctgaccctggatggcctgactggagtgtcccaggaccacatgagggcccactaccagacaggcagcaaccacatgatgctgaacatcaacctgtggagcaccctgctgctgggcatgggcatcctcttcaccggggagctgtgggagttcctgagctttgctgagcgctacccagccatcatctacaacatcctgctgtttggcctgaccagcgccctgggccagagcttcatcttcatgacagtggtgtacttcggccccctgacctgcagcatcatcaccaccaccaggaagttcttcaccatcctggccagcgtcatcctgtttgccaaccccatcagccccatgcagtgggtgggcaccgtgctggtgttcctgggcctgggcctggatgccaagtttggaaaaggagccaagaagaccagccactag

SEQ ID NO: 170679 - DNA, 450 bp, Artificial Sequence
  Description of Artificial Sequence: Synthetic coding sequence
ccccagagctgcctgattggcaagatcagccgggcccgggaccagagccggggctgccgcttcccctggcccagcggcatggagcccaggaccagggtgggccccctgctggtgctgcctgatgcctgcaagcagcccatccggccccggccctggtgccacagcaggaacacagtgagcagctgcctgggcacccggggcaagtatggagagggcgccaagcaggagaccttcacctttgccctgaccctggtgttcatccagtgtgtgatcaatgctgtgtttgccaagatctggtggatcgtgcctggagctggctccatgctgcctgtgctgagccccatctgggtgccctggagccctgccatccagcactacagcctgagcaccacccagctgcggagcctggtgaacccagccagccagagccagagctgcagcctgggctag

SEQ ID NO: 170680 - DNA, 1080 bp, Artificial Sequence
  Description of Artificial Sequence: Synthetic coding sequence
atgaggcccctgccccctgtgggagatgtgcggctggagctgagccccccaccacccctgctgcctgtgcctgtggtgtctggcagccctgtgggcagcagcggccgcctgatggccagcagcagcagcctggtgcctgaccggctgcggctgcccctgtgcttcctgggcgtgtttgtgtgctacttctactacggcatcctgcaggagaagatcacccggggcaagtatggagagggcgccaagcaggagaccttcacctttgccctgaccctggtgttcatccagtgtgtgatcaatgctgtgtttgccaagatcctgatccagttctttgacacagcccgggtggacaggaccaggtcctggctgtatgctgcctgcagcatctcctacctgggcgccatggtgagcagcaacagcgccctgcagtttgtgaactaccccacccaggtgctgggcaagagctgcaagcccatccctgtgatgctgctgggcgtgaccctgctgaagaagaagtaccccctggccaagtacctgtgtgtgctgctgattgtggccggcgtggccctcttcatgtacaagcccaagaaggtggtgggcatcgaggagcacacagtgggctacggggagctgctgctgctgctgagcctgaccctggatggcctgactggagtgtcccaggaccacatgagggcccactaccagacaggcagcaaccacatgatgctgaacatcaacctgtggagcaccctgctgctgggcatgggcatcctcttcaccggggagctgtgggagttcctgagctttgctgagcgctacccagccatcatctacaacatcctgctgtttggcctgaccagcgccctgggccagagcttcatcttcatgacagtggtgtacttcggccccctgacctgcagcatcatcaccaccaccaggaagttcttcaccatcctggccagcgtcatcctgtttgccaaccccatcagccccatgcagtgggtgggcaccgtgctggtgttcctgggcctgggcctggatgccaagtttgggaagggggccaagaagaccagccactag

SEQ ID NO: 170681 - DNA, 720 bp, Artificial Sequence
  Description of Artificial Sequence: Synthetic coding sequence
atggccagcagcagcagcctggtgcctgaccggctgcggctgcccctgtgcttcctgggcgtgtttgtgtgctacttctactacggcatcctgcaggagaagatcacccggggcaagtacggggagggcgccaagcaggagaccttcacctttgccctgaccctggtgttcatccagtgtgtgatcaatgctgtgtttgccaagatcctgatccagttctttgacacagcccgggtggacaggaccaggtcctggctgtatgctgcctgcagcatctcctacctgggcgccatggtgagcagcaacagcgccctgcagtttgtgaactaccccacccaggtgctgggcaagagctgcaagcccatccctgtgatgctgctgggcgtgaccctgctgaagaagaagtaccccctggccaagtacctgtgtgtgctgctgattgtggccggcgtggccctcttcatgtacaagcccaagaaggtggtgggcatcgaggagcacacagtgggctatggagagctgctgctgctgctgagcctgaccctggatggcctgactggagtgtcccaggaccacatgagggcccactaccagacaggcagcaaccacatgatgctgaacatcaacctgtggagcaccctgctgctgggcatgggagagagccagttctgctgcagcagccacgtgtccccagagggccgcctgcccagcagcttctag

SEQ ID NO: 170682 - DNA, 597 bp, Artificial Sequence
  Description of Artificial Sequence: Synthetic coding sequence
atgctgctgggcgtgaccctgctgaagaagaagtaccccctggccaagtacctgtgtgtgctgctgattgtggccggcgtggccctcttcatgtacaagcccaagaaggtggtgggcatcgaggagcacacagtgggctatggagagctgctgctgctgctgagcctgaccctggatggcctgactggagtgtcccaggaccacatgagggcccactaccagacaggcagcaaccacatgatgctgaacatcaacctgtggagcaccctgctgctgggcatgggcatcctcttcaccggggagctgtgggagttcctgagctttgctgagcgctacccagccatcatctacaacatcctgctgtttggcctgaccagcgccctgggccagagcttcatcttcatgacagtggtgtacttcggccccctgacctgcagcatcatcaccaccaccaggaagttcttcaccatcctggccagcgtcatcctgtttgccaaccccatcagccccatgcagtgggtgggcaccgtgctggtgttcctgggcctgggcctggatgccaagtttggaaaaggagccaagaagaccagccactag

SEQ ID NO: 170683 - DNA, 570 bp, Artificial Sequence
  Description of Artificial Sequence: Synthetic coding sequence
atgctgctgggcgtgaccctgctgaagaagaagtaccccctggccaagtacctgtgtgtgctgctgattgtggccggcgtggccctcttcatgtacaagcccaagaaggtggtgggcatcgaggagcacacagtgggctatggagagctgctgctgctgctgagcctgaccctggatggcctgactggagtgtcccaggaccacatgagggcccactaccagacaggcagcaaccacatgatgctgaacatcaacctgtggagcaccctgctgctgggcatgggcatcctcttcaccggggagctgtgggagttcctgagctttgctgagcgctacccagccatcatctacaacatcctgctgtttggcctgaccagcgccctgggccagagcttcatcttcatgacagtggtgtacttcggccccctgacctgcagcatcatcaccaccaccaggaagttcttcaccatcctggccagcgtcatcctgtttgccaaccccatcagccccatgcagtgggtgggcaccgtgctggtgttcctggccatgggcagctgctgcgtggcctag

SEQ ID NO: 170684 - DNA, 1179 bp, Artificial Sequence
  Description of Artificial Sequence: Synthetic coding sequence
atggatgcccgctggtgggccgtggtggtgctggccgccttccccagcctgggcgccggcggggagaccccagaggcccctcctgagagctggacccagctgtggttcttccgctttgtggtgaatgctgctggctacgccagcttcatggtgcccggctacctgctggtgcagtacttccggaggaagaactacctggagaccggccggggcctgtgcttccccctggtgaaggcctgtgtgtttggaaatgagcccaaggccagtgatgaggtgcccctggcccccaggacagaggccgctgagaccacccccatgtggcaggccctgaagctgctcttctgtgccaccggcctgcaggtgtcctacctgacctggggcgtgctgcaggagcgggtgatgaccaggagctatggagccacagccaccagccctggagagcgcttcacagacagccagttcctggtgctgatgaacagagtgctggccctgattgtggccggcctgagctgtgtgctgtgcaagcagcccaggcatggagcccccatgtaccgctacagctttgccagcctgagcaatgtgctgagctcctggtgccagtatgaggccctgaagtttgtgtccttccccacccaggtgctggccaaggccagcaaggtgattcctgtgatgctgatgggcaagctggtgagccgccgctcctatgagcactgggagtacctgacagccaccctcatcagcattggagtgtccatgttcctgctgagcagcggccctgagcccaggagcagccctgccaccaccctgagcggcctcttcaccgtgggcagcctgctggagcagggcgccctgctggagggcacccgcttcatgggccgccacagcgagtttgctgcccacgccctgctgctgagcatctgcagcgcctgtggccagctgttcatcttctacaccatcggccagtttggagctgctgtgttcaccatcatcatgaccctgcggcaggcctttgccatcctgctgagctgcctgctgtatggccacacagtgacagtggtgggcggcctgggcgtggccgtggtgtttgctgccctgctgctgcgggtgtatgcccggggccgcctgaagcagaggggcaagaaggctgtgcctgtggagagccctgtgcagaaggtgtag

SEQ ID NO: 170685 - DNA, 1299 bp, Artificial Sequence
  Description of Artificial Sequence: Synthetic coding sequence
atggatgcccgctggtgggccgtggtggtgctggccgccttccccagcctgggcgccggcggggagaccccagaggcccctcctgagagctggacccagctgtggttcttccgctttgtggtgaatgctgctggctacgccagcttcatggtgcccggctacctgctggtgcagtacttccggaggaagaactacctggagaccggccggggcctgtgcttccccctggtgaaggcctgtgtgtttggaaatgagcccaaggccagtgatgaggtgcccctggcccccaggacagaggccgctgagaccacccccatgtggcaggccctgaagctgctcttctgtgccaccggcctgcaggtgtcctacctgacctggggcgtgctgcaggagcgggtgatgaccaggagctatggagccacagccaccagccctggagagcgcttcacagacagccagttcctggtgctgatgaacagagtgctggccctgattgtggccggcctgagctgtgtgctgtgcaagcagcccaggcatggagcccccatgtaccgctacagctttgccagcctgagcaatgtgctgagctcctggtgccagtatgaggccctgaagtttgtgtccttccccacccaggtgctggccaaggccagcaaggtgattcctgtgatgctgatgggcaagctggtgagccgccgctcctatgagcactgggagtacctgacagccaccctcatcagcattggagtgtccatgttcctgctgagcagcggccctgagcccaggagcagccctgccaccaccctgagcggcctcatcctgctggccggctacatcgcctttgacagcttcaccagcaactggcaggatgccctgtttgcctacaagatgagctctgtgcagatgatgtttggagtgaacttcttcagctgcctcttcaccgtgggcagcctgctggagcagggcgccctgctggagggcacccgcttcatgggccgccacagcgagtttgctgcccacgccctgctgctgagcatctgcagcgcctgtggccagctgttcatcttctacaccatcggccagtttggagctgctgtgttcaccatcatcatgaccctgcggcaggcctttgccatcctgctgagctgcctgctgtatggccacacagtgacagtggtgggcggcctgggcgtggccgtggtgtttgctgccctgctgctgcgggtgtatgcccggggccgcctgaagcagaggggcaagaaggctgtgcctgtggagagccctgtgcagaaggtgtag

SEQ ID NO: 170686 - DNA, 900 bp, Artificial Sequence
  Description of Artificial Sequence: Synthetic coding sequence
atgaccaggagctatggagccacagccaccagccctggagagcgcttcacagacagccagttcctggtgctgatgaacagagtgctggccctgattgtggccggcctgagctgtgtgctgtgcaagcagcccaggcatggagcccccatgtaccgctacagctttgccagcctgagcaatgtgctgagctcctggtgccagtatgaggccctgaagtttgtgtccttccccacccaggtgctggccaaggccagcaaggtgattcctgtgatgctgatgggcaagctggtgtccagaagaagctatgagcactgggagtacctgacagccaccctcatcagcattggagtgtccatgttcctgctgagcagcggccctgagcccaggagcagccctgccaccaccctgagcggcctcatcctgctggccggctacatcgcctttgacagcttcaccagcaactggcaggatgccctgtttgcctacaagatgagctctgtgcagatgatgtttggagtgaacttcttcagctgcctcttcaccgtgggcagcctgctggagcagggcgccctgctggagggcacccgcttcatgggccgccacagcgagtttgctgcccacgccctgctgctgagcatctgcagcgcctgtggccagctgttcatcttctacaccatcggccagtttggagctgctgtgttcaccatcatcatgaccctgcggcaggcctttgccatcctgctgagctgcctgctgtatggccacacagtgacagtggtgggcggcctgggcgtggccgtggtgtttgctgccctgctgctgcgggtgtatgcccggggccgcctgaagcagaggggcaagaaggctgtgcctgtggagagccctgtgcagaaggtgtag

SEQ ID NO: 170687 - DNA, 1020 bp, Artificial Sequence
  Description of Artificial Sequence: Synthetic coding sequence
atgctgctggccatgcctgccctgtggtacctggccacctcctggtgcagcaccagcggcggccgcaccacctggaggcctgtgtcctacctgacctggggcgtgctgcaggagcgggtgatgaccaggagctatggagccacagccaccagccctggagagcgcttcacagacagccagttcctggtgctgatgaacagagtgctggccctgattgtggccggcctgagctgtgtgctgtgcaagcagcccaggcatggagcccccatgtaccgctacagctttgccagcctgagcaatgtgctgagctcctggtgccagtatgaggccctgaagtttgtgtccttccccacccaggtgctggccaaggccagcaaggtgattcctgtgatgctgatgggcaagctggtgtccagaagaagctatgagcactgggagtacctgacagccaccctcatcagcattggagtgtccatgttcctgctgagcagcggccctgagcccaggagcagccctgccaccaccctgagcggcctcatcctgctggccggctacatcgcctttgacagcttcaccagcaactggcaggatgccctgtttgcctacaagatgagctctgtgcagatgatgtttggagtgaacttcttcagctgcctcttcaccgtgggcagcctgctggagcagggcgccctgctggagggcacccgcttcatgggccgccacagcgagtttgctgcccacgccctgctgctgagcatctgcagcgcctgtggccagctgttcatcttctacaccatcggccagtttggagctgctgtgttcaccatcatcatgaccctgcggcaggcctttgccatcctgctgagctgcctgctgtatggccacacagtgacagtggtgggcggcctgggcgtggccgtggtgtttgctgccctgctgctgcgggtgtatgcccggggccgcctgaagcagaggggcaagaaggctgtgcctgtggagagccctgtgcagaaggtgtag

SEQ ID NO: 170688 - DNA, 852 bp, Artificial Sequence
  Description of Artificial Sequence: Synthetic coding sequence
atggacctgacccagcaggccaaggacatccagaacatcaccgtgcaggagaccaacaagaacaacagcgagagcattgaatgttccaagatcaccatggacctgaagttcaacaacagcaggaagtacatcagcatcaccgtgcccagcaagacccagaccatgagcccccacatcaagtctgtggatgatgtggtggtgctgggcatgaacctgagcaagttcaacaagctgacccagttcttcatctgtgtggccggcgtgtttgtgttctacctgatctacggctacctgcaggagctgatcttctctgtggagggcttcaagagctgtggctggtacctgaccctggtgcagtttgccttctacagcatcttcggcctgattgagctgcagctgatccaggacaagagaagacgcatccctgggaagacctacatgatcatcgccttcctgactgtgggcaccatgggcctgagcaacaccagcctgggctacctgaactaccccacccaggtgatcttcaagtgctgcaagctgatccctgtgatgctgggcggcgtcttcatccagggcaagcgctacaacgtggctgatgtgtctgctgccatctgcatgagcctgggcctcatctggttcaccctggccgacagcaccacagcccccaacttcaacctgactggagtggtgctgatcagcctggccctgtgtgctgatgctgtgattggaaatgtgcaggagaaggccatgaagctgcacaatgccagcaacagcgagatgaacatcaccaccagcagctacagcggggtcttcatcttccccaacaagctgaagatccccctggtgctgtag

SEQ ID NO: 170689 - DNA, 1206 bp, Artificial Sequence
  Description of Artificial Sequence: Synthetic coding sequence
atggacctgacccagcaggccaaggacatccagaacatcaccgtgcaggagaccaacaagaacaacagcgagagcattgaatgttccaagatcaccatggacctgaagttcaacaacagcaggaagtacatcagcatcaccgtgcccagcaagacccagaccatgagcccccacatcaagtctgtggatgatgtggtggtgctgggcatgaacctgagcaagttcaacaagctgacccagttcttcatctgtgtggccggcgtgtttgtgttctacctgatctacggctacctgcaggagctgatcttctctgtggagggcttcaagagctgtggctggtacctgaccctggtgcagtttgccttctacagcatcttcggcctgattgagctgcagctgatccaggacaagagaagacgcatccctgggaagacctacatgatcatcgccttcctgactgtgggcaccatgggcctgagcaacaccagcctgggctacctgaactaccccacccaggtgatcttcaagtgctgcaagctgatccctgtgatgctgggcggcgtcttcatccagggcaagcgctacaacgtggctgatgtgtctgctgccatctgcatgagcctgggcctcatctggttcaccctggccgacagcaccacagcccccaacttcaacctgactggagtggtgctgatcagcctggccctgtgtgctgatgctgtgattggaaatgtgcaggagaaggccatgaagctgcacaatgccagcaacagcgagatggtgctgtacagctacagcattggatttgtgtacatcctgctgggcctgacctgcaccagcggcctgggccctgctgtgaccttctgtgccaagaaccctgtgaggacctacggctacgccttcctgttcagcctgaccggctacttcggcatcagctttgtgctggccctgatcaagatctttggagccctgattgctgtgacagtgaccactggaaggaaggccatgaccatcgtgctgtccttcatcttctttgccaagcccttcaccttccagtatgtgtggagcggcctgctggtggtgctgggcatcttcctgaatgtgtacagcaagaacatggacaagatccggctgcccagcctgtatgacctgatcaacaagtctgtggaggccaggaagagcaggaccctggcccagacagtgtag

SEQ ID NO: 170690 - DNA, 657 bp, Artificial Sequence
  Description of Artificial Sequence: Synthetic coding sequence
atgctgcggctggcccagaccccccggcggctgcccagccccttccgggtgacctaccggccctggggcacccgggcctttggagccttccctgtgtttggcacccagatcagcagccccccagagaacctggacacagcccacctgccccaccctgagggcgcctttgaggagtggatgaggagcggctggaagaagagggacctgacccagcaggccaaggacatccagaacatcaccgtgcaggagaccaacaagaacaacagcgagagcattgaatgttccaagatcaccatggacctgaagttcaacaacagcaggaagtacatcagcatcaccgtgcccagcaagacccagaccatgagcccccacatcaagtctgtggatgatgtggtggtgctgggcatgaacctgagcaagttcaacaagctgacccagttcttcatctgtgtggccggcgtgtttgtgttctacctgatctacggctacctgcaggagctgatcttctctgtggagggcttcaagagctgtggctggtacctgaccctggtgcagtttgccttctacagcatcttcggcctgattgagctgcagctgatccaggacaagagaagaagatatgtggtgtgcttctacttcctgatcttcctgtactag

SEQ ID NO: 170691 - DNA, 996 bp, Artificial Sequence
  Description of Artificial Sequence: Synthetic coding sequence
atgaggcctgccctggccgtgggcctggtgtttgctggctgctgcagcaatgtcatcttcctggagctgctggccaggaagcaccctggctgcggcaacatcgtgacctttgcccagttcctgttcatcgctgtggagggcttcctgtttgaggccgacctgggcaggaagcccccagccatccccatccgctactatgccatcatggtgaccatgttcttcaccgtgtctgtggtgaacaactatgccctgaacctgaacatcgccatgcccctgcacatgatcttccgcagcggcagcctcatcgccaacatgatcctgggcatcatcatcctgaagaagcgctacagcatcttcaagtacaccagcatcgccctggtgtctgtgggcatcttcatctgcaccttcatgtctgccaagcaggtgaccagccagagcagcctgtctgaaaatgatggcttccaggcctttgtgtggtggctgctgggcatcggggccctgacctttgccctgctgatgtctgccaggatgggcatcttccaggagaccctgtacaagagatttgggaagcacagcaaggaggccctcttctacaaccacgccctgcccctgcccggctttgtgttcctggccagtgacatctatgaccatgctgtgctcttcaacaagtctgagctgtatgagatccctgtgattggagtgaccctgcccatcatgtggttctacctgctgatgaacatcatcacccagtatgtgtgcatccggggcgtcttcatcctgaccacagaatgtgccagcctgactgtgaccctggtggtgaccctgaggaagtttgtgtccctcatcttcagcatcctgtacttccagaaccccttcaccctgtggcactggctgggcaccctgtttgtgttcatcggcaccctgatgtacacagaggtgtggaacaacctgggcaccaccaagtctgagccccagaaggacagcaagaagaactag

SEQ ID NO: 170692 - DNA, 1095 bp, Artificial Sequence
  Description of Artificial Sequence: Synthetic coding sequence
atgaacagagcccccctgaagaggagccgcatcctgcacatggccctgactggagccagtgaccccagcgctgaggccgaggccaatggagagaagcccttcctgctgcgggccctgcagatcgccctggtggtgtccctgtactgggtgaccagcatctccatggtgttcctgaacaagtacctgctggacagccccagcctgcggctggacacccccatctttgtgaccttctaccagtgcctggtgaccaccctgctgtgcaagggcctgagcgccctggccgcctgctgccctggagctgtggacttccccagcctgcggctggacctgcgggtggcccggtctgtgctgcccctgtctgtggtgttcatcggcatgatcaccttcaacaacctgtgcctgaagtatgtgggcgtggccttctacaacgtgggccgcagcctgaccaccgtcttcaacgtgctgctgagctacctgctgctgaagcagaccaccagcttctacgccctgctgacctgtggcatcatcatcggcggcttctggctgggcgtggaccaggagggcgctgagggcaccctgtcctggctgggcaccgtgtttggagtgctggccagcctgtgtgtgtccctgaatgccatctacaccaccaaggtgctgcctgctgtggatggcagcatctggaggctgaccttctacaacaacgtgaatgcctgcatcctcttcctgcccctgctgctgctgctgggggagctgcaggccctgcgggactttgcccagctgggcagcgcccacttctggggcatgatgaccctgggcggcctgtttggatttgccatcggctacgtgacaggcctgcagatcaagttcaccagccccctgacccacaacgtgtctggaacagccaaggcctgtgcccagacagtgctggccgtgctgtactatgaggagaccaagagcttcctgtggtggaccagcaacatgatggtgctgggcggcagcagcgcctacacctgggtgcggggctgggagatgaagaagaccccagaggagcccagccccaaggacagcgagaagagcgccatgggcgtgtag

SEQ ID NO: 170693 - DNA, 1056 bp, Artificial Sequence
  Description of Artificial Sequence: Synthetic coding sequence
atggccctgaccggggccagtgaccccagcgctgaggccgaggccaacggggagaagcccttcctgctgcgggccctgcagatcgccctggtggtgtccctgtactgggtgaccagcatctccatggtgttcctgaacaagtacctgctggacagccccagcctgcggctggacacccccatctttgtgaccttctaccagtgcctggtgaccaccctgctgtgcaagggcctgagcgccctggccgcctgctgccctggagctgtggacttccccagcctgcggctggacctgcgggtggcccggtctgtgctgcccctgtctgtggtgttcatcggcatgatcaccttcaacaacctgtgcctgaagtatgtgggcgtggccttctacaacgtgggccgcagcctgaccaccgtcttcaacgtgctgctgagctacctgctgctgaagcagaccaccagcttctacgccctgctgacctgtggcatcatcattggaggcttctggctgggcgtggaccaggagggcgctgagggcaccctgtcctggctgggcaccgtgtttggagtgctggccagcctgtgtgtgtccctgaatgccatctacaccaccaaggtgctgcctgctgtggatggcagcatctggaggctgaccttctacaacaacgtgaatgcctgcatcctcttcctgcccctgctgctgctgctgggggagctgcaggccctgcgggactttgcccagctgggcagcgcccacttctggggcatgatgaccctgggcggcctgtttggatttgccatcggctacgtgacaggcctgcagatcaagttcaccagccccctgacccacaacgtgtctggaacagccaaggcctgtgcccagacagtgctggccgtgctgtactatgaggagaccaagagcttcctgtggtggaccagcaacatgatggtgctgggcggcagcagcgcctacacctgggtgcggggctgggagatgaagaagaccccagaggagcccagccccaaggacagcgagaagagcgccatgggcgtgtag

SEQ ID NO: 170694 - DNA, 1056 bp, Artificial Sequence; identical to SEQ ID NO: 170693
  Description of Artificial Sequence: Synthetic coding sequence

SEQ ID NO: 170695 - DNA, 219 bp, Artificial Sequence
  Description of Artificial Sequence: Synthetic coding sequence
atggccctgaccggggccagtgaccccagcgctgaggccgaggccaacggggagaagcccttcctgctgcgggccctgcagatcgccctggtggtgtccctgtactgggtgaccagcatctccatggtgttcctgaacaagtacctgctggacagccccagcctgcggctggacacccccatctttgtgaccttctaccagtgcctggtgaccacctag

SEQ ID NO: 170696 - DNA, 498 bp, Artificial Sequence
  Description of Artificial Sequence: Synthetic coding sequence
atggccctgaccggggccagtgaccccagcgctgaggccgaggccaacggggagaagcccttcctgctgcgggccctgcagatcgccctggtggtgtccctgtactgggtgaccagcatctccatggtgttcctgaacaagtacctgctggacagccccagcctgcggctggacacccccatctttgtgaccttctaccagtgcctggtgaccaccctgctgtgcaagggcctgagcgccctggccgcctgctgccctggagctgtggacttccccagcctgcggctggacctgcgggtggcccggtctgtgctgcccctgtctgtggtgttcatcggcatgatcaccttcaacaacctgtgcctgaagtatgtgggcgtggccttctacaacgtgggccgcagcctgaccaccgtcttcaacgtgctgctgagctacctgctgctgaagcagaccaccagcttctacgccctgctgacctgtggcatcatcatctag

SEQ ID NO: 170697 - DNA, 741 bp, Artificial Sequence
  Description of Artificial Sequence: Synthetic coding sequence
atgaacagagcccccctgaagaggagccgcatcctgcacatggccctgactggagccagtgaccccagcgctgaggccgaggccaatggagagaagcccttcctgctgcgggccctgcagatcgccctggtggtgtccctgtactgggtgaccagcatctccatggtgttcctgaacaagtacctgctggacagccccagcctgcggctggacacccccatctttgtgaccttctaccagtgcctggtgaccaccctgctgtgcaagggcctgagcgccctggccgcctgctgccctggagctgtggacttccccagcctgcggctggacctgcgggtggcccggtctgtgctgcccctgtctgtggtgttcatcggcatgatcaccttcaacaacctgtgcctgaagtatgtgggcgtggccttctacaacgtgggccgcagcctgaccaccgtcttcaacgtgctgctgagctacctgctgctgaagcagaccaccagcttctacgccctgctgacctgtggcatcatcatcggcggcttctggctgggcgtggaccaggagggcgctgagggcaccctgtcctggctgggcaccgtgtttggagtgctggccagcctgtgtgtgtccctgaatgccatctacaccaccaaggtgctgcctgctgtggatggcagcatctggaggctgaccttctacaacaacgtgaatgcctgcatcctcttcctgcccctgctgtag

SEQ ID NO: 170698 - DNA, 1014 bp, Artificial Sequence
  Description of Artificial Sequence: Synthetic coding sequence
atgacagctgggggccaggccgaggccgagggcgctggaggagagcccggggccgcccggctgcccagccgggtggcccggctgctgagcgccctcttctacggcacctgcagcttcctgattgtgctggtgaacaaggccctgctgaccacctacggcttccccagccccatcttcctgggcatcggccagatggccgccaccatcatgatcctgtatgtgtccaagctgaacaagatcatccacttcccagactttgacaagaagatccctgtgaagctgttccccctgcccctgctgtatgtgggcaaccacatcagcggcctgagcagcaccagcaagctgagcctgcccatgttcaccgtgctgaggaagttcaccatccccctgaccctgctgctggagaccatcatcctgggcaagcagtacagcctgaacatcatcctgtctgtgtttgccatcatcctgggcgccttcatcgccgccggcagtgacctggccttcaacctggagggctacatctttgtgttcctgaatgacatcttcaccgctgccaacggggtgtacaccaagcagaagatggaccccaaggagctgggcaagtatggagtgctcttctacaatgcctgcttcatgatcatccccaccctcatcatctctgtgtccactggagacctgcagcaggccacagagttcaaccagtggaagaatgtggtgttcatcctgcagttcctgctgagctgcttcctgggcttcctgctgatgtacagcacagtgctgtgcagctactacaacagcgccctgaccacagctgtggtgggcgccatcaagaatgtgtctgtggcctacatcggcatcctgattggaggagactacatcttcagcctgctgaactttgtgggcctgaacatctgcatggccggcggcctgcgctacagcttcctgaccctgagcagccagctgaagcccaagcctgtgggggaggagaacatctgcctggacctgaagagctag

SEQ ID NO: 170699 - DNA, 492 bp, Artificial Sequence
  Description of Artificial Sequence: Synthetic coding sequence
atgacagctgggggccaggccgaggccgagggcgctggaggagagcccggggccgcccggctgcccagccgggtggcccggctgctgagcgccctcttctacggcacctgcagcttcctgattgtgctggtgaacaaggccctgctgaccacctacggcttccccagccccatcttcctgggcatcggccagatggccgccaccatcatgatcctgtatgtgtccaagctgaacaagatcatccacttcccagactttgacaagaagatccctgtgaagctgttccccctgcccctgctgtatgtgggcaaccacatcagcggcctgagcagcaccagcaagctgagcctgcccatgttcaccgtgctgaggaagttcaccatccccctgaccctgctgctggagaccatcatcctgggcaagcagtacagcctgaacatcatcctgtctgtgtttgccatcatcctgggcgccttcatcgccgccggctag

SEQ ID NO: 170700 - DNA, 750 bp, Artificial Sequence
  Description of Artificial Sequence: Synthetic coding sequence
atgacagctgggggccaggccgaggccgagggcgctggaggagagcccggggccgcccggctgcccagccgggtggcccggctgctgagcgccctcttctacggcacctgcagcttcctgattgtgctggtgaacaaggccctgctgaccacctacggcttccccagccccatcttcctgggcatcggccagatggccgccaccatcatgatcctgtatgtgtccaagctgaacaagatcatccacttcccagactttgacaagaagatccctgtgaagctgttccccctgcccctgctgtatgtgggcaaccacatcagcggcctgagcagcaccagcaagctgagcctgcccatgttcaccgtgctgaggaagttcaccatccccctgaccctgctgctggagaccatcatcctgggcaagcagtacagcctgaacatcatcctgtctgtgtttgccatcatcctgggcgccttcatcgccgccggcttcctgctgatgtacagcacagtgctgtgcagctactacaacagcgccctgaccacagctgtggtgggcgccatcaagaatgtgtctgtggcctacatcggcatcctgattggaggagactacatcttcagcctgctgaactttgtgggcctgaacatctgcatggccggcggcctgcgctacagcttcctgaccctgagcagccagctgaagcccaagcctgtgggggaggagaacatctgcctggacctgaagagctag

SEQ ID NO: 170701 - DNA, 1251 bp, Artificial Sequence
  Description of Artificial Sequence: Synthetic coding sequence
atgaggcagctgtgccggggccgggtgctgggcatctctgtggccatcgcccacggcgtcttcagcggcagcctgaacatcctgctgaagttcctgatcagccgctaccagttctccttcctgaccctggtgcagtgcctgaccagcagcacagctgccctgagcctggagctgctgcggcggctgggcctgattgctgtgccccccttcggcctgagcctggcccggagctttgctggggtggccgtgctgagcaccctgcagagcagcctgaccctgtggagcctgcggggcctgagcctgcccatgtatgtggtgttcaagcgctgcctgcccctggtgaccatgctgattggagtgctggtgctgaagaatggagcccccagccctggggtgctggccgctgtgctgatcaccacctgtggggccgccctggccggggccggggacctgaccggggaccccatcggctacgtgactggagtgctggccgtgctggtgcatgctgcctacctggtgctgatccagaaggccagcgctgacacagagcacggccccctgacagcccagtatgtgattgctgtgtctgccacccccctgctggtgatctgcagctttgccagcacagacagcatccacgcctggaccttccctggctggaaggaccctgccatggtgtgcatctttgtggcctgcatcctgattggctgtgccatgaacttcaccaccctgcactgcacctacatcaacagcgctgtgaccaccagctttgtgggcgtggtgaagagcatcgccaccatcaccgtgggcatggtggccttcagtgatgtggagcccaccagcctcttcatcgccggcgtggtggtgaacaccctgggcagcatcatctactgtgtggccaagttcatggagaccaggaagcagagcaactatgaggacctggaggcccagcccagaggagaggaggcccagctgagcggggaccagctgccctttgtgatggaggagctgcccggggagggcggcaatggccgctctgagggcggggaggccgccggcggccctgcccaggagagccggcaggaggtgcggggcagcccccggggcgtgcccctggtggccggcagcagcgaggagggcagccgccgcagcctgaaggatgcctacctggaggtgtggaggctggtgcggggcacccgctacatgaagaaggactacctgattgaaaatgaggagctgcccagcccctag

SEQ ID NO: 170702 - DNA, 1431 bp, Artificial Sequence
  Description of Artificial Sequence: Synthetic coding sequence
atgagcacccagaggctgagaaatgaagactaccatgactacagcagcacagatgtgtccccagaggagagccccagcgagggcctgaacaacctgagcagccctggcagctaccagagatttggccagagcaacagcaccacctggttccagaccctcatccacctgctgaagggcaacattggaacaggcctgctgggcctgcccctggccgtgaagaatgccggcatcgtgatgggccccatcagcctgctgatcattggaattgtggccgtgcactgcatgggcatcctggtgaagtgtgcccaccacttctgccggcggctgaacaagagctttgtggactatggagacacagtgatgtatggcctggagagcagcccctgctcctggctgagaaatcatgcccactggggccggcgggtggtggacttcttcctgattgtgacccagctgggcttctgctgcgtgtactttgtgttcctggccgacaacttcaagcaggtgattgaggccgccaacggcaccaccaacaactgccacaacaatgaaacagtcatcctgacccccaccatggacagccggctgtacatgctgtccttcctgcccttcctggtgctgctggtgttcatccggaacctgcgggccctgagcatcttcagcctgctggccaacatcaccatgctggtgtccctggtgatgatctaccagttcatcgtgcagaggatcccagaccccagccacctgcccctggtggccccctggaagacctaccccctcttcttcggcacagccatcttctcctttgagggcatcggcatggtgctgcccctggagaacaagatgaaggaccccaggaagttccccctcatcctgtacctgggcatggtgattgtgaccatcctgtacatcagcctgggctgcctgggctacctgcagtttggagccaacatccagggcagcatcaccctgaacctgcccaactgctggctgtaccagagcgtgaagctgctgtacagcatcggcatcttcttcacctacgccctgcagttctacgtgcctgctgagatcatcatccccttctttgtgtcccgggcccctgagcactgtgagctggtggtggacctgtttgtgaggacagtgctggtgtgcctgacctgcatcctggccatcctgatcccccggctggacctggtgatcagcctggtgggctctgtgagcagcagcgccctggccctgatcatcccccccctgctggaggtgaccaccttctacagcgagggcatgagccccctgaccatcttcaaggatgccctgatcagcatcctgggctttgtgggctttgtggtgggcacctatgaggccctgtatgagctgatccagcccagcaatgcccccatcttcatcaacagcacctgtgccttcatctag

SEQ ID NO: 170703 - DNA, 1161 bp, Artificial Sequence
  Description of Artificial Sequence: Synthetic coding sequence
atgagcacccagaggctgagaaatgaagactaccatgactacagcagcacagatgtgtccccagaggagagccccagcgagggcctgaacaacctgagcagccctggcagctaccagagatttggccagagcaacagcaccacctggttccagaccctcatccacctgctgaagggcaacattggaacaggcctgctgggcctgcccctggccgtgaagaatgccggcatcgtgatgggccccatcagcctgctgatcattggaattgtggccgtgcactgcatgggcatcctggtgaagtgtgcccaccacttctgccggcggctgaacaagagctttgtggactatggagacacagtgatgtatggcctggagagcagcccctgctcctggctgagaaatcatgcccactggggccggcgggtggtggacttcttcctgattgtgacccagctgggcttctgctgcgtgtactttgtgttcctggccgacaacttcaagcaggtgattgaggccgccaacggcaccaccaacaactgccacaacaatgaaacagtcatcctgacccccaccatggacagccggctgtacatgctgtccttcctgcccttcctggtgctgctggtgttcatccggaacctgcgggccctgagcatcttcagcctgctggccaacatcaccatgctggtgtccctggtgatgatctaccagttcatcgtgcagaggatcccagaccccagccacctgcccctggtggccccctggaagacctaccccctcttcttcggcacagccatcttctcctttgagggcatcggcatggtgctgcccctggagaacaagatgaaggaccccaggaagttccccctcatcctgtacctgggcatggtgattgtgaccatcctgtacatcagcctgggctgcctgggctacctgcagtttggagccaacatccagggcagcatcaccctgaacctgcccaactgctggctgtaccagagcgtgaagctgctgtacagcatcggcatcttcttcacctacgccctgcagttctacgtgcctgctgagatcatcatccccttctttgtgtcccgggcccctgagcactgtgagctggtggtggacctgtttgtgaggacagtgctggtgtgcctgacctag

SEQ ID NO: 170704 - DNA, 213 bp, Artificial Sequence
  Description of Artificial Sequence: Synthetic coding sequence
atgagcacccagaggctgagaaatgaagactaccatgactacagcagcacagatgtgtccccagaggagagccccagcgagggcctgaacaacctgagcagccctggcagctaccagagatttggccagagcaacagcaccacctggttccagaccctcatccacctgctgaagggcaacattggaacaggcctgctgggcctgcccctgtag

SEQ ID NO: 170705 - DNA, 219 bp, Artificial Sequence
  Description of Artificial Sequence: Synthetic coding sequence
atgagcacccagaggctgagaaatgaagactaccatgactacagcagcacagatgtgtccccagaggagagccccagcgagggcctgaacaacctgagcagccctggcagctaccagagatttggccagagcaacagcaccacctggttccagaccctcatccacctgctgaagggcaacattggaacaggcctgctgggcctgcccctggccgtgtag

SEQ ID NO: 170706 - DNA, 1431 bp, Artificial Sequence; identical to SEQ ID NO: 170702
  Description of Artificial Sequence: Synthetic coding sequence

SEQ ID NO: 170707 - DNA, 1167 bp, Artificial Sequence
  Description of Artificial Sequence: Synthetic coding sequence
atgagcacccagaggctgagaaatgaagactaccatgactacagcagcacagatgtgtccccagaggagagccccagcgagggcctgaacaacctgagcagccctggcagctaccagagatttggccagagcaacagcaccacctggttccagaccctcatccacctgctgaagggcaacattggaacaggcctgctgggcctgcccctggccgtgaagaatgccggcatcgtgatgggccccatcagcctgctgatcattggaattgtggccgtgcactgcatgggcatcctggtgaagtgtgcccaccacttctgccggcggctgaacaagagctttgtggactatggagacacagtgatgtatggcctggagagcagcccctgctcctggctgagaaatcatgcccactggggccggcgggtggtggacttcttcctgattgtgacccagctgggcttctgctgcgtgtactttgtgttcctggccgacaacttcaagcaggtgattgaggccgccaacggcaccaccaacaactgccacaacaatgaaacagtcatcctgacccccaccatggacagccggctgtacatgctgtccttcctgcccttcctggtgctgctggtgttcatccggaacctgcgggccctgagcatcttcagcctgctggccaacatcaccatgctggtgtccctggtgatgatctaccagttcatcgtgcagaggatcccagaccccagccacctgcccctggtggccccctggaagacctaccccctcttcttcggcacagccatcttctcctttgagggcatcggcatggtgctgcccctggagaacaagatgaaggaccccaggaagttccccctcatcctgtacctgggcatggtgattgtgaccatcctgtacatcagcctgggctgcctgggctacctgcagtttggagccaacatccagggcagcatcaccctgaacctgcccaactgctggctgtaccagagcgtgaagctgctgtacagcatcggcatcttcttcacctacgccctgcagttctacgtgcctgctgagatcatcatccccttctttgtgtcccgggcccctgagcactgtgagctggtggtggacctgtttgtgaggacagtgctggtgtgcctgacctgtgagtag

SEQ ID NO: 170708 - DNA, 1452 bp, Artificial Sequence
  Description of Artificial Sequence: Synthetic coding sequence
atgtctgtgaccaagagcacagagggcccccagggcgctgtggccatcaagctggacctgatgagccccccagagagcgccaagaagctggagaacaaggacagcaccttcctggatgagagccccagcgagagcgctggcctgaagaagaccaagggcatcaccgtcttccaggccctgatccacctggtgaagggcaacatgggcaccggcatcctgggcctgcccctggccgtgaagaatgccggcatcctgatgggccccctgagcctgctggtgatgggcttcatcgcctgccactgcatgcacatcctggtgaagtgtgcccagcgcttctgcaagaggctgaacaagcccttcatggactatggagacacagtgatgcacggcctggaggccaaccccaatgcctggctgcagaaccacgcccactggggccgccacatcgtgtccttcttcctgatcatcacccagctgggcttctgctgcgtgtacatcgtgttcctggccgacaacctgaagcaggtggtggaggccgtgaacagcaccaccaacaactgctacagcaatgagaccgtcatcctgacccccaccatggacagccggctgtacatgctgtccttcctgcccttcctggtgctgctggtgctgatccggaacctgcgcatcctgaccatcttctccatgctggccaacatctccatgctggtgtccctggtgatcatcatccagtacatcacccaggagatcccagaccccagccggctgcccctggtggcctcctggaagacctaccccctcttctttggaacagccatcttctcctttgagagcattggagtggtgctgcccctggagaacaagatgaagaatgcccggcacttccctgccatcctgagcctgggcatgagcatcgtgaccagcctgtacatcggcatggccgccctgggctacctgcgctttggagatgacatcaaggccagcatcagcctgaacctgcccaactgctggctgtaccagagcgtgaagctgctgtacatcgccggcatcctgtgcacctacgccctgcagttctacgtgcctgctgagatcatcatcccctttgccatcagccgggtgtccacccgctgggccctgcccctggacctgagcatccggctggtgatggtgtgcctgacctgcctgctggccatcctgatcccccggctggacctggtgatcagcctggtgggctctgtgtctggaacagccctggccctgatcatcccccccctgctggaggtgaccaccttctacagcgagggcatgagccccctgaccatcttcaaggatgccctgatcagcatcctgggctttgtgggctttgtggtgggcacctaccaggccctggatgagctgctgaagtctgaggacagccaccccttcagcaacagcaccacctttgtgaggtag

SEQ ID NO: 170709 - DNA, 624 bp, Artificial Sequence
  Description of Artificial Sequence: Synthetic coding sequence
atgaatgacacagctgtgctgcccctggagaacaagatgaagaatgcccggcacttccctgccatcctgagcctgggcatgagcatcgtgaccagcctgtacatcggcatggccgccctgggctacctgcgctttggagatgacatcaaggccagcatcagcctgaacctgcccaactgctggctgtaccagagcgtgaagctgctgtacatcgccggcatcctgtgcacctacgccctgcagttctacgtgcctgctgagatcatcatcccctttgccatcagccgggtgtccacccgctgggccctgcccctggacctgagcatccggctggtgatggtgtgcctgacctgcctgctggccatcctgatcccccggctggacctggtgatcagcctggtgggctctgtgtctggaacagccctggccctgatcatcccccccctgctggaggtgaccaccttctacagcgagggcatgagccccctgaccatcttcaaggatgccctgatcagcatcctgggctttgtgggctttgtggtgggcacctaccaggccctggatgagctgctgaagtctgaggacagccaccccttcagcaacagcaccacctttgtgaggtag

SEQ ID NO: 170710 - DNA, 1413 bp, Artificial Sequence
  Description of Artificial Sequence: Synthetic coding sequence
atgagcctgctgggccgggactacaacagcgagctgaacagcctggacaatggcccccagagccccagcgagagcagcagcagcatcaccagtgaaaatgtgcaccctgctggggaggccggcctgtccatgatgcagaccctcatccacctgctgaagtgcaacatcggcaccggcctgctgggcctgcccctggccatcaagaatgccggcctgctggtgggccctgtgtccctgctggccatcggcgtgctgactgtgcactgcatggtgatcctgctgaactgtgcccagcacctgagccagaggctgcagaagacctttgtgaactatggagaggccaccatgtatggcctggagacctgccccaacacctggctgcgggcccatgctgtgtggggccgctacacagtgtccttcctgctggtgatcacccagctgggcttctgcagcgtgtacttcatgttcatggctgacaacctgcagcagatggtggagaaggcccacgtgaccagcaacatctgccagccccgggagatcctgaccctgacccccatcctggacatccgcttctacatgctgatcatcctgcccttcctgatcctgctggtgttcatccagaacctgaaggtgctgtctgtgttcagcaccctggccaacatcaccaccctgggctccatggccctgatctttgagtacatcatggagggcatcccctaccccagcaacctgcccctgatggccaactggaagaccttcctgctcttctttggaacagccatcttcacctttgagggcgtgggcatggtgctgcccctgaagaaccagatgaagcacccccagcagttctcctttgtgctgtacctgggcatgagcatcgtcatcatcctgtacatcctgctgggcaccctgggctacatgaagtttggaagtgacacccaggccagcatcaccctgaacctgcccaactgctggctgtaccagagcgtgaagctgatgtacagcatcggcatcttcttcacctacgccctgcagttccacgtgcctgctgagatcatcatcccctttgccatcagccaggtgtctgagagctgggccctgtttgtggacctgtctgtgcgcagcgccctggtgtgcctgacctgtgtgtctgccatcctgatcccccggctggacctggtgatcagcctggtgggctctgtgagcagcagcgccctggccctgatcatcccagccctgctggagatcgtcatcttctacagcgaggacatgagctgtgtgaccatcgccaaggacatcatgatcagcatcgtgggcctgctgggctgcatcttcggcacctaccaggccctgtatgagctgccccagcccatcagccacagcatggccaacagcactggagtgcacgcctag

SEQ ID NO: 170711 - DNA, 1536 bp, Artificial Sequence
  Description of Artificial Sequence: Synthetic coding sequence
atgagcctgctgggccgggactacaacagcgagctgaacagcctggacaatggcccccagagccccagcgagagcagcagcagcatcaccagtgaaaatgtgcaccctgctggggaggccggcctgtccatgatgcagaccctcatccacctgctgaagtgcaacatcggcaccggcctgctgggcctgcccctggccatcaagaatgccggcctgctggtgggccctgtgtccctgctggccatcggcgtgctgactgtgcactgcatggtgatcctgctgaactgtgcccagcacctgagccagaggctgcagaagacctttgtgaactatggagaggccaccatgtatggcctggagacctgccccaacacctggctgcgggcccatgctgtgtggggccgctggaacctggccctgagcccccggctggagtgcagcggcaagatcagcgcccactgcaacccccacctgcagggcagcagcaacagccctgcccaggccagccgggtggccggcatctaccgctacacagtgtccttcctgctggtgatcacccagctgggcttctgcagcgtgtacttcatgttcatggctgacaacctgcagcagatggtggagaaggcccacgtgaccagcaacatctgccagccccgggagatcctgaccctgacccccatcctggacatccgcttctacatgctgatcatcctgcccttcctgatcctgctggtgttcatccagaacctgaaggtgctgagcgtcttcagcaccctggccaacatcaccaccctgggctccatggccctgatctttgagtacatcatggagggcatcccctaccccagcaacctgcccctgatggccaactggaagaccttcctgctcttcttcggcacagccatcttcacctttgaaggagtgggcatggtgctgcccctgaagaaccagatgaagcacccccagcagttctcctttgtgctgtacctgggcatgagcatcgtcatcatcctgtacatcctgctgggcaccctgggctacatgaagtttggaagtgacacccaggccagcatcaccctgaacctgcccaactgctggctgtaccagagcgtgaagctgatgtacagcatcggcatcttcttcacctacgccctgcagttccacgtgcctgctgagatcatcatcccctttgccatcagccaggtgtctgagagctgggccctgtttgtggacctgtctgtgcgcagcgccctggtgtgcctgacctgtgtgtctgccatcctgatcccccggctggacctggtgatcagcctggtgggctctgtgagcagcagcgccctggccctgatcatcccagccctgctggagatcgtcatcttctacagcgaggacatgagctgtgtgaccatcgccaaggacatcatgatcagcatcgtgggcctgctgggctgcatcttcggcacctaccaggccctgtatgagctgccccagcccatcagccacagcatggccaacagcactggagtgcacgcctag

SEQ ID NO: 170712 - DNA, 1515 bp, Artificial Sequence
  Description of Artificial Sequence: Synthetic coding sequence
atggaggccgccgccaccccagctgctgctggggccgcccggcgggaggagctggacatggatgtgatgaggcccctcatcaatgagcagaactttgatggcaccagtgatgaggagcacgagcaggagctgctgcctgtgcagaagcactaccagctggatgaccaggagggcatcagctttgtgcagaccctgatgcacctgctgaagggcaacattggaacaggcctgctgggcctgcccctggccatcaagaatgccggcatcgtgctgggccccatcagcctggtgttcatcggcatcatctctgtgcactgcatgcacatcctggtgcgctgcagccacttcctgtgcctgcgcttcaagaagagcaccctgggctacagcgacacagtgtcctttgccatggaggtgagcccctggagctgcctgcagaagcaggccgcctggggccgctctgtggtggacttcttcctggtgatcacccagctgggcttctgcagcgtgtacatcgtgttcctggccgagaatgtgaagcaggtgcatgagggcttcctggagagcaaggtgttcatcagcaacagcaccaacagcagcaacccctgtgagcggcgctctgtggacctgcgcatctacatgctgtgcttcctgcccttcatcatcctgctggtgttcatccgggagctgaagaacctgtttgtgctgtccttcctggccaacgtgtccatggctgtgtccctggtgatcatctaccagtatgtggtgaggaacatgccagacccccacaacctgcccatcgtggccggctggaagaagtaccccctcttctttggaacagctgtgtttgcctttgagggcattggagtggtgctgcccctggagaaccagatgaaggagagcaagcgcttcccccaggccctgaacatcggcatgggcatcgtgaccaccctgtatgtgaccctggccaccctgggctacatgtgcttccatgatgagatcaagggcagcatcaccctgaacctgccccaggatgtgtggctgtaccagagcgtgaagatcctgtacagctttggcatctttgtgacctacagcatccagttctacgtgcctgctgagatcatcatccctggcatcaccagcaagttccacaccaagtggaagcagatctgtgaatttggcatccgctccttcctggtgtccatcacctgtgccggggccatcctgatcccccggctggacatcgtcatcagctttgtgggcgctgtgagcagcagcaccctggccctgatcctgccccccctggtggagatcctgaccttcagcaaggagcactacaacatctggatggtgctgaagaacatcagcatcgccttcaccggggtggtgggcttcctgctgggcacctacatcaccgtggaggagatcatctaccccacccccaaggtggtggccggcaccccccagagccccttcctgaacctgaacagcacctgcctgaccagcggcctgaagtag

SEQ ID NO: 170713 - DNA, 1602 bp, Artificial Sequence
  Description of Artificial Sequence: Synthetic coding sequence
atggcccggctgcctgctggcatccgcttcatcatctccttcagccgggaccagtggtaccgggccttcatcttcatcctgaccttcctgctgtatgccagcttccacctgagcaggaagcccatcagcatcgtgaagggggagctgcacaagtactgcacagcctgggatgaagcagatgtgcgcttcagcagccagaacaggaagagcggcagcgctgccccccaccagctgcctgacaatgaaacagactgtggctgggccccctttgacaagaacaactaccagcagctgctgggcgccctggactacagcttcctgtgtgcctatgctgtgggcatgtacctgagcggcatcatcggggagcggctgcccatccgctactacctgaccttcggcatgctggccagcggggccttcaccgccctgtttggcctgggctacttctacaacatccacagctttggcttctacgtggtgacccaggtgatcaatggcctggtgcagaccaccggctggcccagcgtggtgacctgcctgggcaactggtttgggaagggccggcggggcctcatcatgggcgtgtggaacagccacacctctgtgggcaacatcctgggcagcctgattgctggctactgggtgtccacctgctggggcctgagctttgtggtgcctggggccatcgtggccgccatgggcatcgtgtgcttcctgttcctgattgagcaccccaatgatgtgcgctgcagcagcaccctggtgacccacagcaagggctatgaaaatggcaccaaccggctgcggctgcagaagcagatcctgaagtctgagaagaacaagcccctggaccctgagatgcagtgcctgctgctgagtgatggcaagggcagcatccaccccaaccacgtggtgatcctgcctggagatggcggcagcggcacagctgccatctccttcaccggggccctgaagatccctggggtcatcgagttcagcctgtgcctgctgtttgccaagctggtgtcctacaccttcctgttctggctgcccctgtacatcaccaacgtggaccacctggatgccaagaaggccggggagctgagcaccctgtttgatgtgggcggcatctttggaggcatcctggccggggtcatcagtgaccggctggagaagagggccagcacctgtggcctgatgctgctgctggccgcccccaccctgtacatcttcagcacagtgtccaagatgggcctggaggccaccatcgccatgctgctgctgagcggggccctggtgtctggcccctacaccctcatcaccacagctgtgtctgctgacctgggcacccacaagagcctgaagggaaatgcccacgccctgagcacagtgacagccatcattgatggcactggatctgtgggcgccgccctgggccccctgctggccggcctgctgagccccagcggctggagcaatgtgttctacatgctgatgtttgctgatgcctgtgccctgctcttcctgatccgcctcatccacaaggagctgagctgccccggcagcgccaccggggaccaggtgcccttcaaggagcagtag

SEQ ID NO: 170714 - DNA, 1602 bp, Artificial Sequence; identical to SEQ ID NO: 170713
  Description of Artificial Sequence: Synthetic coding sequence

SEQ ID NO: 170715 - DNA, 57 bp, Artificial Sequence
  Description of Artificial Sequence: Synthetic coding sequence
atggcccggctgcctgctggcatccgcttcatcatctccttcagccgggaccagtag

SEQ ID NO: 170716 - DNA, 57 bp, Artificial Sequence; identical to SEQ ID NO: 170715
  Description of Artificial Sequence: Synthetic coding sequence

SEQ ID NO: 170717 - DNA, 1464 bp, Artificial Sequence
  Description of Artificial Sequence: Synthetic coding sequence
atgatgcacttcaagagcggcctggagctgacagagctgcagaacatgacagtgcctgaagatgacaacatcagcaatgacagcaatgacttcacagaggtggagaatggccagatcaacagcaagttcatcagtgaccgggagagccgccgcagcctgaccaacagccacctggagaagaagaagtgtgatgagtacatccctggcaccaccagcctgggcatgtctgtgttcaacctgagcaatgccatcatgggcagcggcatcctgggcctggcctttgccctggccaacacaggcatcctgctcttcctggtgctgctgacctctgtgaccctgctgagcatctacagcatcaacctgctgctgatctgcagcaaggagaccggctgcatggtgtatgagaagctgggggagcaggtgtttggcaccaccgggaagtttgtgatctttggagccaccagcctgcagaacacaggagccatgctgagctacctgttcatcgtgaagaatgagctgcccagcgccatcaagttcctgatgggcaaggaggagaccttcagcgcctggtacgtggatggccgggtgctggtggtgattgtgaccttcggcatcatcctgcccctgtgcctgctgaagaacctgggctacctgggctacaccagcggcttcagcctgagctgcatggtgttcttcctgattgtggtgatctacaagaagttccagatcccctgcatcgtgcctgagctgaacagcaccatcagcgccaacagcaccaatgctgacacctgcacccccaagtatgtgaccttcaacagcaagacagtgtatgccctgcccaccatcgcctttgcctttgtgtgccaccccagcgtgctgcccatctacagcgagctgaaggacaggagccagaagaagatgcagatggtgagcaacatctccttctttgccatgtttgtgatgtacttcctgacagccatcttcggctacctgaccttctatgacaacgtgcagagcgacctgctgcacaagtaccagagcaaggatgacatcctgatcctgactgtgcggctggccgtgattgtggccgtcatcctgactgtgcctgtgctcttcttcaccgtgcgcagcagcctgtttgagctggccaagaagaccaagttcaacctgtgccgccacacagtggtgacctgcatcctgctggtggtgatcaacctgctggtgatcttcatccccagcatgaaggacatcttcggcgtggtgggcgtgaccagcgccaacatgctgatcttcatcctgcccagcagcctgtacctgaagatcacagaccaggatggagacaagggcacccagaggatctgggccgccctcttcctgggcctgggcgtgctcttcagcctggtgtccatccccctggtgatctatgactgggcctgcagcagcagcagtgatgagggccactag

SEQ ID NO: 170718 - DNA, 1464 bp, Artificial Sequence; identical to SEQ ID NO: 170717
  Description of Artificial Sequence: Synthetic coding sequence

SEQ ID NO: 170719 - DNA, 1464 bp, Artificial Sequence; identical to SEQ ID NO: 170717
  Description of Artificial Sequence: Synthetic coding sequence

SEQ ID NO: 170720 - DNA, 1464 bp, Artificial Sequence; identical to SEQ ID NO: 170717
  Description of Artificial Sequence: Synthetic coding sequence

SEQ ID NO: 170721 - DNA, 1521 bp, Artificial Sequence
  Description of Artificial Sequence: Synthetic coding sequence
atgaagaaggccgagatgggccgcttcagcatcagcccagatgaggacagcagcagctacagcagcaacagcgacttcaactacagctaccccaccaagcaggccgccctgaagagccactatgcagatgtggaccctgagaaccagaacttcctgctggagagcaacctgggcaagaagaagtatgaaacagagttccaccctggcaccaccagctttggcatgtctgtgttcaacctgagcaatgccatcgtgggcagcggcatcctgggcctgtcctatgccatggccaacacaggaattgccctcttcatcatcctgctgacctttgtgtccatcttcagcctgtacagcgtgcacctgctgctgaagacagccaatgaaggaggcagcctgctgtatgagcagctgggctacaaggccttcggcctggtgggcaagctggccgccagcggcagcatcaccatgcagaacattggagccatgagcagctacctgttcatcgtgaagtatgagctgcccctggtgatccaggccctgaccaacatcgaggacaagacaggcctgtggtacctgaatggaaactacctggtgctgctggtgtccctggtggtgatcctgcccctgagcctcttcaggaacctgggctacctgggctacaccagcggcctgagcctgctgtgcatggtgttcttcctgattgtggtgatctgcaagaagttccaggtgccctgccctgtggaggccgccctgatcatcaatgagaccatcaacaccaccctgacccagcccacagccctggtgcctgccctgagccacaacgtgacagaaaatgacagctgccggccccactacttcatcttcaacagccagacagtgtatgctgtgcccatcctgatcttctcctttgtgtgccaccctgctgtgctgcccatctatgaggagctgaaggacaggagcagaagaaggatgatgaatgtgtccaagatctccttctttgccatgttcctgatgtacctgctggccgccctgtttggctacctgaccttctatgaacatgtggagagcgagctgctgcacacctacagcagcatcctgggcacagacatcctgctgctgattgtgcggctggccgtgctgatggctgtgaccctgactgtgcctgtggtgatcttccccatccgcagctctgtgacccacctgctgtgtgccagcaaggacttctcctggtggaggcacagcctcatcaccgtgtccatcctggccttcaccaacctgctggtgatctttgtgcccaccatccgggacatcttcggcttcatcggggccagcgctgcctccatgctgatcttcatcctgcccagcgccttctacatcaagctggtgaagaaggagcccatgaagtctgtgcagaagattggagccctcttcttcctgctgtctggagtgctggtgatgacaggctccatggccctgattgtgctggactgggtgcacaatgcccctgggggcggccactag

SEQ ID NO: 170722 - DNA, 1644 bp, Artificial Sequence
  Description of Artificial Sequence: Synthetic coding sequence
atggaccccatggagctgagaaatgtgaacattgaaccagatgatgagagcagcagtggagagagcgccccagacagctacatcggcatcggcaacagcgagaaggccgccatgagcagccagtttgccaatgaagacacagagagccagaagttcctgaccaacggcttcctgggcaagaagaagctggccgactatgcagatgagcaccaccctggcaccaccagctttggcatgagcagcttcaacctgagcaatgccatcatgggcagcggcatcctgggcctgtcctatgccatggccaacacaggcatcatcctcttcatcatcatgctgctggccgtggccatcctgagcctgtacagcgtgcacctgctgctgaagacagccaaggagggcggcagcctcatctatgagaagctgggggagaaggccttcggctggccaggcaagatcggggcctttgtgtccatcaccatgcagaacattggagccatgagcagctacctgttcatcatcaagtatgagctgcctgaggtgatccgggccttcatgggcctggaggagaacacaggagagtggtacctgaatggaaactacctgatcatctttgtgtctgtgggcatcatcctgcccctgagcctgctgaagaacctgggctacctgggctacaccagcggcttcagcctgacctgcatggtgttctttgtgtctgtggtgatctacaagaagttccagatcccctgccccctgcctgtgctggaccacagcgtgggcaacctgtccttcaacaacaccctgcccatgcacgtggtgatgctgcccaacaacagcgagagcagtgatgtgaacttcatgatggactacacccacaggaacccagctggcctggatgagaaccaggccaagggcagcctgcatgattctggagtggagtatgaggcccacagtgatgacaagtgtgagcccaagtactttgtgttcaacagcaggacagcctatgccatccccatcctggtgtttgcctttgtgtgccaccctgaggtgctgcccatctacagcgagctgaaggacaggagcaggaggaagatgcagacagtgagcaacatcagcatcaccggcatgctggtgatgtacctgctggccgccctgtttggctacctgaccttctatggagaggtggaggatgagctgctgcacgcctacagcaaggtgtacaccctggacatccccctgctgatggtgcggctggccgtgctggtggccgtgaccctgactgtgcccatcgtgctcttccccatccgcaccagcgtcatcaccctgctcttccccaagaggcccttctcctggatccgccacttcctgattgctgctgtgctgattgccctgaacaacgtgctggtgatcctggtgcccaccatcaagtacatcttcggcttcatcggggccagcagcgccaccatgctgatcttcatcctgcctgctgtgttctacctgaagctggtgaagaaggagaccttccgcagcccccagaaggtgggcgccctgatcttcctggtggtgggcatcttcttcatgattggctccatggccctgatcatcatcgactggatctatgacccccccaacagcaagcaccactag

SEQ ID NO: 170723 - DNA, 780 bp, Artificial Sequence
  Description of Artificial Sequence: Synthetic coding sequence
atggaccccatggagctgagaaatgtgaacattgaaccagatgatgagagcagcagtggagagagcgccccagacagctacatcggcatcggcaacagcgagaaggccgccatgagcagccagtttgccaatgaagacacagagagccagaagttcctgaccaacggcttcctgggcaagaagaagctggccgactatgcagatgagcaccaccctggcaccaccagctttggcatgagcagcttcaacctgagcaatgccatcatgggcagcggcatcctgggcctgtcctatgccatggccaacacaggcatcatcctcttcatcatcatgctgctggccgtggccatcctgagcctgtacagcgtgcacctgctgctgaagacagccaaggagggcggcagcctcatctatgagaagctgggggagaaggccttcggctggccaggcaagatcggggcctttgtgtccatcaccatgcagaacattggagccatgagcagctacctgttcatcatcaagtatgagctgcctgaggtgatccgggccttcatgggcctggaggagaacacaggagagtggtacctgaatggaaactacctgatcatctttgtgtctgtgggcatcatcctgcccctgagcctgctgaagaacctgggctacctgggctacaccagcggcttcagcctgacctgcatggtgttctttgtgtctgtgatgatctacaagaagatctccttcttcctgcagatcttcatcatcctgaagctgttcttctag

SEQ ID NO: 170724 - DNA, 1644 bp, Artificial Sequence; identical to SEQ ID NO: 170722
  Description of Artificial Sequence: Synthetic coding sequence

SEQ ID NO: 170725 - DNA, 579 bp, Artificial Sequence
  Description of Artificial Sequence: Synthetic coding sequence
atggaccccatggagctgagaaatgtgaacattgaaccagatgatgagagcagcagtggagagagcgccccagacagctacatcggcatcggcaacagcgagaaggccgccatgagcagccagtttgccaatgaagacacagagagccagaagttcctgaccaacggcttcctgggcaagaagaagctggccgactatgcagatgagcaccaccctggcaccaccagctttggcatgagcagcttcaacctgagcaatgccatcatgggcagcggcatcctgggcctgtcctatgccatggccaacacaggcatcatcctcttcatcatcatgctgctggccgtggccatcctgagcctgtacagcgtgcacctgctgctgaagacagccaaggagggcggcagcctcatctatgagaagctgggggagaaggccttcggctggccaggcaagatcggggcctttgtgtccatcaccatgcagaacattggagccatgagcagctacctgttcatcatcaagtatgagctgcctgaggtgatccgggccttcatgggcctggaggagaacacaggatag

SEQ ID NO: 170726 - DNA, 660 bp, Artificial Sequence
  Description of Artificial Sequence: Synthetic coding sequence
atggaccccatggagctgagaaatgtgaacattgaaccagatgatgagagcagcagtggagagagcgccccagacagctacatcggcatcggcaacagcgagaaggccgccatgagcagccagtttgccaatgaagacacagagagccagaagttcctgaccaacggcttcctgggcaagaagaagctggccgactatgcagatgagcaccaccctggcaccaccagctttggcatgagcagcttcaacctgagcaatgccatcatgggcagcggcatcctgggcctgtcctatgccatggccaacacaggcatcatcctcttcatcatcatgctgctggccgtggccatcctgagcctgtacagcgtgcacctgctgctgaagacagccaaggagggcggcagcctcatctatgagaagctgggggagaaggccttcggctggccaggcaagatcggggcctttgtgtccatcaccatgcagaacattggagccatgagcagctacctgttcatcatcaagtatgagctgcctgaggtgatccgggccttcatgggcctggaggagaacacaggagagtggtacctgaatggaaactacctgatcatctttgtgtctgtgggcatcatcctgcccctgagcctgctgaagaacctgtag

SEQ ID NO: 170727 - DNA, 1419 bp, Artificial Sequence
  Description of Artificial Sequence: Synthetic coding sequence
atggagctgcaggaccccaagatgaatggagccctgcccagtgatgctgtgggctaccggcaggagcgggagggcttcctgcccagccggggccctgcccctggcagcaagcctgtgcagttcatggactttgagggcaagaccagctttggcatgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggcctttggacctgctgggaaggtggtggtggccaccgtcatctgcctgcacaacgtgggcgccatgagcagctacctgttcatcatcaagtctgagctgcccctggtgattggcaccttcctgtacatggaccctgagggggactggttcctgaagggcaacctgctgatcatcatcgtgtctgtgctgatcatcctgcccctggccctgatgaagcacctgggctacctgggctacaccagcggcctgagcctgacctgcatgctgttcttcctggtgtctgtcatctacaagaagttccagctgggctgtgccatcggccacaatgaaacagccatggagagcgaggccctggtgggcctgcccagccagggcctgaacagcagctgtgaggcccagatgttcaccgtggacagccagatgagctacacagtgcccatcatggcctttgcctttgtgtgccaccctgaggtgctgcccatctacacagagctgtgccggcccagcaagaggaggatgcaggccgtggccaacgtgtccatcggggccatgttctgcatgtatggcctgacagccaccttcggctacctgaccttctacagctctgtgaaggccgagatgctgcacatgtacagccagaaggaccccctcatcctgtgtgtgcggctggccgtgctgctggccgtgaccctgactgtgcctgtggtgctcttccccatccggcgggccctgcagcagctgctcttccctgggaaggccttctcctggcccaggcatgtggccatcgccctgatcctgctggtgctggtgaatgtgctggtgatctgtgtgcccaccatccgggacatctttggagtcatcggcagcaccagcgcccccagcctcatcttcatcctgcccagcatcttctacctgcgcatcgtgcccagcgaggtggagcccttcctgtcctggcccaagatccaggccctgtgctttggagtgctgggcgtgctcttcatggctgtgtccctgggcttcatgtttgccaactgggccaccggccagagcaggatgagcggccactag

SEQ ID NO: 170728 - DNA, 1266 bp, Artificial Sequence
  Description of Artificial Sequence: Synthetic coding sequence
atgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggccttcggccctgctgggaaggtggtggtggccaccgtcatctgcctgcacaacgtgggcgccatgagcagctacctgttcatcatcaagtctgagctgcccctggtgattggcaccttcctgtacatggaccctgagggggactggttcctgaagggcaacctgctgatcatcatcgtgtctgtgctgatcatcctgcccctggccctgatgaagcacctgggctacctgggctacaccagcggcctgagcctgacctgcatgctgttcttcctggtgtctgtcatctacaagaagttccagctgggctgtgccatcggccacaatgaaacagccatggagagcgaggccctggtgggcctgcccagccagggcctgaacagcagctgtgaggcccagatgttcaccgtggacagccagatgagctacacagtgcccatcatggcctttgcctttgtgtgccaccctgaggtgctgcccatctacacagagctgtgccggcccagcaagaggaggatgcaggccgtggccaacgtgtccattggagccatgttctgcatgtatggcctgacagccaccttcggctacctgaccttctacagctctgtgaaggccgagatgctgcacatgtacagccagaaggaccccctcatcctgtgtgtgcggctggccgtgctgctggccgtgaccctgactgtgcctgtggtgctcttccccatcagaagagccctgcagcagctgctcttccctgggaaggccttctcctggcccaggcatgtggccatcgccctgatcctgctggtgctggtgaatgtgctggtgatctgtgtgcccaccatccgggacatcttcggcgtgattggcagcaccagcgcccccagcctcatcttcatcctgcccagcatcttctacctgagaattgtgcccagcgaggtggagcccttcctgtcctggcccaagatccaggccctgtgcttcggcgtgctgggcgtgctcttcatggctgtgtccctgggcttcatgtttgccaactgggccaccggccagagcaggatgagcggccactag

SEQ ID NO: 170729 - DNA, 1419 bp, Artificial Sequence; identical to SEQ ID NO: 170727
  Description of Artificial Sequence: Synthetic coding sequence

SEQ ID NO: 170730 - DNA, 660 bp, Artificial Sequence
  Description of Artificial Sequence: Synthetic coding sequence
atggagctgcaggaccccaagatgaatggagccctgcccagtgatgctgtgggctaccggcaggagcgggagggcttcctgcccagccggggccctgcccctggcagcaagcctgtgcagttcatggactttgagggcaagaccagctttggcatgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggcctttggacctgctgggaaggtggtggtggccaccgtcatctgcctgcacaacgtgggcgccatgagcagctacctgttcatcatcaagtctgagctgcccctggtgattggcaccttcctgtacatggaccctgagggggactggttcctgaagggcaacctgctgatcatcatcgtgtctgtgctgatcatcctgcccctggccctgatgaagcacctgggctacctgggctacaccagcggcctgagcctgacctgcatgctgttcttcctggtgtctgtcatctacaagaagttccagctgtag

SEQ ID NO: 170731 - DNA, 576 bp, Artificial Sequence
  Description of Artificial Sequence: Synthetic coding sequence
atggagctgcaggaccccaagatgaatggagccctgcccagtgatgctgtgggctaccggcaggagcgggagggcttcctgcccagccggggccctgcccctggcagcaagcctgtgcagttcatggactttgagggcaagaccagctttggcatgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggcctttggacctgctgggaaggtggtggtggccaccgtcatctgcctgcacaacgtgggcgccatgagcagctacctgttcatcatcaagtctgagctgcccctggtgattggcaccttcctgtacatggaccctgagggggactggttcctgaagggcaacctgctgatcatcatcgtgtctgtgctgatcatcctgcccctggccctgatgaagcacctgtag

SEQ ID NO: 170732 - DNA, 495 bp, Artificial Sequence
  Description of Artificial Sequence: Synthetic coding sequence
atggagctgcaggaccccaagatgaatggagccctgcccagtgatgctgtgggctaccggcaggagcgggagggcttcctgcccagccggggccctgcccctggcagcaagcctgtgcagttcatggactttgagggcaagaccagctttggcatgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggcctttggacctgctgggaaggtggtggtggccaccgtcatctgcctgcacaacgtgggcgccatgagcagctacctgttcatcatcaagtctgagctgcccctggtgattggcaccttcctgtacatggaccctgagggctag

SEQ ID NO: 170733 - DNA, 840 bp, Artificial Sequence
  Description of Artificial Sequence: Synthetic coding sequence
atggagctgcaggaccccaagatgaatggagccctgcccagtgatgctgtgggctaccggcaggagcgggagggcttcctgcccagccggggccctgcccctggcagcaagcctgtgcagttcatggactttgagggcaagaccagctttggcatgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggcctttggacctgctgggaaggtggtggtggccaccgtcatctgcctgcacaacgtgggcgccatgagcagctacctgttcatcatcaagtctgagctgcccctggtgattggcaccttcctgtacatggaccctgagggggactggttcctgaagggcaacctgctgatcatcatcgtgtctgtgctgatcatcctgcccctggccctgatgaagcacctgggctacctgggctacaccagcggcctgagcctgacctgcatgctgttcttcctggtgtctgtcatctacaagaagttccagctgggctgtgccatcggccacaatgaaacagccatggagagcgaggccctggtgggcctgcccagccagggcctgaacagcagctgtgaggcccagatgttcaccgtggacagccagatgagctacacagtgcccatcatggcctttgcctttgtgtgccaccctgaggtgctgcccatctactag

SEQ ID NO: 170734 - DNA, 819 bp, Artificial Sequence
  Description of Artificial Sequence: Synthetic coding sequence
atggagctgcaggaccccaagatgaatggagccctgcccagtgatgctgtgggctaccggcaggagcgggagggcttcctgcccagccggggccctgcccctggcagcaagcctgtgcagttcatggactttgagggcaagaccagctttggcatgtctgtgttcaacctgagcaatgccatcatgggcagcggcatcctgggcctggcctatgccatggcccacactggagtcatcttcttcctggccctgctgctgtgcatcgccctgctgagcagctacagcatccacctgctgctgacctgtgccggcattgctggcatccgggcctatgagcagctgggccagagggcctttggacctgctgggaaggtggtggtggccaccgtcatctgcctgcacaacgtgggcgccatgagcagctacctgttcatcatcaagtctgagctgcccctggtgattggcaccttcctgtacatggaccctgagggggactggttcctgaagggcaacctgctgatcatcatcgtgtctgtgctgatcatcctgcccctggccctgatgaagcacctgggctacctgggctacaccagcggcctgagcctgacctgcatgctgttcttcctggtgtctgtcatctacaagaagttccagctgggctgtgccatcggccacaatgaaacagccatggagagcgaggccctggtgggcctgcccagccagggcctgaacagcagctgtgaggcccagatgttcaccgtggacagccagatgagctacacagtgcccatcatggcctttgcctttgtgtgccactag

SEQ ID NO: 170735 - DNA, 1422 bp, Artificial Sequence
  Description of Artificial Sequence: Synthetic coding sequence
atggccacccaggccaagaggccccgggtggccggccctgtggatggaggagacctggaccctgtggcctgcttcctgtcctggtgccggcgggtgggcctggagctgagccccaaggtgtctgagcgggccggcggccgccgcacccggggcggggcccgggccgccctgaccagccccccagcccaggtggccgtgtcccggcagggcaccgtggccggctacggcatggtggcccgggagagcgtgcaggccggggagctgctgtttgtggtgcccagggctgccctgctgagccagcacacctgcagcattggaggcctgctggagcgggagcgggtggccctgcagagccagagcggctgggtgcccctgctgctggccctgctgcacgagctgcaggccccagccagccgctggaggccctactttgccctgtggccagagctgggccgcctggagcaccccatgttctggccagaggaggagcggcgctgcctgctgcagggcactggagtgcctgaggccgtggagaaggacctggccaacatccgctctgagtaccagagcatcgtgctgcccttcatggaggcccacccagacctcttcagcctgcgggtgcgcagcctggagctgtaccaccagctggtggccctggtgatggcctacagcttccaggagcccctggaggaggaggaggatgagaaggagcccaacagccctgtgatggtgcctgctgctgacatcctgaaccacctggccaaccacaatgccaacctggagtacagcgccaactgcctgaggatggtggccacccagcccatccccaagggccacgagatcttcaacacctacggccagatggccaactggcagctgatccacatgtatggctttgtggagccctacccagacaacacagatgacacagctgacatccagatggtgacagtgcgggaggccgccctgcagggcaccaagacagaggccgagcggcacctggtgtatgagcgctgggacttcctgtgcaagctggagatggtgggggaggagggcgccttcgtcatcggccgggaggaggtgctgacagaggaggagctgaccaccaccctgaaggtgctgtgcatgcctgctgaggagttccgggagctgaaggaccaggacggcggcggagatgacaagcgggaggagggcagcctgaccatcaccaacatccccaagctgaaggcctcctggaggcagctgctgcagaacagcgtgctgctgaccctgcagacctacgccacagacctgaagacagaccagggcctgctgagcaacaaggaggtgtatgccaagctgtcctggagggagcagcaggccctgcaggtgcgctatggccagaagatgatcctgcaccagctgctggagctgaccagctag

SEQ ID NO: 170736 - DNA, 975 bp, Artificial Sequence
  Description of Artificial Sequence: Synthetic coding sequence
atgggcccctggggcgagcctgagctgctggtgtggaggcctgaggccgtggccagcgagccccctgtgcctgtgggcctggaggtgaagctgggcgccctggtgctgctgctggtgctgaccctgctgtgcagcctggtgcccatctgtgtgctgcggcggcctggggccaaccacgagggcagcgccagccggcagaaggccctgagcctggtgtcctgctttgctgggggcgtcttcctggccacctgcctgctggacctgctgcctgactacctggccgccattgatgaggccctggccgccctgcacgtgaccctgcagttccccctgcaggagttcatcctggccatgggcttcttcctggtgctggtgatggagcagatcaccctggcctacaaggagcagagcggccccagccccctggaggagacccgggccctgctgggcaccgtgaatggaggcccccagcactggcatgatggccctggggtgccccaggccagcggggccccagccacccccagcgccctgcgggcctgtgtgctggtgttcagcctggccctgcacagcgtgtttgagggcctggccgtgggcctgcagagggaccgggcccgggccatggagctgtgcctggccctgctgctgcacaagggcatcctggccgtgtccctgagcctgcggctgctgcagagccacctgcgggcccaggtggtggccggctgcggcatcctcttcagctgcatgacccccctgggcatcggcctgggcgccgccctggccgagagcgctggccccctgcaccagctggcccagagcgtgctggagggcatggccgccggcaccttcctgtacatcaccttcctggagatcctgccccaggagctggccagcagcgagcagaggatcctgaaggtgatcctgctgctggccggctttgccctgctgaccggcctgctcttcatccagatctag

SEQ ID NO: 170737 - DNA, 975 bp, Artificial Sequence; identical to SEQ ID NO: 170736
  Description of Artificial Sequence: Synthetic coding sequence

SEQ ID NO: 170738 - DNA, 975 bp, Artificial Sequence; identical to SEQ ID NO: 170736
  Description of Artificial Sequence: Synthetic coding sequence

SEQ ID NO: 170739 - DNA, 975 bp, Artificial Sequence; identical to SEQ ID NO: 170736
  Description of Artificial Sequence: Synthetic coding sequence

SEQ ID NO: 170740 - DNA, 723 bp, Artificial Sequence
  Description of Artificial Sequence: Synthetic coding sequence
atgggcccctggggcgagcctgagctgctggtgtggaggcctgaggccgtggccagcgagccccctgtgcctgtgggcctggaggtgaagctgggcgccctggtgctgctgctggtgctgaccctgctgtgcagcctggtgcccatctgtgtgctgcggcggcctggggccaaccacgagggcagcgccagccggcagaaggccctgagcctggtgtcctgctttgctgggggcgtcttcctggccacctgcctgctggacctgctgcctgactacctggccgccattgatgaggccctggccgccctgcacgtgaccctgcagttccccctgcaggagttcatcctggccatgggcttcttcctggtgctggtgatggagcagatcaccctggcctacaaggagcagagcggccccagccccctggaggagacccgggccctgctgggcaccgtgaatggaggcccccagcactggcatgatggccctggggtgccccaggccagcggggccccagccacccccagcgccctgcgggcctgtgtgctggtgttcagcctggccctgcacagcgtgtttgagggcctggccgtgggcctgcagagggaccgggcccgggccatggagctgtgcctggccctgctgctgcacaagggcatcctggccgtgtccctgagcctgcggctgctgcagagccacctgcgggcccaggtggtggcctag

SEQ ID NO: 170741 - DNA, 621 bp, Artificial Sequence
  Description of Artificial Sequence: Synthetic coding sequence
atgggcccctggggcgagcctgagctgctggtgtggaggcctgaggccgtggccagcgagccccctgtgcctgtgggcctggaggtgaagctgggcgccctggtgctgctgctggtgctgaccctgctgtgcagcctggtgcccatctgtgtgctgcggcggcctggggccaaccacgagggcagcgccagccggcagaaggccctgagcctggtgtcctgctttgctgggggcgtcttcctggccacctgcctgctggacctgctgcctgactacctggccgccattgatgaggccctggccgccctgcacgtgaccctgcagttccccctgcaggagttcatcctggccatgggcttcttcctggtgctggtgatggagcagatcaccctggcctacaaggagcagagcggccccagccccctggaggagacccgggccctgctgggcaccgtgaatggaggcccccagcactggcatgatggccctggggtgccccaggccagcggggccccagccacccccagcgccctgcgggcctgtgtgctggtgttcagcctggccctgcacagcgtgtttgagggcctggccgtgggcctgcagagggaccgggccaggtag

SEQ ID NO: 170742 - DNA, 966 bp, Artificial Sequence
  Description of Artificial Sequence: Synthetic coding sequence
atgggcccctggggcgagcctgagctgctggtgtggaggcctgaggccgtggccagcgagccccctgtgcctgtgggcctggaggtgaagctgggcgccctggtgctgctgctggtgctgaccctgctgtgcagcctggtgcccatctgtgtgctgcggcggcctggggccaaccacgagggcagcgccagccggcagaaggccctgagcctggtgtcctgctttgctgggggcgtcttcctggccacctgcctgctggacctgctgcctgactacctggccgccattgatgaggccctggccgccctgcacgtgaccctgcagttccccctgcaggagttcatcctggccatgggcttcttcctggtgctggtgatggagcagatcaccctggcctacaaggagcagagcggccccagccccctggaggagacccgggccctgctgggcaccgtgaatggaggcccccagcactggcatgatggccctggggtgccccaggccagcggggccccagccacccccagcgccctgcgggcctgtgtgctggtgttcagcctggccctgcacagcgtgtttgagggcctggccgtgggcctgcagagggaccgggcccgggccatggagctgtgcctggccctgctgctgcacaagggcatcctggccgtgtccctgagcctgcggctgctgcagagccacctgcgggcccaggtggtggccggctgcggcatcctcttcagctgcatgacccccctgggcatcggcctgggcgccgccctggccgagagcgctggccccctgcaccagctggcccagagcgtgctggagggcatggccgccggcaccttcctgtacatcaccttcctggagatcctgccccaggagctggccagcagcgagcagaggatcctgaaggtgatcctgctgctggccggctttgccctgctgaccggcctgctcttctag

SEQ ID NO: 170743 - DNA, 669 bp, Artificial Sequence
  Description of Artificial Sequence: Synthetic coding sequence
atgaaggcccagctgcagttccccctgcaggagttcatcctggccatgggcttcttcctggtgctggtgatggagcagatcaccctggcctacaaggagcagagcggccccagccccctggaggagacccgggccctgctgggcaccgtgaatggaggcccccagcactggcatgatggccctggggtgccccaggccagcggggccccagccacccccagcgccctgcgggcctgtgtgctggtgttcagcctggccctgcacagcgtgtttgagggcctggccgtgggcctgcagagggaccgggcccgggccatggagctgtgcctggccctgctgctgcacaagggcatcctggccgtgtccctgagcctgcggctgctgcagagccacctgcgggcccaggtggtggccggctgcggcatcctcttcagctgcatgacccccctgggcatcggcctgggcgccgccctggccgagagcgctggccccctgcaccagctggcccagagcgtgctggagggcatggccgccggcaccttcctgtacatcaccttcctggagatcctgccccaggagctggccagcagcgagcagaggatcctgaaggtgatcctgctgctggccggctttgccctgctgaccggcctgctcttcatccagatctag

SEQ ID NO: 170744 - DNA, 942 bp, Artificial Sequence
  Description of Artificial Sequence: Synthetic coding sequence
atgggcccctggggcgagcctgagctgctggtgtggaggcctgaggccgtggccagcgagccccctgtgcctgtgggcctggtgctgaccctgctgtgcagcctggtgcccatctgtgtgctgcggcggcctggggccaaccacgagggcagcgccagccggcagaaggccctgagcctggtgtcctgctttgctggaggagtcttcctggccacctgcctgctggacctgctgcctgactacctggccgccattgatgaggccctggccgccctgcacgtgaccctgcagttccccctgcaggagttcatcctggccatgggcttcttcctggtgctggtgatggagcagatcaccctggcctacaaggagcagagcggccccagccccctggaggagacccgggccctgctgggcaccgtgaatggaggcccccagcactggcatgatggccctggggtgccccaggccagcggggccccagccaccccatctgccctgcgggcctgtgtgctggtgttcagcctggccctgcacagcgtgtttgagggcctggccgtgggcctgcagagggaccgggcccgggccatggagctgtgcctggccctgctgctgcacaagggcatcctggccgtgtccctgagcctgcggctgctgcagagccacctgcgggcccaggtggtggccggctgcggcatcctcttcagctgcatgacccccctgggcatcggcctgggcgccgccctggccgagagcgctggccccctgcaccagctggcccagagcgtgctggagggcatggctgctggcaccttcctgtacatcaccttcctggagatcctgccccaggagctggccagcagcgagcagaggatcctgaaggtgatcctgctgctggccggctttgccctgctgaccggcctgctcttcatccagatctag

SEQ ID NO: 170745 - DNA, 1095 bp, Artificial Sequence
  Description of Artificial Sequence: Synthetic coding sequence
atgcctggctgcccctgccccggctgcggcatggccggcccccggctgctcttcctgacagccctggccctggagctgctggagcgggccggcggcagccagcctgccctgcggagccggggcacagccacagcctgccgcctggacaacaaggagagcgagagctggggcgccctgctgtctggagagcggctggacacctggatctgcagcctgctgggcagcctgatggtgggcctgtctggagtcttccccctgctggtgatccccctggagatgggcaccatgctgcggtctgaggccggggcctggaggctgaagcagctgctgagctttgccctgggcggcctgctgggcaatgtgttcctgcacctgctgcctgaggcctgggcctacacctgcagcgccagccctggaggagagggccagagcctgcagcagcagcagcagctgggcctgtgggtgattgctggcatcctgaccttcctggccctggagaagatgttcctggacagcaaggaggagggcaccagccaggcccccaacaaggaccccacagctgctgctgctgccctgaatggaggccactgcctggcccagcctgctgctgagcccggcctgggcgctgtggtgcgcagcatcaaggtgtctggctacctgaacctgctggccaacaccatcgacaacttcacccacggcctggccgtggccgccagcttcctggtgtccaagaagattggcctgctgaccaccatggccatcctgctgcacgagatcccccatgaggtgggggactttgccatcctgctgcgggccggctttgaccgctggagcgctgccaagctgcagctgagcacagccctgggcggcctgctgggcgccggctttgccatctgcacccagagccccaagggcgtggaggagacagctgcctgggtgctgcccttcaccagcggcggcttcctgtacatcgccctggtgaatgtgctgcctgacctgctggaggaggaggacccctggaggagcctgcagcagctgctgctgctgtgtgccggcatcgtggtgatggtgctcttcagcctgtttgtggactag

SEQ ID NO: 170746 - DNA, 1116 bp, Artificial Sequence
  Description of Artificial Sequence: Synthetic coding sequence
atgcctggctgcccctgccccggctgcggcatggccggcccccggctgctcttcctgacagccctggccctggagctgctggagcgggccggcggcagccagcctgccctgcggagccggggcacagccacagcctgccgcctggacaacaaggagagcgagagctggggcgccctgctgtctggagagcggctggacacctggatctgcagcctgctgggcagcctgatggtgggcctgtctggagtcttccccctgctggtgatccccctggagatgggcaccatgctgcggtctgaggccggggcctggaggctgaagcagctgctgagctttgccctgggcggcctgctgggcaatgtgttcctgcacctgctgcctgaggcctgggcctacacctgcagcgccagccctggaggagagggccagagcctgcagcagcagcagcagctgggcctgtgggtgattgctggcatcctgaccttcctggccctggagaagatgttcctggacagcaaggaggagggcaccagccaggcccccaacaaggaccccacagctgctgctgctgccctgaatggaggccactgcctggcccagcctgctgctgagcccggcctgggcgctgtggtgcgcagcatcaaggtgtctggctacctgaacctgctggccaacaccatcgacaacttcacccacggcctggccgtggccgccagcttcctggtgtccaagaagattggcctgctgaccaccatggccatcctgctgcacgagatcccccatgaggtgggggactttgccatcctgctgcgggccggctttgaccgctggagcgctgccaagctgcagctgagcacagccctgggcggcctgctgggcgccggctttgccatctgcacccagagccccaagggcgtggtgggctgcagccctgctgctgaggagacagctgcctgggtgctgcccttcaccagcggcggcttcctgtacatcgccctggtgaatgtgctgcctgacctgctggaggaggaggacccctggaggagcctgcagcagctgctgctgctgtgtgccggcatcgtggtgatggtgctcttcagcctgtttgtggactag

SEQ ID NO: 170747 - DNA, 930 bp, Artificial Sequence
  Description of Artificial Sequence: Synthetic coding sequence
atggagcagctgctgggcatcaagctgggctgcctgtttgccctgctggccctgaccctgggctgcggcctgacccccatctgcttcaagtggttccagattgatgctgcccggggccaccaccggctggtgctgcggctgctgggctgcatctctgctggggtcttcctgggcgccggcttcatgcacatgacagctgaggccctggaggagattgagagccagatccagaagttcatggtgcagaacagaagtgccagcgagaggaacagcagtggagatgctgacagcgcccacatggagtacccctacggggagctgatcatcagcctgggcttcttctttgtgttcttcctggagagcctggccctgcagtgctgccctggagctgctgggggcagcacagtgcaggatgaggagtggggcggggcccacatctttgagctgcacagccacggccacctgcccagccccagcaagggccccctgcgggccctggtgctgctgctgagcctgtccttccacagcgtgtttgagggcctggccgtgggcctgcagcccaccgtggccgccaccgtgcagctgtgcctggccgtgctggcccacaagggcctggtggtgtttggagtgggcatgaggctggtgcacctgggcaccagcagccgctgggccgtgttcagcatcctgctgctggccctgatgagccccctgggcctggccgtgggcctggccgtgactggaggagacagcgagggcggccggggcctggcccaggccgtgctggagggcgtggccgccggcaccttcctgtatgtgaccttcctggagatcctgccccgggagctggccagccctgaggcccccctggccaagtggagctgtgtggccgccggctttgccttcatggccttcatcgccctgtgggcctag

SEQ ID NO: 170748 - DNA, 945 bp, Artificial Sequence
  Description of Artificial Sequence: Synthetic coding sequence
atggtgaagctgctggtggccaagatcctgtgcatggtgggcgtcttcttcttcatgctgctgggcagcctgctgcctgtgaagatcatcgagacagactttgagaaggcccacaggagcaagaagatcctgagcctgtgcaacaccttcggcggcggcgtcttcctggccacctgcttcaatgccctgctgcctgctgtgcgggagaagctgcagaaggtgctgagcctgggccacatcagcacagactaccccctggccgagaccatcctgctgctgggcttcttcatgaccgtcttcctggagcagctgatcctgaccttcaggaaggagaagcccagcttcatcgacctggagaccttcaatgccggcagtgatgtgggcagtgacagtgaatatgagagccccttcatgggcggggcccggggccacgccctgtatgtggagccccacggccacggccccagcctgtctgtgcagggcctgagccgggccagccctgtgcggctgctgagcctggcctttgccctgagcgcccacagcgtgtttgagggcctggccctgggcctgcaggaggagggggagaaggtggtgtccctgtttgtgggcgtggccgtgcatgagaccctggtggccgtggccctgggcatctccatggcccggagcgccatgcccctgagagatgctgccaagctggccgtgacagtgtctgccatgatccccctgggcatcggcctgggcctgggcatcgagagcgcccagggcgtgcccggctctgtggcctctgtgctgctgcagggcctggccggcggcaccttcctgttcatcaccttcctggagatcctggccaaggagctggaggagaagagtgaccggctgctgaaggtgctcttcctggtgctgggctacacagtgctggccggcatggtgttcctgaagtggtag

SEQ ID NO: 170749 - DNA, 318 bp, Artificial Sequence
  Description of Artificial Sequence: Synthetic coding sequence
atggtgaagctgctggtggccaagatcctgtgcatggtgggcgtcttcttcttcatgctgctgggcagcctgctgcctgtgaagatcatcgagacagactttgagaaggcccacaggagcaagaagatcctgagcctgtgcaacaccttcggcggcggcgtcttcctggccacctgcttcaatgccctgctgcctgctgtgcgggagaaggtgcgggccccctgggccctggccgccgccctgggcaccctgtggccccgggacagtgatgccttcagcaccctgatgcccagctctgtgaaggccctgatgctgtag

SEQ ID NO: 170750 - DNA, 972 bp, Artificial Sequence
  Description of Artificial Sequence: Synthetic coding sequence
atggtgaagctgctggtggccaagatcctgtgcatggtgggcgtcttcttcttcatgctgctgggcagcctgctgcctgtgaagatcatcgagacagactttgagaaggcccacaggagcaagaagatcctgagcctgtgcaacaccttcggcggcggcgtcttcctggccacctgcttcaatgccctgctgcctgctgtgcgggagaagctgcagaaggtgctgagcctgggccacatcagcacagactaccccctggccgagaccatcctgctgctgggcttcttcatgaccgtcttcctggagcagctgatcctgaccttcaggaaggagaagcccagcttcatcgacctggagaccttcaatgccggcagtgatgtgggcagtgacagtgaatatgagagccccttcatgggcggggcccggggccacgccctgtatgtggagccccacggccacggccccagcctgtctgtgcagggcctgagccgggccagccctgtgcggctgctgagcctggcctttgccctgagcgcccacagcgtgtttgagggcctggccctgggcctgcaggaggagggggagaaggtggtgtccctgtttgtgggcgtggccgtgcatgagaccctggtggccgtggccctgggcatctccatggcccggagcgccatgcccctgagagatgctgccaagctggccgtgacagtgtctgccatgatccccctgggcatcggcctgggcctgggcatcgagagcgcccagggcgtgcccggctctgtggcctctgtgctgctgcagggcctggccggcggcaccttcctgttcatcaccttcctggagatcctggccaaggagctggaggagaagagtgaccggctgctgaaggtgctcttcctggtgctgggctacacagtgctggccggcatggtgttcctgaagtggatcagccccccagagccccgggtgtcctag

SEQ ID NO: 170751 - DNA, 1869 bp, Artificial Sequence
  Description of Artificial Sequence: Synthetic coding sequence
atggtggatgtggtgggcctggagcgggagaccggcccccggggcagcccctggccaggcctgcccctgcccagcctggtgggccctgcccccctgctgacctgcctgtgcccccagtgcctgtctgtggaggatgccctgggcctgggggagcctgagggcagcggcctgcccccaggccctgtgctggaggcccgctacgtggcccggctgtctgctgctgctgtgctgtacctgagcaaccctgagggcacctgtgaagatgcccgggccggcctgtgggccagccacgccgaccacctgctggccctgctggagagccccaaggccctgaccccaggcctgtcctggctgctgcagaggatgcaggcccgggctgctggccagacccccaagacagcctgtgtggacatcccccagctgctggaggaggccgtgggcgctggggcccctggcagcgctgggggcgtgctggccgccctgctggaccacgtgcgcagcggcagctgcttccacgccctgcccagcccccagtactttgtggactttgtgttccagcagcacagcagcgaggtgcccatgaccctggccgagctgagcgccctgatgcagaggctgggcgtgggccgggaggcccacagcgaccacagccaccgccacagaggagccagctcctgggaccctgtgcccctcatcagcagcagcaacagcagctctgtgtgggacacagtgtgcctgagcgccagagatgtgatggccgcctacggcctgtctgagcaggccggcgtgaccccagaggcctgggcccagctgagccctgccctgctgcagcagcagctgagcggggcctgcaccagccagagccggccccctgtgcaggaccagctgagccagagcgagcgctacctgtatggcagcctggccaccctgctgatctgcctgtgtgctgtgtttggcctgctgctgctgacctgcaccggctgccggggcgtgacccactacatcctgcagaccttcctgagcctggccgtgggcgccctgactggagatgctgtgctgcacctgacccccaaggtgctgggcctgcacacccacagcgaggagggcctgagcccccagcccacctggaggctgctggccatgctggccggcctgtatgccttcttcctgtttgagaacctcttcaacctgctgctgccccgggaccctgaggacctggaggatggcccctgtggccacagcagccacagccacggcggccacagccatggagtgtccctgcagctggcccccagcgagctgcggcagcccaagccccctcatgagggcagcagagctgacctggtggccgaggagagccctgagctgctgaaccctgagccccggcggctgagccctgagctgcggctgctgccctacatgatcaccctgggagatgctgtgcacaactttgctgatggcctggccgtgggcgccgcctttgccagctcctggaagacaggcctggccaccagcctggccgtgttctgccacgagctgccccatgagctgggggactttgctgccctgctgcacgccggcctgtctgtgcggcaggccctgctgctgaacctggccagcgccctgacagcctttgctggcctgtatgtggccctggccgtgggcgtgtctgaggagagcgaggcctggatcctggccgtggccaccggcctcttcctgtatgtggccctgtgtgacatgctgcctgccatgctgaaggtgcgggacccccggccctggctgctcttcctgctgcacaacgtgggcctgctgggcggctggacagtgctgctgctgctgagcctgtatgaagatgacatcaccttctag

SEQ ID NO: 170752 - DNA, 1944 bp, Artificial Sequence
  Description of Artificial Sequence: Synthetic coding sequence
atggccagcctggtgtccctggagctgggcctgctgctggccgtgctggtggtgacagccacagccagccccccagctggcctgctgagcctgctgaccagcggccagggcgccctggaccaggaggccctgggcggcctgctgaacaccctggccgacagagtgcactgtgccaacggcccctgtgggaagtgcctgtctgtggaggatgccctgggcctgggggagcctgagggcagcggcctgcccccaggccctgtgctggaggcccgctacgtggcccggctgtctgctgctgctgtgctgtacctgagcaaccctgagggcacctgtgaagatgcccgggccggcctgtgggccagccatgctgaccacctgctggccctgctggagagccccaaggccctgaccccaggcctgtcctggctgctgcagaggatgcaggcccgggccgccggccagacccccaagacagcctgtgtggacatcccccagctgctggaggaggccgtgggcgctggggcccctggcagcgctggaggagtgctggccgccctgctggaccacgtgcgcagcggcagctgcttccacgccctgcccagcccccagtactttgtggactttgtgttccagcagcacagcagcgaggtgcccatgaccctggccgagctgagcgccctgatgcagaggctgggcgtgggccgggaggcccacagcgaccacagccaccgccacagaggagccagctcctgggaccctgtgcccctcatcagcagcagcaacagcagctctgtgtgggacacagtgtgcctgagcgccagagatgtgatggccgcctacggcctgtctgagcaggccggcgtgaccccagaggcctgggcccagctgagccctgccctgctgcagcagcagctgagcggggcctgcaccagccagagcaggcctcctgtgcaggaccagctgagccagagcgagcgctacctgtatggcagcctggccaccctgctgatctgcctgtgtgctgtgtttggcctgctgctgctgacctgcaccggctgccggggcgtgacccactacatcctgcagaccttcctgagcctggccgtgggcgccctgactggagatgctgtgctgcacctgacccccaaggtgctgggcctgcacacccacagcgaggagggcctgagcccccagcccacctggaggctgctggccatgctggccggcctgtatgccttcttcctgtttgaaaatctcttcaacctgctgctgccccgggaccctgaggacctggaggatggcccctgtggccacagcagccacagccatggaggccacagccacggcgtgtccctgcagctggcccccagcgagctgcggcagcccaagccccctcatgagggcagcagagctgacctggtggccgaggagagccctgagctgctgaaccctgagccccggcggctgagccctgagctgcggctgctgccctacatgatcaccctgggagatgctgtgcacaactttgctgatggcctggccgtgggcgccgcctttgccagctcctggaagacaggcctggccaccagcctggccgtgttctgccacgagctgccccatgagctgggggactttgctgccctgctgcatgctggcctgtctgtgcggcaggccctgctgctgaacctggccagcgccctgacagcctttgctggcctgtatgtggccctggccgtgggcgtgtctgaggagagcgaggcctggatcctggccgtggccaccggcctcttcctgtatgtggccctgtgtgacatgctgcctgccatgctgaaggtgcgggacccccggccctggctgctcttcctgctgcacaacgtgggcctgctgggcggctggacagtgctgctgctgctgagcctgtatgaagatgacatcaccttctag

SEQ ID NO: 170753 - DNA, 1410 bp, Artificial Sequence
  Description of Artificial Sequence: Synthetic coding sequence
atggcccggggcctgggcgccccccactgggtggccgtgggcctgctgacctgggccaccctgggcctgctggtggccggcctgggcggccatgatgacctgcatgatgacctgcaggaggacttccacggccacagccaccgccacagccatgaggacttccaccacggccacagccacgcccacggccacggccacacccatgagagcatctggcacggccacacccatgaccatgaccacggccacagccatgaggacctgcaccacggccacagccacggctacagccatgagagcctgtaccaccggggccacggccatgaccacgagcacagccacggcggctatggagagagcggggcccctggcatcaagcaggacctggatgctgtgaccctgtgggcctatgccctgggcgccaccgtgctgatctctgctgcccccttctttgtgctcttcctgatccctgtggagagcaacagccccaggcacaggagcctgctgcagatcctgctgagctttgccagcggcggcctgctgggagatgccttcctgcacctgatcccccacgccctggagccccacagccaccacaccctggagcagcccggccacggccacagccacagcggccagggccccatcctgtctgtgggcctgtgggtgctgtctggaattgtggccttcctggtggtggagaagtttgtgagacatgtgaagggcggccacggccacagccacggccacggccacgcccacagccacacccggggcagccacggccacggccggcaggagaggagcaccaaggagaagcagagcagcgaggaggaggagaaggagacccggggcgtgcagaagagaagaggaggcagcacagtgcccaaggatggccctgtgcggccccagaatgctgaggaggagaagaggggcctggacctgcgggtgtctggctacctgaacctggccgctgacctggcccacaacttcacagatggcctggccatcggggccagcttccggggcggccggggcctgggcatcctgaccaccatgacagtgctgctgcacgaggtgccccatgaggtgggggactttgccatcctggtgcagagcggctgcagcaagaagcaggccatgaggctgcagctgctgacagctgtgggcgccctggccggcacagcctgtgccctgctgacagaaggaggagctgtgggcagcgagattgctggaggagctggccctggctgggtgctgcccttcaccgctgggggcttcatctacgtggccaccgtgtctgtgctgcctgagctgctgcgggaggccagccccctgcagagcctgctggaggtgctgggcctgctgggcggcgtcatcatgatggtgctgattgcccacctggagtag

SEQ ID NO: 170754 - DNA, 1410 bp, Artificial Sequence; identical to SEQ ID NO: 170753
  Description of Artificial Sequence: Synthetic coding sequence

SEQ ID NO: 170755 - DNA, 1410 bp, Artificial Sequence; identical to SEQ ID NO: 170753
  Description of Artificial Sequence: Synthetic coding sequence

SEQ ID NO: 170756 - DNA, 1410 bp, Artificial Sequence; identical to SEQ ID NO: 170753
  Description of Artificial Sequence: Synthetic coding sequence

SEQ ID NO: 170757 - DNA, 663 bp, Artificial Sequence
  Description of Artificial Sequence: Synthetic coding sequence
atggacagcagcctgcctgaatgtcgccacatcggcaagggcatccgggccaaggtggagaggaacttcctgttcagccgggacctgaaggccggcctgccccggcccagcaagccaggcaaggagcgcatccctgagcccgccctgggcgccaccgtgctgatctctgctgcccccttctttgtgctcttcctgatccctgtggagagcaacagccccaggcacaggagcctgctgcagatcctgctgagctttgccagcggcggcctgctgggagatgccttcctgcacctgatcccccacgccctggagccccacagccaccacaccctggagcagcccggccacggccacagccacagcggccagggccccatcctgtctgtgggcctgtgggtgctgtctggaattgtggccttcctggtggtggagaagtttgtgagacatgtgaagggcggccacggccacagccacggccacggccacgcccacagccacacccggggcagccacggccacggccggcaggagaggagcaccaaggagaagcagagcagcgaggaggaggagaaggagacccggggcgtgcagaagagaagaggaggcagcacagtgcccaaggatggccctgtgcggccccagaatgctgaggaggagaagtag

SEQ ID NO: 170758 - DNA, 663 bp, Artificial Sequence; identical to SEQ ID NO: 170757
  Description of Artificial Sequence: Synthetic coding sequence

SEQ ID NO: 170759 - DNA, 1410 bp, Artificial Sequence; identical to SEQ ID NO: 170753
  Description of Artificial Sequence: Synthetic coding sequence

SEQ ID NO: 170760 - DNA, 1410 bp, Artificial Sequence; identical to SEQ ID NO: 170753
  Description of Artificial Sequence: Synthetic coding sequence

SEQ ID NO: 170761 - DNA, 1410 bp, Artificial Sequence; identical to SEQ ID NO: 170753
  Description of Artificial Sequence: Synthetic coding sequence

SEQ ID NO: 170762 - DNA, 663 bp, Artificial Sequence; identical to SEQ ID NO: 170757
  Description of Artificial Sequence: Synthetic coding sequence

SEQ ID NO: 170763 - DNA, 663 bp, Artificial Sequence; identical to SEQ ID NO: 170757
  Description of Artificial Sequence: Synthetic coding sequence

SEQ ID NO: 170764 - DNA, 1410 bp, Artificial Sequence; identical to SEQ ID NO: 170753
  Description of Artificial Sequence: Synthetic coding sequence

SEQ ID NO: 170765 - DNA, 1410 bp, Artificial Sequence; identical to SEQ ID NO: 170753
  Description of Artificial Sequence: Synthetic coding sequence

SEQ ID NO: 170766 - DNA, 1410 bp, Artificial Sequence; identical to SEQ ID NO: 170753
  Description of Artificial Sequence: Synthetic coding sequence

SEQ ID NO: 170767 - DNA, 1410 bp, Artificial Sequence; identical to SEQ ID NO: 170753
  Description of Artificial Sequence: Synthetic coding sequence

SEQ ID NO: 170768 - DNA, 663 bp, Artificial Sequence; identical to SEQ ID NO: 170757
  Description of Artificial Sequence: Synthetic coding sequence

SEQ ID NO: 170769 - DNA, 1125 bp, Artificial Sequence
  Description of Artificial Sequence: Synthetic coding sequence
atggcccggggcctgggcgccccccactgggtggccgtgggcctgctgacctgggccaccctgggcctgctggtggccggcctgggcggccatgatgacctgcatgatgacctgcaggaggacttccacggccacagccacagcgctgacctgagcagcagcatcttctgccccctgccctacccccggggcgtggagctgagccctgccagcctgagcaccagtgacctggcccagttctgcttccgctgggcccctggccgctgcttcctgcacctgatcccccacgccctggagccccacagccaccacaccctggagcagcccggccacggccacagccacagcggccagggccccatcctgtctgtgggcctgtgggtgctgagcggcatcgtggccttcctggtggtggagaagtttgtgcgccacgtgaagggcggccacggccacagccacggccacggccacgcccacagccacacccggggcagccacggccacggccggcaggagaggagcaccaaggagaagcagagcagcgaggaggaggagaaggagacccggggcgtgcagaagaggcggggcggcagcacagtgcccaaggatggccctgtgcggccccagaatgctgaggaggagaagaggggcctggacctgcgggtgtctggctacctgaacctggccgctgacctggcccacaacttcacagatggcctggccatcggggccagcttccggggcggccggggcctgggcatcctgaccaccatgacagtgctgctgcacgaggtgccccatgaggtgggggactttgccatcctggtgcagagcggctgcagcaagaagcaggccatgaggctgcagctgctgacagctgtgggcgccctggccggcacagcctgtgccctgctgacagagggcggcgctgtgggcagcgagattgctgggggcgccggccctggctgggtgctgcccttcaccgctgggggcttcatctacgtggccaccgtgtctgtgctgcctgagctgctgcgggaggccagccccctgcagagcctgctggaggtgctgggcctgctgggcggcgtcatcatgatggtgctgattgcccacctggagtag

SEQ ID NO: 170770 - DNA, 1353 bp, Artificial Sequence
  Description of Artificial Sequence: Synthetic coding sequence
atggcccggggcctgggcgccccccactgggtggccgtgggcctgctgacctgggccaccctgggcctgctggtggccggcctgggcggccatgatgacctgcatgatgacctgcaggaggacttccacggccacggccacacccatgagagcatctggcacggccacacccatgaccatgaccacggccacagccatgaggacctgcaccacggccacagccacggctacagccatgagagcctgtaccaccggggccacggccatgaccacgagcacagccatggaggctacggggagagcggggcccctggcatcaagcaggacctggatgctgtgaccctgtgggcctatgccctgggcgccaccgtgctgatctctgctgcccccttctttgtgctcttcctgatccctgtggagagcaacagccccaggcacaggagcctgctgcagatcctgctgagctttgccagcggcggcctgctgggagatgccttcctgcacctgatcccccacgccctggagccccacagccaccacaccctggagcagcccggccacggccacagccacagcggccagggccccatcctgtctgtgggcctgtgggtgctgagcggcatcgtggccttcctggtggtggagaagtttgtgcgccacgtgaagggcggccacggccacagccacggccacggccacgcccacagccacacccggggcagccacggccacggccggcaggagaggagcaccaaggagaagcagagcagcgaggaggaggagaaggagacccggggcgtgcagaagaggcggggcggcagcacagtgcccaaggatggccctgtgcggccccagaatgctgaggaggagaagaggggcctggacctgcgggtgtctggctacctgaacctggccgctgacctggcccacaacttcacagatggcctggccatcggggccagcttccggggcggccggggcctgggcatcctgaccaccatgacagtgctgctgcacgaggtgccccatgaggtgggggactttgccatcctggtgcagagcggctgcagcaagaagcaggccatgaggctgcagctgctgacagctgtgggcgccctggccggcacagcctgtgccctgctgacagagggcggcgctgtgggcagcgagattgctgggggcgccggccctggctgggtgctgcccttcaccgctgggggcttcatctacgtggccaccgtgtctgtgctgcctgagctgctgcgggaggccagccccctgcagagcctgctggaggtgctgggcctgctgggcggcgtcatcatgatggtgctgattgcccacctggagtag

SEQ ID NO: 170771 - DNA, 663 bp, Artificial Sequence; identical to SEQ ID NO: 170757
  Description of Artificial Sequence: Synthetic coding sequence

SEQ ID NO: 170772 - DNA, 1410 bp, Artificial Sequence; identical to SEQ ID NO: 170753
  Description of Artificial Sequence: Synthetic coding sequence

SEQ ID NO: 170773 - DNA, 1125 bp, Artificial Sequence; identical to SEQ ID NO: 170769
  Description of Artificial Sequence: Synthetic coding sequence

SEQ ID NO: 170774 - DNA, 1353 bp, Artificial Sequence; identical to SEQ ID NO: 170770
  Description of Artificial Sequence: Synthetic coding sequence

SEQ ID NO: 170775 - DNA, 1125 bp, Artificial Sequence; identical to SEQ ID NO: 170769
  Description of Artificial Sequence: Synthetic coding sequence

SEQ ID NO: 170776 - DNA, 1125 bp, Artificial Sequence; identical to SEQ ID NO: 170769
  Description of Artificial Sequence: Synthetic coding sequence

SEQ ID NO: 170777 - DNA, 1353 bp, Artificial Sequence; identical to SEQ ID NO: 170770
  Description of Artificial Sequence: Synthetic coding sequence

SEQ ID NO: 170778 - DNA, 1353 bp, Artificial Sequence; identical to SEQ ID NO: 170770
  Description of Artificial Sequence: Synthetic coding sequence

SEQ ID NO: 170779 - DNA, 1125 bp, Artificial Sequence; identical to SEQ ID NO: 170769
  Description of Artificial Sequence: Synthetic coding sequence

SEQ ID NO: 170780 - DNA, 1353 bp, Artificial Sequence; identical to SEQ ID NO: 170770
  Description of Artificial Sequence: Synthetic coding sequence

SEQ ID NO: 170781 - DNA, 1353 bp, Artificial Sequence; identical to SEQ ID NO: 170770
  Description of Artificial Sequence: Synthetic coding sequence

SEQ ID NO: 170782 - DNA, 1125 bp, Artificial Sequence; identical to SEQ ID NO: 170769
  Description of Artificial Sequence: Synthetic coding sequence

SEQ ID NO: 170783 - DNA, 2391 bp, Artificial Sequence
  Description of Artificial Sequence: Synthetic coding sequence
atgctggcccccctgagaaatgcccctggccgggagggcgccaccagccccagccccccaacagatgccaccggcagcctgggggagtgggatgtggacagaaatgtgaagacagagggctgggtgtccaaggagcgcatcagcaagctgcaccggctgaggatggctgacatcctgagccagagcgagaccctggccagccaggacctgagcggggacttcaagaagccagccctgcctgtgtccccagctgcccggagcaaggccccagccagcagcagcagcaaccctgaggaggtgcagaaggagggccccacagccctgcaggacagcaacagcggggagccagacatccccccaccccagcctgactgtggggacttccgcagcctgcaggaggagcagagccggcccccaacagctgtgagcagccctgggggccctgcccgggccccaccctaccaggagcccccctggggcggccctgccacagccccctacagcctggagaccctgaagggcggcaccatcctgggcaccaggagcctgaagggcaccagctactgcctgtttggccgcctgagcggctgtgatgtgtgcctggagcaccccagcgtgagccgctaccacgctgtgctgcagcaccgggccagcggcccagatggagaatgtgacagcaatggacctggcttctacctgtatgacctgggcagcacccacggcaccttcctgaacaagacccgcatcccccccaggacctactgccgggtgcacgtgggccacgtggtgcgctttggaggcagcaccaggctcttcatcctgcagggcccagaagaagatcgggaggccgagagcgagctgactgtgacccagctgaaggagctgaggaagcagcagcagatcctgctggagaagaagatgctgggggaggacagtgatgaggaggaggagatggacaccagcgagaggaagatcaatgccggcagccaggatgatgagatgggctgcacctggggcatgggagaagatgctgtggaggatgatgctgaggagaaccccatcgtgctggagttccagcaggagcgggaggccttctacatcaaggaccccaagaaggccctgcagggcttctttgaccgggagggggaggagctggagtatgaatttgatgagcagggccacagcacctggctgtgccgggtgcggctgcctgtggatgacagcacaggcaagcagctggtggccgaggccatccacagcggcaagaagaaggaggccatgatccagtgcagcctggaggcctgccgcatcctggacaccctgggcctgctgcggcaggaggccgtgtccaggaagaggaaggccaagaactgggaggatgaggacttctatgacagtgatgatgacaccttcctggacagaacaggcctcatcgagaagaagaggctgaacaggatgaagaaggccggcaagattgatgagaagccagagacctttgagagcctggtggccaagctgaatgatgctgagcgggagctgtctgagatcagcgagcggctgaaggccagcagccaggtgctgtctgagagccccagccaggacagcctggatgccttcatgtctgagatgaagagcggcagcaccctggatggagtgtccaggaagaagctgcacctgcggacctttgagctgaggaaggagcagcagaggctgaagggcctcatcaagatcgtgaagccagctgagatccctgagctgaagaagacagagacccagaccaccggggctgagaacaaggccaagaagctgaccctgcccctgtttggagccatgaagggcggcagcaagttcaagctgaagacaggaacagtgggcaagctgccccccaagaggcctgagctgccccccaccctgatgaggatgaaggatgagcctgaggtggaggaggaggaggaggaggaggaggaggaggagaaggagaaggaggagcacgagaagaagaagctggaggatggcagcctgagccggccccagcctgagattgagcctgaggccgctgtgcaggagatgaggcctcccacagacctgacccacttcaaggagacccagacccatgagaacatgagccagctgtctgaggaggagcagaacaaggactaccaggactgcagcaagaccaccagcctgtgtgccggccccagcgccagcaagaatgaatatgagaagagcagaggagagctgaagaagaagaagaccccaggccctgggaagctgccccccaccctgagcagcaagtacccagaagatgatcctgactactgtgtgtgggtgcccccagagggccagagcggagatggccgcacccacctgaatgacaagtatggctactag

SEQ ID NO: 170784 - DNA, 3699 bp, Artificial Sequence
  Description of Artificial Sequence: Synthetic coding sequence
atggacttcctgctgcggccccagcctgagcctgagagcctgggccctggcaccccaggcttccctgagcaggaggaggatgagctgcacaggaccctgggcgtggagagatttgaggagatcctgcaggaggccggcagcagaggaggagaggagcccggccgctcctatggagaggaggactttgagtaccaccggcagagcagccaccacatccaccaccccctgagcacccacctgcccccagatgcccggcggaggaagaccccccagggccctggcaggaagcccaggagaagacctggggccagccccaccggggagacccccaccatcgaggagggggaggaggatgaagatgaggccagcgaggccgagggcgcccgggccctgacccagcccagccctgtgtccacccccagctctgtgcagttcttcctgcaggaggatgacagcgctgacaggaaggccgagaggaccagccccagcagccctgcccccctgccccaccaggaggccaccccccgggccagcaaaggagcccaggccggcacccaggtggaggaggccgaggccgaggccgtggccgtggccagcggcacagctggaggagatgatggaggagccagcggccggcccctgcccaaggcccagcccggccacaggagctacaacctgcaggagcggcggcgcatcggctccatgaccggggctgagcaggccctgctgccccgggtgcccacagatgaaattgaggcccagaccctggccacagctgacctggacctgatgaagagccacagatttgaagatgtgcctggggtgcggcggcacctggtgaggaagaatgccaagggcagcacccagagcggccgggagggccgggagcccggccccaccccccgggcccggccccgggccccccacaagccccatgaggtgtttgtggagctgaatgagctgctgctggacaagaaccaggagccccagtggagggagacagcccgctggatcaagtttgaggaggatgtggaggaggagacagagcgctggggcaagccccacgtggccagcctgtccttccgcagcctgctggagctgcggaggaccctggcccatggagctgtgctgctggacctggaccagcagaccctgcccggggtggcccaccaggtggtggagcagatggtgatcagtgaccagatcaaggcagaagatcgggccaacgtgctgcgggccctgctgctgaagcacagccaccccagtgatgagaaggacttctccttccccaggaacatctctgctggcagcctgggcagcctgctgggccaccaccacggccagggcgctgagagtgacccccacgtgacagagcccctgatgggcggcgtgcctgagacccggctggaggtggagcgggagcgggagctgcccccaccagcccccccagctggcatcaccaggagcaagagcaagcatgagctgaagctgctggagaagatcccagaaaatgctgaggccaccgtggtgctggtgggctgtgtggagttcctgagccggcccaccatggcctttgtgcggctgcgggaggccgtggagctggatgctgtgctggaggtgcctgtgcctgtgcgcttcctgttcctgctgctgggccccagcagcgccaacatggactaccatgaaattggccgcagcatcagcaccctgatgtctgacaagcagttccatgaagctgcctacctggctgatgaaagagaggacctgctgacagccatcaatgccttcctggactgcagcgtggtgctgccccccagcgaggtgcagggcgaggagctgctgcggtctgtggcccacttccagaggcagatgctgaagaagcgggaggagcagggccgcctgctgcccactggagctggcctggagcccaagagcgcccaggacaaggccctgctgcagatggtggaggccgccggggctgctgaagatgaccccctgcggaggacaggccggccctttggaggcctcatcagagatgtgagaagacgctacccccactacctgagtgacttcagagatgccctggacccccagtgcctggccgccgtcatcttcatctactttgctgccctgagccctgccatcacctttggaggcctgctgggggagaagacccaggacctgattggagtgtctgagctgatcatgagcacagccctgcagggcgtggtgttctgcctgctgggcgcccagcccctgctggtgattggcttcagcggccccctgctggtgtttgaggaggccttcttctccttctgcagcagcaaccacctggagtacctggtgggccgggtgtggattggcttctggctggtgttcctggccctgctgatggtggccctggagggcagcttcctggtgcgctttgtgagccgcttcacccaggagatctttgccttcctgatcagcctcatcttcatctatgagaccttctacaagctggtgaagatcttccaggagcaccccctgcacggctgcagcgccagcaacagcagcgaggtggatggaggagagaacatgacctgggccggggcccggcccaccctgggccctggcaacagaagcctggccggccagagcggccagggcaagccccggggccagcccaacacagccctgctgagcctggtgctgatggccggcaccttcttcatcgccttcttcctgaggaagttcaagaacagccgcttcttccctggccgcatcagaagagtcatcggggactttggagtgcccatcgccatcctgatcatggtgctggtggactacagcattgaggacacctacacccagaagctgtctgtgcccagcggcttctctgtgacagcccctgagaagaggggctgggtgatcaaccccctgggggagaagagccccttccctgtgtggatgatggtggccagcctgctgcctgccatcctggtgttcatcctgatcttcatggagacccagatcaccaccctcatcatcagcaagaaggagaggatgctgcagaagggcagcggcttccacctggacctgctgctgattgtggccatgggcggcatctgtgccctgtttggcctgccctggctggccgccgccaccgtgcgctctgtgacccacgccaatgccctgactgtgatgagcaaggctgtggcccctggggacaagcccaagatccaggaggtgaaggagcagagggtgacaggcctgctggtggccctgctggtgggcctgagcatcgtgattggagacctgctgcggcagatccccctggccgtgctgtttggcatcttcctgtacatgggcgtgaccagcctgaatggcatccagttctatgagcggctgcacctgctgctgatgccacccaagcaccacccagatgtgacctacgtgaagaaggtgaggaccctgaggatgcacctgttcaccgccctgcagctgctgtgcctggccctgctgtgggccgtgatgagcacagctgccagcctggccttccccttcatcctgatcctgactgtgcccctgaggatggtggtgctgacccgcatcttcacagaccgggagatgaagtgcctggatgccaatgaggccgagcctgtgtttgatgagcgggagggcgtggatgagtacaatgagatgcccatgcctgtgtag

SEQ ID NO: 170785 - DNA, 3684 bp, Artificial Sequence
  Description of Artificial Sequence: Synthetic coding sequence
atgacccagcctgagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattttgagtaccaccggcagagcagccaccacatccaccaccccctgagcacccacctgcccccagatgcccggcggaggaagaccccccagggccctggcaggaagccccggcggcggcctggggccagccccactggagagacccccaccatcgaggagggggaggaggatgaagatgaggccagcgaggccgagggcgcccgggccctgacccagcccagccctgtgtccacccccagctctgtgcagttcttcctgcaggaggatgattctgctgacaggaaggccgagaggaccagccccagcagccctgcccccctgccccaccaggaggccaccccccgggccagcaagggggcccaggccggcacccaggtggaggaggccgaggccgaggccgtggccgtggccagcggcacagctggaggagatgatggaggagccagcggccggcccctgcccaaggcccagcccggccacaggagctacaacctgcaggagaggagaagaattggctccatgactggagctgagcaggccctgctgccccgggtgcccacagatgaaattgaggcccagaccctggccacagctgacctggacctgatgaagagccacagatttgaagatgtgcctggggtgagaagacacctggtgaggaagaatgccaagggcagcacccagagcggccgggagggccgggagcccggccccaccccccgggcccggccccgggccccccacaagccccatgaggtgtttgtggagctgaatgagctgctgctggacaagaaccaggagccccagtggagggagacagcccgctggatcaagtttgaagaagatgtggaggaggagacagagcgctggggcaagccccacgtggccagcctgtccttccgcagcctgctggagctgcggaggaccctggcccacggggctgtgctgctggacctggaccagcagaccctgcccggggtggcccaccaggtggtggagcagatggtgatcagtgaccagatcaaggccgaggaccgggccaacgtgctgcgggccctgctgctgaagcacagccaccccagtgatgagaaggacttctccttccccaggaacatctctgctggcagcctgggcagcctgctgggccaccaccacggccagggcgctgagagtgacccccacgtgacagagcccctgatgggcggcgtgcctgagacccggctggaggtggagcgggagcgggagctgcccccaccagcccctcctgctggcatcaccaggagcaagagcaagcatgagctgaagctgctggagaagatcccagaaaatgctgaggccaccgtggtgctggtgggctgtgtggagttcctgagccggcccaccatggcctttgtgcggctgcgggaggccgtggagctggatgctgtgctggaggtgcctgtgcctgtgcgcttcctgttcctgctgctgggccccagcagcgccaacatggactaccacgagatcggccgcagcatcagcaccctgatgtctgacaagcagttccacgaggccgcctacctggctgatgagcgggaggacctgctgacagccatcaatgccttcctggactgcagcgtggtgctgcccccatctgaggtgcagggcgaggagctgctgcggtctgtggcccacttccagaggcagatgctgaagaagcgggaggagcagggccgcctgctgcccaccggggccggcctggagcccaagagcgcccaggacaaggccctgctgcagatggtggaggccgccggggctgctgaagatgaccccctgcggaggacaggccggccctttggaggcctcatcagagatgtgagaagacgctacccccactacctgagtgacttcagagatgccctggacccccagtgcctggccgctgtgatcttcatctactttgctgccctgagccctgccatcaccttcggcggcctgctgggggagaagacccaggacctgattggagtgtctgagctgatcatgagcacagccctgcagggcgtggtgttctgcctgctgggcgcccagcccctgctggtgattggcttcagcggccccctgctggtgtttgaggaggccttcttctccttctgcagcagcaaccacctggagtacctggtgggccgggtgtggattggcttctggctggtgttcctggccctgctgatggtggccctggagggcagcttcctggtgcgctttgtgagccgcttcacccaggagatctttgccttcctgatcagcctcatcttcatctatgagaccttctacaagctggtgaagatcttccaggagcaccccctgcacggctgcagcgccagcaacagcagcgaggtggatggaggagagaacatgacctgggccggggcccggcccaccctgggccctggcaacagaagcctggccggccagagcggccagggcaagccccggggccagcccaacacagccctgctgagcctggtgctgatggccggcaccttcttcatcgccttcttcctgaggaagttcaagaacagccgcttcttccctggccgcatccggcgggtgattggagactttggagtgcccatcgccatcctgatcatggtgctggtggactacagcattgaggacacctacacccagaagctgtctgtgcccagcggcttctctgtgacagcccctgagaagaggggctgggtgatcaaccccctgggggagaagagccccttccctgtgtggatgatggtggccagcctgctgcctgccatcctggtgttcatcctgatcttcatggagacccagatcaccaccctcatcatcagcaagaaggagaggatgctgcagaagggcagcggcttccacctggacctgctgctgattgtggccatgggcggcatctgtgccctgtttggcctgccctggctggccgccgccaccgtgcgctctgtgacccacgccaatgccctgactgtgatgagcaaggctgtggcccctggggacaagcccaagatccaggaggtgaaggagcagagggtgacaggcctgctggtggccctgctggtgggcctgagcatcgtcatcggggacctgctgcggcagatccccctggccgtgctgtttggcatcttcctgtacatgggcgtgaccagcctgaatggcatccagttctatgaaaggctgcacctgctgctgatgccacccaagcaccacccagatgtgacctacgtgaagaaggtgaggaccctgaggatgcacctgttcaccgccctgcagctgctgtgcctggccctgctgtgggccgtgatgagcacagctgccagcctggccttccccttcatcctgatcctgactgtgcccctgaggatggtggtgctgacccgcatcttcacagaccgggagatgaagtgcctggatgccaatgaagctgagcctgtgtttgatgagcgggagggcgtggatgagtacaatgagatgcccatgcctgtgtag

SEQ ID NO: 170786 - DNA, 2406 bp, Artificial Sequence
  Description of Artificial Sequence: Synthetic coding sequence
gtgatggaggtggtggaggccgagaagatcgtgctgctgaccagcgcccgcttcctgttcctgctgctgggccctgctgggaaggccccccagtaccatgaaattggccgcagcatcgccaccctgatgacagatgagatcttccatgatgtggcctacaaggccaaggacagaaatgacctgctgtctggaattgatgagttcctggaccaggtgacagtgctgcccccaggagagtgggaccccagcatccgcatcgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcacctttggaggcctgctgggggaggccacagagggccgcatcagcgccatcgagagcctgtttggagccagcctgactggaattgcctacagcctgtttgctggccagcccctgaccatcctgggcagcactggacctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggggccggctaccacctggacctgctgatggtgggcgtgatgctgggcgtgtgcagcgtgatgggcctgccctggtttgtggccgccaccgtgctgagcatcagccacgtgaacagcctgaaggtggagagtgaatgttctgcccctggagagcagcccaagttcctgggcatccgggagcagagggtgacaggcctgatgatcttcatcctgatgggcctgtctgtgttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgaaggaggcagcctgctgcagatccctgtgaaggccctgaagtacagcgtggaccccagcatcgtgaacatcagtgatgagatggccaagacagcccagtggaaggccctgtccatgaacacagaaaatgccaaggtgaccaggagcaacatgagcccagacaagcctgtgtctgtgaagatcagctttgaagatgagcccaggaagaagtatgtggatgctgagaccagcctgtag

SEQ ID NO: 170787 - DNA, 2244 bp, Artificial Sequence
  Description of Artificial Sequence: Synthetic coding sequence
atgcccctgggccggcagagccaccgccaccacaggacccacggccagaagcacagaagaagaggccggggcaaaggagccagccagggcgaggagggcctggaggccctggcccatgacacccccagccagagggtgcagttcatcctgggcacagaggaggatgaggagcacgtgccccatgagctgttcacagagctggatgagatctgcatgaaggagggggaggatgctgagtggaaggagacagcccgctggctgaagtttgaagaagatgtggaggatggaggagagcgctggagcaagccctacgtggccaccctgagcctgcacagcctgtttgagctgcggagctgcctgatcaatggcaccgtgctgctggacatgcacgccaacagcattgaggagatcagtgacctgatcctggaccagcaggagctgagcagtgacctgaatgacagcatgagggtgaaggtgcgggaggccctgctgaagaagcaccaccaccagaatgagaagaagaggaacaacctgatccccatcgtgcgcagctttgctgaggtgggcaagaagcagagcgacccccacctgatggacaagcacggccagacagtgagcccccagagcgtgcccaccaccaacctggaggtgaagaatggagtgaactgtgagcacagccctgtggacctgagcaaggtggacctgcacttcatgaagaagatccccactggagctgaggccagcaatgtgctggtgggggaggtggacatcctggaccggcccatcgtggcctttgtgcggctgagccctgctgtgctgctgagcggcctgacagaggtgcccatccccacccgcttcctgttcatcctgctgggccctgtgggcaagggccagcagtaccatgaaattggccgctccatggccaccatcatgacagatgagatcttccatgatgtggcctacaaggccaaggagagagatgacctgctggccggcattgatgagttcctggaccaggtgacagtgctgcccccaggagagtgggaccccagcatccgcatcgagccccccaagaatgtgcccagccaggagaagaggaagatgcctggggtgcccaatggaaatgtgtgccacatcgagcaggagccccacggcggccacagcggccctgagctgcagaggacaggccgcctgtttggaggcctggtgctggacatcaagaggaaggccccctggtactggagcgactacagagatgccctgagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttgctggccaggccctgaccatcctgggcagcactggacctgtgctggtgtttgagaagatcctcttcaagttctgcaaggactatgccctgagctacctgagcctgcgggcctgcatcggcctgtggacagccttcctgtgcatcgtgctggtggccacagatgccagcagcctggtgtgctacatcacccgcttcacagaggaggcctttgccagcctcatctgcatcatcttcatctatgaggccatcgagaagctgatccacctggccgagacctaccccatccacatgcacagccagctggaccacctgagcctgtactactgccgctgcaccctgcctgagaaccccaacaaccacaccctgcagtactggaaggaccacaacatcgtgacagctgaggtgcactgggccaacctgactgtgtctgagtgccaggagatgcatggagagttcatgggcagcgcctgtggccaccacggcccctacaccccagatgtgctcttctggagctgcatcctcttcttcaccaccttcatcctgagcagcaccctgaagaccttcaagaccagccgctacttccccaccaggatggagagctgcagcgtggcctggctggagtgtggcggcgtcatcctggcccactgcaacctgcggctgctgcccagctcctgggactacagacatgccccaccccagcctgccaacttctgcatcttcagcagagatggagtgagcccctgctggccaggctggagccagagcctggacctggtgatctgcctgcccaggcctcccaagatgctgggcctgcaggcctag

SEQ ID NO: 170788 - DNA, 3135 bp, Artificial Sequence
  Description of Artificial Sequence: Synthetic coding sequence
atgcctgctgctggcagcaatgaaccagatggagtgctgagctaccagaggccagatgaggaggccgtggtggaccagggcggcaccagcaccatcctgaacatccactatgagaaggaggagctggagggccacaggaccctgtatgtgggcgtgaggatgcccctgggccggcagagccaccgccaccacaggacccacggccagaagcacagaagaagaggccggggcaagggggccagccagggcgaggagggcctggaggccctggcccatgacacccccagccagagggtgcagttcatcctgggcacagaagaagatgaggagcacgtgccccatgagctgttcacagagctggatgagatctgcatgaaggagggagaagatgctgagtggaaggagacagcccgctggctgaagtttgaggaggatgtggaggatggaggagagcgctggagcaagccctacgtggccaccctgagcctgcacagcctgtttgagctgcggagctgcctgatcaatggaacagtgctgctggacatgcacgccaacagcattgaggagatcagtgacctgatcctggaccagcaggagctgagcagtgacctgaatgacagcatgagggtgaaggtgcgggaggccctgctgaagaagcaccaccaccagaatgagaagaagaggaacaacctgatccccatcgtgcgcagctttgctgaggtgggcaagaagcagagcgacccccacctgatggacaagcacggccagacagtgagcccccagagcgtgcccaccaccaacctggaggtgaagaatggagtgaactgtgagcacagccctgtggacctgagcaaggtggacctgcacttcatgaagaagatccccaccggggctgaggccagcaatgtgctggtgggggaggtggacatcctggaccggcccatcgtggcctttgtgcggctgagccctgctgtgctgctgagcggcctgacagaggtgcccatccccacccgcttcctgttcatcctgctgggccctgtgggcaagggccagcagtaccacgagatcggccgctccatggccaccatcatgacagatgagatcttccatgatgtggcctacaaggccaaggagagagatgacctgctggccggcattgatgagttcctggaccaggtgacagtgctgcccccaggagagtgggaccccagcatcagaattgagccccccaagaatgtgcccagccaggagaagaggaagatgcctggggtgcccaatggaaatgtgtgccacatcgagcaggagccccatggaggccacagcggccctgagctgcagaggacaggccgcctgtttggaggcctggtgctggacatcaagaggaaggccccctggtactggagcgactacagagatgccctgagcctgcagtgcctggccagcttcctgttcctgtactgtgcctgcatgagccctgtgatcaccttcggcggcctgctgggggaggccacagagggccgcatcagcgccatcgagagcctgtttggagcctccatgacaggcatcgcctacagcctgtttgctggccaggccctgaccatcctgggcagcacaggccctgtgctggtgtttgagaagatcctcttcaagttctgcaaggactatgccctgagctacctgagcctgcgggcctgcatcggcctgtggacagccttcctgtgcatcgtgctggtggccacagatgccagcagcctggtgtgctacatcacccgcttcacagaggaggcctttgccagcctcatctgcatcatcttcatctatgaggccatcgagaagctgatccacctggccgagacctaccccatccacatgcacagccagctggaccacctgagcctgtactactgccgctgcaccctgcctgagaaccccaacaaccacaccctgcagtactggaaggaccacaacatcgtgacagctgaggtgcactgggccaacctgactgtgtctgagtgccaggagatgcacggggagttcatgggcagcgcctgtggccaccacggcccctacaccccagatgtgctcttctggagctgcatcctcttcttcaccaccttcatcctgagcagcaccctgaagaccttcaagaccagccgctacttccccaccagggtgcgctccatggtgtctgactttgctgtgttcctgaccatcttcaccatggtgatcatcgacttcctgattggagtgcccagccccaagctgcaggtgcccagcgtcttcaagcccaccagagatgaccggggctggatcatcaaccccatcggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccatcatgctgggcgtgtgcagcatcatgggcctgccctggtttgtggccgccaccgtgctgagcatcacccacgtgaacagcctgaagctggagagcgagtgcagcgcccctggagagcagcccaagttcctgggcatccgggagcagagggtgacaggcctgatgatctttgtgctgatgggctgcagcgtcttcatgacagccatcctgaagttcatccccatgcctgtgctgtatggagtcttcctgtacatgggcgtgagcagcctgcagggcatccagttctttgaccggctgaagctgtttggcatgcctgccaagcaccagcctgacttcatctacctgcggcacgtgcccctgaggaaggtgcacctgttcaccctcatccagctgacctgcctggtgctgctgtgggtgatcaaggccagccctgctgccatcgtgttccccatgatggtgctggccctggtgtttgtgaggaaggtgatggacctgtgcttcagcaagcgggagctgtcctggctggatgacctgatgcctgagagcaagaagaagaagctggatgatgccaagaagaaggccaaggaggaggaggtgattgtgctggcccccaccgtgtacctgggcgccagcaactaccgcacctag

SEQ ID NO: 170789 - DNA, 2736 bp, Artificial Sequence
  Description of Artificial Sequence: Synthetic coding sequence
atggaggagctgcaggatgattatgaggacatgatggaggagaacctggagcaggaggagtatgaggaccctgacatccctgagagccagatggaggagcctgctgcccatgacacagaggccacagccacagactaccacaccaccagccaccctggcacccacaaggtgtatgtggagctgcaggagctggtgatggatgagaagaaccaggagctgcgctggatggaggccgcccgctgggtgcagctggaggagaacctgggggagaatggagcctggggccggccccacctgagccacctgaccttctggagcctgctggagctgcggcgggtcttcaccaagggcaccgtgctgctggacctgcaggagaccagcctggccggcgtggccaaccagctgctggaccgcttcatctttgaggaccagatccggccccaggaccgggaggagctgctgcgggccctgctgctgaagcacagccacgccggggagctggaggccctgggcggcgtgaagccagctgtgctgaccaggtctggggaccccagccagcccctgctgccccagcacagcagcctggagacccagctgttctgtgagcagggagatggcggcacagagggccacagccccagcggcatcctggagaagatccccccagacagcgaggccaccctggtgctggtgggccgggctgacttcctggagcagcctgtgctgggctttgtgcggctgcaggaggccgctgagctggaggccgtggagctgcctgtgcccatccgcttcctgtttgtgctgctgggccctgaggccccccacatcgactacacccagctgggccgggctgctgccaccctgatgtctgagagggtcttcagaattgatgcctacatggcccagagcagaggagagctgctgcacagcctggagggcttcctggactgcagcctggtgctgcccccaacagatgcccccagcgagcaggccctgctgagcctggtgcctgtgcagcgggagctgctgcggcggcgctaccagagcagccctgccaagccagacagcagcttctacaagggcctggacctgaatggaggcccagatgaccccctgcagcagacaggccagctgtttggaggcctggtgcgggacatcagaagacgctacccctactacctgagtgacatcacagatgccttcagcccccaggtgctggccgccgtcatcttcatctactttgctgccctgagccctgccatcacctttggaggcctgctgggggagaagaccaggaaccagatgggcgtgtctgagctgctgatcagcacagctgtgcagggcatcctgtttgccctgctgggcgcccagcccctgctggtggtgggcttcagcggccccctgctggtgtttgaggaggccttcttctccttctgtgagaccaacggcctggagtacatcgtgggccgggtgtggattggcttctggctgatcctgctggtggtgctggtggtggcctttgagggcagcttcctggtgcgcttcatcagccgctacacccaggagatcttctccttcctgatcagcctcatcttcatctatgagaccttcagcaagctgatcaagatcttccaggaccaccccctgcagaagacctacaactacaacgtgctgatggtgcccaagccccagggccccctgcccaacacagccctgctgagcctggtgctgatggccggcaccttcttctttgccatgatgctgaggaagttcaagaacagcagctacttccctgggaagctgcggcgggtgattggagactttggagtgcccatcagcatcctgatcatggtgctggtggacttcttcatccaggacacctacacccagaagctgtctgtgcctgatggcttcaaggtgagcaacagcagcgcccggggctgggtgatccaccccctgggcctgcggtctgagttccccatctggatgatgtttgccagcgccctgcctgccctgctggtgttcatcctgatcttcctggagagccagatcaccaccctcatcgtgtccaagccagagaggaagatggtgaagggcagcggcttccacctggacctgctgctggtggtgggcatgggcggcgtggccgccctgtttggcatgccctggctgagcgccaccaccgtgcgctctgtgacccacgccaatgccctgactgtgatgggcaaggccagcaccccaggagctgctgcccagatccaggaggtgaaggagcagaggatcagcggcctgctggtggccgtgctggtgggcctgagcatcctgatggagcccatcctgagccgcatccccctggccgtgctgtttggcatcttcctgtacatgggcgtgaccagcctgagcggcatccagctgtttgaccgcatcctgctgctcttcaagccacccaagtaccacccagatgtgccctacgtgaagagggtgaagacctggaggatgcacctgttcaccggcatccagatcatctgcctggccgtgctgtgggtggtgaagagcaccccagccagcctggccctgccctttgtgctgatcctgactgtgcccctgcggcgggtgctgctgcccctcatcttcagaaatgtggagctgcagtgcctggatgctgatgatgccaaggccacctttgatgaggaggagggcagagatgaatatgatgaggtggccatgcctgtgtag

SEQ ID NO: 170790 - DNA, 3480 bp, Artificial Sequence
  Description of Artificial Sequence: Synthetic coding sequence
atgagcagcgccccccggcggcctgccaagggagctgacagcttctgcaccccaggccctggcaggaagccccggcggcggcctggggccagccccactggagagacccccaccatcgaggagggggaggaggatgaagatgaggccagcgaggccgagggcgcccgggccctgacccagcccagccctgtgtccacccccagctctgtgcagttcttcctgcaggaggatgattctgctgacaggaaggccgagaggaccagccccagcagccctgcccccctgccccaccaggaggccaccccccgggccagcaagggggcccaggccggcacccaggtggaggaggccgaggccgaggccgtggccgtggccagcggcacagctggaggagatgatggaggagccagcggccggcccctgcccaaggcccagcccggccacaggagctacaacctgcaggagaggagaagaattggctccatgactggagctgagcaggccctgctgccccgggtgcccacagatgaaattgaggcccagaccctggccacagctgacctggacctgatgaagagccacagatttgaagatgtgcctggggtgagaagacacctggtgaggaagaatgccaagggcagcacccagagcggccgggagggccgggagcccggccccaccccccgggcccggccccgggccccccacaagccccatgaggtgtttgtggagctgaatgagctgctgctggacaagaaccaggagccccagtggagggagacagcccgctggatcaagtttgaagaagatgtggaggaggagacagagcgctggggcaagccccacgtggccagcctgtccttccgcagcctgctggagctgcggaggaccctggcccacggggctgtgctgctggacctggaccagcagaccctgcccggggtggcccaccaggtggtggagcagatggtgatcagtgaccagatcaaggccgaggaccgggccaacgtgctgcgggccctgctgctgaagcacagccaccccagtgatgagaaggacttctccttccccaggaacatctctgctggcagcctgggcagcctgctgggccaccaccacggccagggcgctgagagtgacccccacgtgacagagcccctgatgggcggcgtgcctgagacccggctggaggtggagcgggagcgggagctgcccccaccagcccctcctgctggcatcaccaggagcaagagcaagcatgagctgaagctgctggagaagatcccagaaaatgctgaggccaccgtggtgctggtgggctgtgtggagttcctgagccggcccaccatggcctttgtgcggctgcgggaggccgtggagctggatgctgtgctggaggtgcctgtgcctgtgcgcttcctgttcctgctgctgggccccagcagcgccaacatggactaccacgagatcggccgcagcatcagcaccctgatgtctgacaagcagttccacgaggccgcctacctggctgatgagcgggaggacctgctgacagccatcaatgccttcctggactgcagcgtggtgctgcccccatctgaggtgcagggcgaggagctgctgcggtctgtggcccacttccagaggcagatgctgaagaagcgggaggagcagggccgcctgctgcccaccggggccggcctggagcccaagagcgcccaggacaaggccctgctgcagatggtggaggccgccggggctgctgaagatgaccccctgcggaggacaggccggccctttggaggcctcatcagagatgtgagaagacgctacccccactacctgagtgacttcagagatgccctggacccccagtgcctggccgctgtgatcttcatctactttgctgccctgagccctgccatcaccttcggcggcctgctgggggagaagacccaggacctgattggagtgtctgagctgatcatgagcacagccctgcagggcgtggtgttctgcctgctgggcgcccagcccctgctggtgattggcttcagcggccccctgctggtgtttgaggaggccttcttctccttctgcagcagcaaccacctggagtacctggtgggccgggtgtggattggcttctggctggtgttcctggccctgctgatggtggccctggagggcagcttcctggtgcgctttgtgagccgcttcacccaggagatctttgccttcctgatcagcctcatcttcatctatgagaccttctacaagctggtgaagatcttccaggagcaccccctgcacggctgcagcgccagcaacagcagcgaggtggatggaggagagaacatgacctgggccggggcccggcccaccctgggccctggcaacagaagcctggccggccagagcggccagggcaagccccggggccagcccaacacagccctgctgagcctggtgctgatggccggcaccttcttcatcgccttcttcctgaggaagttcaagaacagccgcttcttccctggccgcatccggcgggtgattggagactttggagtgcccatcgccatcctgatcatggtgctggtggactacagcattgaggacacctacacccagaagctgtctgtgcccagcggcttctctgtgacagcccctgagaagaggggctgggtgatcaaccccctgggggagaagagccccttccctgtgtggatgatggtggccagcctgctgcctgccatcctggtgttcatcctgatcttcatggagacccagatcaccaccctcatcatcagcaagaaggagaggatgctgcagaagggcagcggcttccacctggacctgctgctgattgtggccatgggcggcatctgtgccctgtttggcctgccctggctggccgccgccaccgtgcgctctgtgacccacgccaatgccctgactgtgatgagcaaggctgtggcccctggggacaagcccaagatccaggaggtgaaggagcagagggtgacaggcctgctggtggccctgctggtgggcctgagcatcgtcatcggggacctgctgcggcagatccccctggccgtgctgtttggcatcttcctgtacatgggcgtgaccagcctgaatggcatccagttctatgaaaggctgcacctgctgctgatgccacccaagcaccacccagatgtgacctacgtgaagaaggtgaggaccctgaggatgcacctgttcaccgccctgcagctgctgtgcctggccctgctgtgggccgtgatgagcacagctgccagcctggccttccccttcatcctgatcctgactgtgcccctgaggatggtggtgctgacccgcatcttcacagaccgggagatgaagtgcctggatgccaatgaagctgagcctgtgtttgatgagcgggagggcgtggatgagtacaatgagatgcccatgcctgtgtag

SEQ ID NO: 170791 - DNA, 3726 bp, Artificial Sequence
  Description of Artificial Sequence: Synthetic coding sequence
atgagcagcgccccccggcggcctgccaagggagctgacagcttctgcaccccagagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattttgagtaccaccggcagagcagccaccacatccaccaccccctgagcacccacctgcccccagatgcccggcggaggaagaccccccagggccctggcaggaagccccggcggcggcctggggccagccccactggagagacccccaccatcgaggagggggaggaggatgaagatgaggccagcgaggccgagggcgcccgggccctgacccagcccagccctgtgtccacccccagctctgtgcagttcttcctgcaggaggatgattctgctgacaggaaggccgagaggaccagccccagcagccctgcccccctgccccaccaggaggccaccccccgggccagcaagggggcccaggccggcacccaggtggaggaggccgaggccgaggccgtggccgtggccagcggcacagctggaggagatgatggaggagccagcggccggcccctgcccaaggcccagcccggccacaggagctacaacctgcaggagaggagaagaattggctccatgactggagctgagcaggccctgctgccccgggtgcccacagatgaaattgaggcccagaccctggccacagctgacctggacctgatgaagagccacagatttgaagatgtgcctggggtgagaagacacctggtgaggaagaatgccaagggcagcacccagagcggccgggagggccgggagcccggccccaccccccgggcccggccccgggccccccacaagccccatgaggtgtttgtggagctgaatgagctgctgctggacaagaaccaggagccccagtggagggagacagcccgctggatcaagtttgaagaagatgtggaggaggagacagagcgctggggcaagccccacgtggccagcctgtccttccgcagcctgctggagctgcggaggaccctggcccacggggctgtgctgctggacctggaccagcagaccctgcccggggtggcccaccaggtggtggagcagatggtgatcagtgaccagatcaaggccgaggaccgggccaacgtgctgcgggccctgctgctgaagcacagccaccccagtgatgagaaggacttctccttccccaggaacatctctgctggcagcctgggcagcctgctgggccaccaccacggccagggcgctgagagtgacccccacgtgacagagcccctgatgggcggcgtgcctgagacccggctggaggtggagcgggagcgggagctgcccccaccagcccctcctgctggcatcaccaggagcaagagcaagcatgagctgaagctgctggagaagatcccagaaaatgctgaggccaccgtggtgctggtgggctgtgtggagttcctgagccggcccaccatggcctttgtgcggctgcgggaggccgtggagctggatgctgtgctggaggtgcctgtgcctgtgcgcttcctgttcctgctgctgggccccagcagcgccaacatggactaccacgagatcggccgcagcatcagcaccctgatgtctgacaagcagttccacgaggccgcctacctggctgatgagcgggaggacctgctgacagccatcaatgccttcctggactgcagcgtggtgctgcccccatctgaggtgcagggcgaggagctgctgcggtctgtggcccacttccagaggcagatgctgaagaagcgggaggagcagggccgcctgctgcccaccggggccggcctggagcccaagagcgcccaggacaaggccctgctgcagatggtggaggccgccggggctgctgaagatgaccccctgcggaggacaggccggccctttggaggcctcatcagagatgtgagaagacgctacccccactacctgagtgacttcagagatgccctggacccccagtgcctggccgctgtgatcttcatctactttgctgccctgagccctgccatcaccttcggcggcctgctgggggagaagacccaggacctgattggagtgtctgagctgatcatgagcacagccctgcagggcgtggtgttctgcctgctgggcgcccagcccctgctggtgattggcttcagcggccccctgctggtgtttgaggaggccttcttctccttctgcagcagcaaccacctggagtacctggtgggccgggtgtggattggcttctggctggtgttcctggccctgctgatggtggccctggagggcagcttcctggtgcgctttgtgagccgcttcacccaggagatctttgccttcctgatcagcctcatcttcatctatgagaccttctacaagctggtgaagatcttccaggagcaccccctgcacggctgcagcgccagcaacagcagcgaggtggatggaggagagaacatgacctgggccggggcccggcccaccctgggccctggcaacagaagcctggccggccagagcggccagggcaagccccggggccagcccaacacagccctgctgagcctggtgctgatggccggcaccttcttcatcgccttcttcctgaggaagttcaagaacagccgcttcttccctggccgcatccggcgggtgattggagactttggagtgcccatcgccatcctgatcatggtgctggtggactacagcattgaggacacctacacccagaagctgtctgtgcccagcggcttctctgtgacagcccctgagaagaggggctgggtgatcaaccccctgggggagaagagccccttccctgtgtggatgatggtggccagcctgctgcctgccatcctggtgttcatcctgatcttcatggagacccagatcaccaccctcatcatcagcaagaaggagaggatgctgcagaagggcagcggcttccacctggacctgctgctgattgtggccatgggcggcatctgtgccctgtttggcctgccctggctggccgccgccaccgtgcgctctgtgacccacgccaatgccctgactgtgatgagcaaggctgtggcccctggggacaagcccaagatccaggaggtgaaggagcagagggtgacaggcctgctggtggccctgctggtgggcctgagcatcgtcatcggggacctgctgcggcagatccccctggccgtgctgtttggcatcttcctgtacatgggcgtgaccagcctgaatggcatccagttctatgaaaggctgcacctgctgctgatgccacccaagcaccacccagatgtgacctacgtgaagaaggtgaggaccctgaggatgcacctgttcaccgccctgcagctgctgtgcctggccctgctgtgggccgtgatgagcacagctgccagcctggccttccccttcatcctgatcctgactgtgcccctgaggatggtggtgctgacccgcatcttcacagaccgggagatgaagtgcctggatgccaatgaagctgagcctgtgtttgatgagcgggagggcgtggatgagtacaatgagatgcccatgcctgtgtag

SEQ ID NO: 170792 - DNA, 456 bp, Artificial Sequence
  Description of Artificial Sequence: Synthetic coding sequence
atgagcagcgccccccggcggcctgccaagggagctgacagcttctgcaccccagagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattttgagtaccaccggcagagcagccaccacatccaccaccccctgagcacccacctgcccccagatgcccggcggaggaagaccccccagggccctggcaggaagccccggcggcggcctggggccagccccactggagagacccccaccatcgaggagggggaggaggatgaagatgaggccagcgaggccgagggcgcccgggccctgacccagcccagccctgtgtccacccccagcagctag

SEQ ID NO: 170793 - DNA, 384 bp, Artificial Sequence
  Description of Artificial Sequence: Synthetic coding sequence
atgagcagcgccccccggcggcctgccaagggagctgacagcttctgcaccccagagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattttgagtaccaccggcagagcagccaccacatccaccaccccctgagcacccacctgcccccagatgcccggcggaggaagaccccccagggccctggcaggaagccccggcggcggcctggggccagccccactggagagacccccaccatcgaggagggggaggaggactag

SEQ ID NO: 170794 - DNA, 438 bp, Artificial Sequence
  Description of Artificial Sequence: Synthetic coding sequence
atgagcagcgccccccggcggcctgccaagggagctgacagcttctgcaccccagagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattttgagtaccaccggcagagcagccaccacatccaccaccccctgagcacccacctgcccccagatgcccggcggaggaagaccccccagggccctggcaggaagccccggcggcggcctggggccagccccactggagagacccccaccatcgaggagggggaggaggatgaagatgaggccagcgaggccgagggcgcccgggccctgacccagcccagcccctag

SEQ ID NO: 170795 - DNA, 3726 bp, Artificial Sequence; identical to SEQ ID NO: 170791
  Description of Artificial Sequence: Synthetic coding sequence

SEQ ID NO: 170796 - DNA, 213 bp, Artificial Sequence
  Description of Artificial Sequence: Synthetic coding sequence
atgagcagcgccccccggcggcctgccaagggagctgacagcttctgcaccccagagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattag

SEQ ID NO: 170797 - DNA, 510 bp, Artificial Sequence
  Description of Artificial Sequence: Synthetic coding sequence
atgagcagcgccccccggcggcctgccaagggagctgacagcttctgcaccccagagcctgagagcctgggccctggcaccccaggcttccctgagcaggaggaggatgagctgcacaggaccctgggcgtggagagatttgaggagatcctgcaggaggccggcagccggggcggggaggagcccggccgctcctatggagaagaagattttgagtaccaccggcagagcagccaccacatccaccaccccctgagcacccacctgcccccagatgcccggcggaggaagaccccccagggccctggcaggaagccccggcggcggcctggggccagccccactggagagacccccaccatcgaggagggggaggaggatgaagatgaggccagcgaggccgagggcgcccgggccctgacccagcccagccctgtgtccacccccagctctgtgcagttcttcctgcaggaggatgattctgctgacaggaaggccgagaggacatag

SEQ ID NO: 170798 - DNA, 3240 bp, Artificial Sequence
  Description of Artificial Sequence: Synthetic coding sequence
atggaggatgaagctgtgctggacagaggagccagcttcctgaagcacgtgtgtgatgaggaggaggtggagggccaccacaccatctacatcggcgtgcacgtgcccaagagctacagaagaagaagaagacacaagaggaagacaggccacaaggagaagaaggagaaggagcgcatcagcgagaactacagcgacaagagtgacattgaaaatgctgatgagagcagcagcagcatcctgaagcccctcatcagccctgctgctgagcgcatccgcttcatcctgggggaggaggatgacagccctgccccaccccagctgttcacagagctggatgagctgctggccgtggatggccaggagatggagtggaaggagacagcccgctggatcaagtttgaggagaaggtggagcagggcggggagcgctggagcaagccccacgtggccaccctgagcctgcacagcctgtttgagctgcggacctgcatggagaagggcagcatcatgctggaccgggaggccagcagcctgccccagctggtggagatgattgtggaccaccagattgaaacaggcctgctgaagccagagctgaaggacaaggtgacctacaccctgctgaggaagcaccgccaccagaccaagaagagcaacctgcggagcctggccgacatcggcaagacagtgtcctctgccagcaggatgttcaccaacccagacaatggcagccctgccatgacccacaggaacctgaccagcagcagcctgaatgacatcagtgacaagccagagaaggaccagctgaagaacaagttcatgaagaagctgcccagagatgctgaggccagcaatgtgctggtgggggaggtggacttcctggacacccccttcatcgcctttgtgcggctgcagcaggccgtgatgctgggcgccctgacagaggtgcctgtgcccacccgcttcctgttcatcctgctgggccccaagggcaaggccaagagctaccacgagatcggccgggccatcgccaccctgatgtctgatgaggtgttccatgacatcgcctacaaggccaaggacagacatgacctgattgctggcattgatgagttcctggatgaagtcatcgtgctgcccccaggagagtgggaccctgccatcagaattgagccccccaagagcctgcccagcagtgacaagaggaagaacatgtacagcggaggagaaaatgtgcagatgaatggagacacccctcatgatggcggccatggaggcggcggccacggggactgtgaggagctgcagaggacaggccgcttctgtggcggcctcatcaaggacatcaagaggaaggcccccttctttgccagtgacttctatgatgccctgaacatccaggccctgagcgccatcctcttcatctacctggccaccgtgaccaatgccatcacctttggaggcctgctgggagatgccacagacaacatgcagggcgtgctggagagcttcctgggcacagctgtgtctggggccatcttctgcctgtttgctggccagcccctgaccatcctgagcagcactggacctgtgctggtgtttgagcggctgctcttcaacttcagcaaggacaacaactttgactacctggagttccggctgtggattggcctgtggagcgccttcctgtgcctgatcctggtggccacagatgccagcttcctggtgcagtacttcacccgcttcacagaggagggcttcagcagcctcatctccttcatcttcatctatgatgccttcaagaagatgatcaagctggccgactactaccccatcaacagcaacttcaaggtgggctacaacaccctcttcagctgcacctgtgtgcccccagaccctgccaacatcagcatcagcaatgacaccaccctggcccctgagtacctgcccaccatgagcagcacagacatgtaccacaacaccacctttgactgggccttcctgagcaagaaggaatgttccaaatatggaggcaacctggtgggcaacaactgcaactttgtgcctgacatcaccctgatgtccttcatcctcttcctgggcacctacaccagctccatggccctgaagaagttcaagaccagcccctacttccccaccacagccaggaagctgatcagtgactttgccatcatcctgagcatcctgatcttctgtgtgattgatgccctggtgggcgtggacacccccaagctgattgtgcccagcgagttcaagcccaccagccccaacagaggctggtttgtgcccccatttggagagaacccctggtgggtgtgcctggccgccgccatcccagccctgctggtgaccatcctgatcttcatggaccagcagatcacagctgtgattgtgaacaggaaggagcacaagctgaagaagggagctggctaccacctggacctcttctgggtggccatcctgatggtgatctgcagcctgatggccctgccctggtacgtggccgccaccgtcatcagcatcgcccacatcgacagcctgaagatggagacagagaccagcgcccctggagagcagcccaagttcctgggcgtgcgggagcagagggtgacaggcaccctggtgttcatcctgaccggcctgagcgtcttcatggcccccatcctgaagttcatccccatgcctgtgctgtatggagtcttcctgtacatgggcgtggccagcctgaatggagtgcagttcatggaccggctgaagctgctgctgatgcccctgaagcaccagcctgacttcatctacctgcggcacgtgcccctgcggcgggtgcacctgttcaccttcctgcaggtgctgtgcctggccctgctgtggatcctgaagagcacagtggccgccatcatcttccctgtgatgatcctggccctggtggccgtgaggaagggcatggactacctgttcagccagcacgacctgtccttcctggatgatgtgattcctgagaaggacaagaagaagaaggaggatgagaagaagaagaagaagaagaagggcagcctggacagcgacaatgatgacagcgactgcccctacagcgagaaggtgcccagcatcaagatccccatggacatcatggagcagcagcccttcctgagtgacagcaagcccagcgaccgggagaggagccccaccttcctggagcggcacaccagctgctag

SEQ ID NO: 170799 - DNA, 3108 bp, Artificial Sequence
  Description of Artificial Sequence: Synthetic coding sequence
atgagcacagaaaatgtggagggcaagcccagcaacctgggggagcggggccgggcccggagcagcaccttcctgcgggtggtgcagcccatgttcaaccacagcatcttcaccagcgctgtgtccccagctgctgagcgcatccgcttcatcctgggggaggaggatgacagccctgccccaccccagctgttcacagagctggatgagctgctggccgtggatggccaggagatggagtggaaggagacagcccgctggatcaagtttgaggagaaggtggagcagggcggggagcgctggagcaagccccacgtggccaccctgagcctgcacagcctgtttgagctgcggacctgcatggagaagggcagcatcatgctggaccgggaggccagcagcctgccccagctggtggagatgattgtggaccaccagattgaaacaggcctgctgaagccagagctgaaggacaaggtgacctacaccctgctgaggaagcaccgccaccagaccaagaagagcaacctgcggagcctggccgacatcggcaagacagtgtcctctgccagcaggatgttcaccaacccagacaatggcagccctgccatgacccacaggaacctgaccagcagcagcctgaatgacatcagtgacaagccagagaaggaccagctgaagaacaagttcatgaagaagctgcccagagatgctgaggccagcaatgtgctggtgggggaggtggacttcctggacacccccttcatcgcctttgtgcggctgcagcaggccgtgatgctgggcgccctgacagaggtgcctgtgcccacccgcttcctgttcatcctgctgggccccaagggcaaggccaagagctaccacgagatcggccgggccatcgccaccctgatgtctgatgaggtgttccatgacatcgcctacaaggccaaggacagacatgacctgattgctggcattgatgagttcctggatgaagtcatcgtgctgcccccaggagagtgggaccctgccatcagaattgagccccccaagagcctgcccagcagtgacaagaggaagaacatgtacagcggaggagaaaatgtgcagatgaatggagacacccctcatgatggcggccatggaggcggcggccacggggactgtgaggagctgcagaggacaggccgcttctgtggcggcctcatcaaggacatcaagaggaaggcccccttctttgccagtgacttctatgatgccctgaacatccaggccctgagcgccatcctcttcatctacctggccaccgtgaccaatgccatcacctttggaggcctgctgggagatgccacagacaacatgcagggcgtgctggagagcttcctgggcacagctgtgtctggggccatcttctgcctgtttgctggccagcccctgaccatcctgagcagcactggacctgtgctggtgtttgagcggctgctcttcaacttcagcaaggacaacaactttgactacctggagttccggctgtggattggcctgtggagcgccttcctgtgcctgatcctggtggccacagatgccagcttcctggtgcagtacttcacccgcttcacagaggagggcttcagcagcctcatctccttcatcttcatctatgatgccttcaagaagatgatcaagctggccgactactaccccatcaacagcaacttcaaggtgggctacaacaccctcttcagctgcacctgtgtgcccccagaccctgccaacatcagcatcagcaatgacaccaccctggcccctgagtacctgcccaccatgagcagcacagacatgtaccacaacaccacctttgactgggccttcctgagcaagaaggaatgttccaaatatggaggcaacctggtgggcaacaactgcaactttgtgcctgacatcaccctgatgtccttcatcctcttcctgggcacctacaccagctccatggccctgaagaagttcaagaccagcccctacttccccaccacagccaggaagctgatcagtgactttgccatcatcctgagcatcctgatcttctgtgtgattgatgccctggtgggcgtggacacccccaagctgattgtgcccagcgagttcaagcccaccagccccaacagaggctggtttgtgcccccatttggagagaacccctggtgggtgtgcctggccgccgccatcccagccctgctggtgaccatcctgatcttcatggaccagcagatcacagctgtgattgtgaacaggaaggagcacaagctgaagaagggagctggctaccacctggacctcttctgggtggccatcctgatggtgatctgcagcctgatggccctgccctggtacgtggccgccaccgtcatcagcatcgcccacatcgacagcctgaagatggagacagagaccagcgcccctggagagcagcccaagttcctgggcgtgcgggagcagagggtgacaggcaccctggtgttcatcctgaccggcctgagcgtcttcatggcccccatcctgaagttcatccccatgcctgtgctgtatggagtcttcctgtacatgggcgtggccagcctgaatggagtgcagttcatggaccggctgaagctgctgctgatgcccctgaagcaccagcctgacttcatctacctgcggcacgtgcccctgcggcgggtgcacctgttcaccttcctgcaggtgctgtgcctggccctgctgtggatcctgaagagcacagtggccgccatcatcttccctgtgatgatcctggccctggtggccgtgaggaagggcatggactacctgttcagccagcacgacctgtccttcctggatgatgtgattcctgagaaggacaagaagaagaaggaggatgagaagaagaagaagaagaagaagggcagcctggacagcgacaatgatgacagcgactgcccctacagcgagaaggtgcccagcatcaagatccccatggacatcatggagcagcagcccttcctgagtgacagcaagcccagcgaccgggagaggagccccaccttcctggagcggcacaccagctgctag

SEQ ID NO: 170800 - DNA, 2988 bp, Artificial Sequence
  Description of Artificial Sequence: Synthetic coding sequence
atggaggatgaagctgtgctggacagaggagccagcttcctgaagcacgtgtgtgatgaggaggaggtggagggccaccacaccatctacatcggcgtgcacgtgcccaagagctacagaagaagaagaagacacaagaggaagacaggccacaaggagaagaaggagaaggagcgcatcagcgagaactacagcgacaagagtgacattgaaaatgctgatgagagcagcagcagcatcctgaagcccctcatcagccctgctgctgagcgcatccgcttcatcctgggggaggaggatgacagccctgccccaccccagctgttcacagagctggatgagctgctggccgtggatggccaggagatggagtggaaggagacagcccgctggatcaagtttgaggagaaggtggagcagggcggggagcgctggagcaagccccacgtggccaccctgagcctgcacagcctgtttgagctgcggacctgcatggagaagggcagcatcatgctggaccgggaggccagcagcctgccccagctggtggagatgattgtggaccaccagattgaaacaggcctgctgaagccagagctgaaggacaaggtgacctacaccctgctgaggaagcaccgccaccagaccaagaagagcaacctgcggagcctggccgacatcggcaagacagtgtcctctgccagcaggatgttcaccaacccagacaatggcagccctgccatgacccacaggaacctgaccagcagcagcctgaatgacatcagtgacaagccagagaaggaccagctgaagaacaagttcatgaagaagctgcccagagatgctgaggccagcaatgtgctggtgggggaggtggacttcctggacacccccttcatcgcctttgtgcggctgcagcaggccgtgatgctgggcgccctgacagaggtgcctgtgcccacccgcttcctgttcatcctgctgggccccaagggcaaggccaagagctaccacgagatcggccgggccatcgccaccctgatgtctgatgaggtgttccatgacatcgcctacaaggccaaggacagacatgacctgattgctggcattgatgagttcctggatgaagtcatcgtgctgcccccaggagagtgggaccctgccatcagaattgagccccccaagagcctgcccagcagtgacaagaggaagaacatgtacagcggaggagaaaatgtgcagatgaatggagacacccctcatgatggcggccatggaggcggcggccacggggactgtgaggagctgcagaggacaggccgcttctgtggcggcctcatcaaggacatcaagaggaaggcccccttctttgccagtgacttctatgatgccctgaacatccaggccctgagcgccatcctcttcatctacctggccaccgtgaccaatgccatcacctttggaggcctgctgggagatgccacagacaacatgcagggcgtgctggagagcttcctgggcacagctgtgtctggggccatcttctgcctgtttgctggccagcccctgaccatcctgagcagcactggacctgtgctggtgtttgagcggctgctcttcaacttcagcaaggacaacaactttgactacctggagttccggctgtggattggcctgtggagcgccttcctgtgcctgatcctggtggccacagatgccagcttcctggtgcagtacttcacccgcttcacagaggagggcttcagcagcctcatctccttcatcttcatctatgatgccttcaagaagatgatcaagctggccgactactaccccatcaacagcaacttcaaggtgggctacaacaccctcttcagctgcacctgtgtgcccccagaccctgccaacatcagcatcagcaatgacaccaccctggcccctgagtacctgcccaccatgagcagcacagacatgtaccacaacaccacctttgactgggccttcctgagcaagaaggaatgttccaaatatggaggcaacctggtgggcaacaactgcaactttgtgcctgacatcaccctgatgtccttcatcctcttcctgggcacctacaccagctccatggccctgaagaagttcaagaccagcccctacttccccaccacagccaggaagctgatcagtgactttgccatcatcctgagcatcctgatcttctgtgtgattgatgccctggtgggcgtggacacccccaagctgattgtgcccagcgagttcaagcccaccagccccaacagaggctggtttgtgcccccatttggagagaacccctggtgggtgtgcctggccgccgccatcccagccctgctggtgaccatcctgatcttcatggaccagcagatcacagctgtgattgtgaacaggaaggagcacaagctgaagttcatccccatgcctgtgctgtatggagtcttcctgtacatgggcgtggccagcctgaatggagtgcagttcatggaccggctgaagctgctgctgatgcccctgaagcaccagcctgacttcatctacctgcggcacgtgcccctgcggcgggtgcacctgttcaccttcctgcaggtgctgtgcctggccctgctgtggatcctgaagagcacagtggccgccatcatcttccctgtgatgatcctggccctggtggccgtgaggaagggcatggactacctgttcagccagcacgacctgtccttcctggatgatgtgattcctgagaaggacaagaagaagaaggaggatgagaagaagaagaagaagaagaagggcagcctggacagcgacaatgatgacagcgactgcccctacagcgagaaggtgcccagcatcaagatccccatggacatcatggagcagcagcccttcctgagtgacagcaagcccagcgaccgggagaggagccccaccttcctggagcggcacaccagctgctag

SEQ ID NO: 170801 - DNA, 3285 bp, Artificial Sequence
  Description of Artificial Sequence: Synthetic coding sequence
atggaggatgaagctgtgctggacagaggagccagcttcctgaagcacgtgtgtgatgaggaggaggtggagggccaccacaccatctacatcggcgtgcacgtgcccaagagctacagaagaagaagaagacacaagaggaagacaggccacaaggagaagaaggagaaggagcgcatcagcgagaactacagcgacaagagtgacattgaaaatgctgatgagagcagcagcagcatcctgaagcccctcatcagccctgctgctgagcgcatccgcttcatcctgggggaggaggatgacagccctgccccaccccagctgttcacagagctggatgagctgctggccgtggatggccaggagatggagtggaaggagacagcccgctggatcaagtttgaggagaaggtggagcagggcggggagcgctggagcaagccccacgtggccaccctgagcctgcacagcctgtttgagctgcggacctgcatggagaagggcagcatcatgctggaccgggaggccagcagcctgccccagctggtggagatgattgtggaccaccagattgaaacaggcctgctgaagccagagctgaaggacaaggtgacctacaccctgctgaggaagcaccgccaccagaccaagaagagcaacctgcggagcctggccgacatcggcaagacagtgtcctctgccagcaggatgttcaccaacccagacaatggcagccctgccatgacccacaggaacctgaccagcagcagcctgaatgacatcagtgacaagccagagaaggaccagctgaagaacaagttcatgaagaagctgcccagagatgctgaggccagcaatgtgctggtgggggaggtggacttcctggacacccccttcatcgcctttgtgcggctgcagcaggccgtgatgctgggcgccctgacagaggtgcctgtgcccacccgcttcctgttcatcctgctgggccccaagggcaaggccaagagctaccacgagatcggccgggccatcgccaccctgatgtctgatgaggtgttccatgacatcgcctacaaggccaaggacagacatgacctgattgctggcattgatgagttcctggatgaagtcatcgtgctgcccccaggagagtgggaccctgccatcagaattgagccccccaagagcctgcccagcagtgacaagaggaagaacatgtacagcggaggagaaaatgtgcagatgaatggagacacccctcatgatggcggccatggaggcggcggccacggggactgtgaggagctgcagaggacaggccgcttctgtggcggcctcatcaaggacatcaagaggaaggcccccttctttgccagtgacttctatgatgccctgaacatccaggccctgagcgccatcctcttcatctacctggccaccgtgaccaatgccatcacctttggaggcctgctgggagatgccacagacaacatgcagggcgtgctggagagcttcctgggcacagctgtgtctggggccatcttctgcctgtttgctggccagcccctgaccatcctgagcagcactggacctgtgctggtgtttgagcggctgctcttcaacttcagcaaggacaacaactttgactacctggagttccggctgtggattggcctgtggagcgccttcctgtgcctgatcctggtggccacagatgccagcttcctggtgcagtacttcacccgcttcacagaggagggcttcagcagcctcatctccttcatcttcatctatgatgccttcaagaagatgatcaagctggccgactactaccccatcaacagcaacttcaaggtgggctacaacaccctcttcagctgcacctgtgtgcccccagaccctgccaacatcagcatcagcaatgacaccaccctggcccctgagtacctgcccaccatgagcagcacagacatgtaccacaacaccacctttgactgggccttcctgagcaagaaggaatgttccaaatatggaggcaacctggtgggcaacaactgcaactttgtgcctgacatcaccctgatgtccttcatcctcttcctgggcacctacaccagctccatggccctgaagaagttcaagaccagcccctacttccccaccacagccaggaagctgatcagtgactttgccatcatcctgagcatcctgatcttctgtgtgattgatgccctggtgggcgtggacacccccaagctgattgtgcccagcgagttcaagcccaccagccccaacagaggctggtttgtgcccccatttggagagaacccctggtgggtgtgcctggccgccgccatcccagccctgctggtgaccatcctgatcttcatggaccagcagatcacagctgtgattgtgaacaggaaggagcacaagctgaagaagggagctggctaccacctggacctcttctgggtggccatcctgatggtgatctgcagcctgatggccctgccctggtacgtggccgccaccgtcatcagcatcgcccacatcgacagcctgaagatggagacagagaccagcgcccctggagagcagcccaagttcctgggcgtgcgggagcagagggtgacaggcaccctggtgttcatcctgaccggcctgagcgtcttcatggcccccatcctgaagttcatccccatgcctgtgctgtatggagtcttcctgtacatgggcgtggccagcctgaatggagtgcagttcatggaccggctgaagctgctgctgatgcccctgaagcaccagcctgacttcatctacctgcggcacgtgcccctgcggcgggtgcacctgttcaccttcctgcaggtgctgtgcctggccctgctgtggatcctgaagagcacagtggccgccatcatcttccctgtgatgatcctggccctggtggccgtgaggaagggcatggactacctgttcagccagcacgacctgtccttcctggatgatgtgattcctgagaaggacaagaagaagaaggaggatgagaagaagaagaagaagaagaagggcagcctggacagcgacaatgatgatgagaaggaccaccagcacagcctgaatgccacccaccacgccgacaagatccccttcctgcagagcctgggcatgcccagcccccccaggacccctgtgaaggtggtgccccagatccgcatcgagctggagccagaagataatgactacttctggaggagcaagggcacagagaccaccctgtag

SEQ ID NO: 170802 - DNA, 3123 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaaggtgcgggccctggtggccgacttcagcatcgtgttcagcatcctgatgttctgtggcattgatgcctgcttcggcctggagacccccaagctgcacgtgcccagcgtcatcaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagaaggccgccggctaccacctggacctcttctgggtgggcatcctgatggccctgtgcagcttcatgggcctgccctggtacgtggccgccaccgtcatcagcatcgcccacatcgacagcctgaagatggagacagagaccagcgcccctggagagcagccccagttcctgggcgtgcgggagcagagggtgacaggcatcatcgtgttcatcctgaccggcatctctgtgttcctggcccccatcctgaagatcctgggcctcatcatcgtgcggcggctgctggacttcatcttcagccagcacgacctggcctggattgacaacatcctgcctgagaaggagaagaaggagacagacaagaagaggaagaggaagaagggggcccacgaggactgtgatgaggagccccagtttcctccacccagcgtcatcaagatccccatggagagcgtgcagagcgacccccagaatggcatccactgcatcgccaggaagaggagcagctcctggagctacagcctgtag

SEQ ID NO: 170803 - DNA, 3414 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaaggtgcgggccctggtggccgacttcagcatcgtgttcagcatcctgatgttctgtggcattgatgcctgcttcggcctggagacccccaagctgcacgtgcccagcgtcatcaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagaaggccgccggctaccacctggacctcttctgggtgggcatcctgatggccctgtgcagcttcatgggcctgccctggtacgtggccgccaccgtcatcagcatcgcccacatcgacagcctgaagatggagacagagaccagcgcccctggagagcagccccagttcctgggcgtgcgggagcagagggtgacaggcatcatcgtgttcatcctgaccggcatctctgtgttcctggcccccatcctgaagtgcatccccctgcctgtgctgtatggagtcttcctgtacatgggcgtggccagcctgaatggcatccagatgggcactggaggcagcgagttcaagatccagaagaagctgacccccttctgggagcgctgcaagctgttcctgatgcctgccaagcaccagcctgaccacgccttcctgcggcacgtgcccctgcggcgcatccacctgttcaccctggtgcagatcctgtgcctggccgtgctgtggatcctgaagagcacagtggccgccatcatcttccctgtgatgatcctgggcctcatcatcgtgcggcggctgctggacttcatcttcagccagcacgacctggcctggattgacaacatcctgcctgagaaggagaagaaggagacagacaagaagaggaagaggaagaagggggcccacgaggactgtgatgaggagccccagttccccccaccttctgtcatcaagatccccatggagagcgtgcagagcgacccccagaatggcatccactgcatcgccaggaagaggagcagctcctggagctacagcctgtag

SEQ ID NO: 170804 - DNA, 3060 bp, Artificial Sequence
  Description of Artificial Sequence: Synthetic coding sequence
atgaaggtgaaggaggagaaggccggcgtgggcaagctggaccacaccaaccacagaagacgcttcccagaccagaagggcagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagaaggccgccggctaccacctggacctcttctgggtgggcatcctgatggccctgtgcagcttcatgggcctgccctggtacgtggccgccaccgtcatcagcatcgcccacatcgacagcctgaagatggagacagagaccagcgcccctggagagcagccccagttcctgggcgtgcgggagcagagggtgacaggcatcatcgtgttcatcctgaccggcatctctgtgttcctggcccccatcctgaagtgcatccccctgcctgtgctgtatggagtcttcctgtacatgggcgtggccagcctgaatggcatccagttctgggagcgctgcaagctgttcctgatgcctgccaagcaccagcctgaccacgccttcctgcggcacgtgcccctgcggcgcatccacctgttcaccctggtgcagatcctgtgcctggccgtgctgtggatcctgaagagcacagtggccgccatcatcttccctgtgatgatcctgggcctcatcatcgtgcggcggctgctggacttcatcttcagccagcacgacctggcctggattgacaacatcctgcctgagaaggagaagaaggagacagacaagaagaggaagaggaagaagggggcccacgaggactgtgatgaggagccccagttccccccaccttctgtcatcaagatccccatggagagcgtgcagagcgacccccagaatggcatccactgcatcgccaggaagaggagcagctcctggagctacagcctgtag

SEQ ID NO: 170805 - DNA, 3060 bp, Artificial Sequence; identical to SEQ ID NO: 170804
  Description of Artificial Sequence: Synthetic coding sequence

SEQ ID NO: 170806 - DNA, 3123 bp, Artificial Sequence; identical to SEQ ID NO: 170802
  Description of Artificial Sequence: Synthetic coding sequence

SEQ ID NO: 170807 - DNA, 3414 bp, Artificial Sequence; identical to SEQ ID NO: 170803
  Description of Artificial Sequence: Synthetic coding sequence

SEQ ID NO: 170808 - DNA, 3366 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaaggtgcgggccctggtggccgacttcagcatcgtgttcagcatcctgatgttctgtggcattgatgcctgcttcggcctggagacccccaagctgcacgtgcccagcgtcatcaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagaaggccgccggctaccacctggacctcttctgggtgggcatcctgatggccctgtgcagcttcatgggcctgccctggtacgtggccgccaccgtcatcagcatcgcccacatcgacagcctgaagatggagacagagaccagcgcccctggagagcagccccagttcctgggcgtgcgggagcagagggtgacaggcatcatcgtgttcatcctgaccggcatctctgtgttcctggcccccatcctgaagtgcatccccctgcctgtgctgtatggagtcttcctgtacatgggcgtggccagcctgaatggcatccagttctgggagcgctgcaagctgttcctgatgcctgccaagcaccagcctgaccacgccttcctgcggcacgtgcccctgcggcgcatccacctgttcaccctggtgcagatcctgtgcctggccgtgctgtggatcctgaagagcacagtggccgccatcatcttccctgtgatgatcctgggcctcatcatcgtgcggcggctgctggacttcatcttcagccagcacgacctggcctggattgacaacatcctgcctgagaaggagaagaaggagacagacaagaagaggaagaggaagaagggggcccacgaggactgtgatgaggagccccagttccccccaccttctgtcatcaagatccccatggagagcgtgcagagcgacccccagaatggcatccactgcatcgccaggaagaggagcagctcctggagctacagcctgtag

SEQ ID NO: 170809 - DNA, 2982 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaaggtgcgggccctggtggccgacttcagcatcgtgttcagcatcctgatgttctgtggcattgatgcctgcttcggcctggagacccccaagctgcacgtgcccagcgtcatcaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagggcacagagagcaacagacaccaccggctgcacccagatggcaacctgtgcctgcccggcagccaccccaaggtgtaccccccagctggagctgtgcgcagcctgcccctgcacggccggggcctgcctgagtggcaccctgtgctgggcaccctgcaggccctgcctgatgccagccaggccccagctggcccctgcctgcctgctgcccgggccgccgccccagacccccccctgcaccctggagctgaccccctgcccggcggggccctggacccccagatccatggaggctgccaccacctgcccggccatgaccccggcccccaccacaggagcaaggccagcggcttccacctgtttcctgcccggcccggcctggactag

SEQ ID NO: 170810 - DNA, 2895 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagggcacagagagcaacagacaccaccggctgcacccagatggcaacctgtgcctgcccggcagccaccccaaggtgtaccccccagctggagctgtgcgcagcctgcccctgcacggccggggcctgcctgagtggcaccctgtgctgggcaccctgcaggccctgcctgatgccagccaggccccagctggcccctgcctgcctgctgcccgggccgccgccccagacccccccctgcaccctggagctgaccccctgcccggcggggccctggacccccagatccatggaggctgccaccacctgcccggccacgtgtccctgcaccaccgctcctgggccagcagcagctttgagggcttctggatcagcagcttccccagcaccacctggccaggcctgaccaccagctag

SEQ ID NO: 170811 - DNA, 390 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggtag

SEQ ID NO: 170812 - DNA, 438 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggctag

SEQ ID NO: 170813 - DNA, 3429 bp, Artificial Sequence
  Description of Artificial Sequence: Synthetic coding sequence
atgaaggtgaaggaggagaaggccggcgtgggcaagctggaccacaccaaccacagaagacgcttcccagaccagaaggaatgtcctcccatccacatcggcctgcctgtgcccacctacccccagaggaagacagaccagaagggccacctgagcggcctgcagaaggtgcactggggcctgcggccagaccagccccagcaggagctgactggacctggcagcggggccagcagccaggacagctccatggacctgatcagcaggaccaggagccctgctgctgagcagctgcaggacatcctgggggaggaggatgaggcccccaaccccaccctcttcacagagatggacaccctgcagcatgatggagaccagatggagtggaaggagagcgcccgctggatcaagtttgaggagaaggtggaggagggcggggagcgctggagcaagccccacgtgtccaccctgagcctgcacagcctgtttgagctgcggacctgcctgcagacaggaacagtgctgctggacctggacagcggcagcctgccccagatcattgatgatgtgattgagaagcagattgaagatggcctgctgcggcctgagctgcgggagcgggtgtcctatgtgctgctgcggcggcaccgccaccagaccaagaagcccatccacaggagcctggccgacatcggcaagtctgtgtccaccaccaacagaagccctgcccggagccctggggccggccccagcctgcaccacagcacagaggacctgaggatgaggcagagcgccaactacggccgcctgtgccacgcccagagccgctccatgaatgacatcagcctgacccccaacacagaccagaggaagaacaagttcatgaagaagatccccaaggacagcgaggccagcaatgtgctggtgggggaggtggacttcctggaccagcccttcatcgcctttgtgcggctcatccagagcgccatgctgggcggcgtgacagaggtgcctgtgcccacccgcttcctgttcatcctgctgggccccagcggccgggccaagagctacaatgagatcggccgggccatcgccaccctgatggtggatgacctcttcagtgatgtggcctacaaggccaggaaccgggaggacctgattgctggcattgatgagttcctggatgaagtcatcgtgctgcccccaggagagtgggaccccaacatcagaattgagccccccaagaaggtgcccagcgctgacaagaggaagtctgtgttcagcctggccgagctgggccagatgaatggatctgtgggcggcggcggcggggcccctgggggcggcaatggaggcggcggcggcggcggcagcggcggcggggccggcagcggcggggccggcggcaccagcagtggagatgatggagagatgcctgccatgcatgagatcggggaggagctgatctggacaggccgcttctttggaggcctgtgcctggacatcaagaggaagctgccctggttccccagcgacttctatgatggcttccacatccagagcatcagcgccatcctcttcatctacctgggctgcatcaccaatgccatcacctttggaggcctgctgggagatgccacagacaactaccagggcgtgatggagagcttcctgggcacagccatggccggcagcctcttctgcctcttcagcggccagcccctcatcatcctgagcagcacaggccccatcctgatctttgagaagctgctgtttgacttcagcaaaggaaatggcctggactacatggagttccggctgtggattggcctgcacagcgctgtgcagtgcctgatcctggtggccacagatgccagcttcatcatcaagtacatcacccgcttcacagaggagggcttcagcaccctcatctccttcatcttcatctatgatgccatcaagaagatgattggagccttcaagtactaccccatcaacatggacttcaagcccaacttcatcaccacctacaagtgtgaatgtgtggccccagacacagtgaacaccaccgtcttcaatgccagcgcccccctggccccagacaccaatgccagcctgtacaacctgctgaacctgacagccctggactggagcctgctgagcaagaaggagtgcctgtcctatggaggccgcctgctgggcaacagctgcaagttcatcccagacctggccctgatgtccttcatcctcttcttcggcacctacagcatgaccctgaccctgaagaagttcaagttcagccgctacttccccaccaaggtgcgggccctggtggccgacttcagcatcgtgttcagcatcctgatgttctgtggcattgatgcctgcttcggcctggagacccccaagctgcacgtgcccagcgtcatcaagcccaccaggccagaccggggctggtttgtggccccctttgggaagaacccctggtgggtgtacccagccagcatcctgcctgccctgctggtgaccatcctgatcttcatggaccagcagatcacagctgtgattgtgaacagaaaagaaaacaagctgaagaaggccgccggctaccacctggacctcttctgggtgggcatcctgatggccctgtgcagcttcatgggcctgccctggtacgtggccgccaccgtcatcagcatcgcccacatcgacagcctgaagatggagacagagaccagcgcccctggagagcagccccagttcctgggcgtgcgggagcagagggtgacaggcatcatcgtgttcatcctgaccggcatctctgtgttcctggcccccatcctgaagtgcatccccctgcctgtgctgtatggagtcttcctgtacatgggcgtggccagcctgaatggcatccagatgggcactggaggcagcgagttcaagatccagaagaagctgacccccttctgggagcgctgcaagctgttcctgatgcctgccaagcaccagcctgaccacgccttcctgcggcacgtgcccctgcggcgcatccacctgttcaccctggtgcagatcctgtgcctggccgtgctgtggatcctgaagagcacagtggccgccatcatcttccctgtgatgagcctgagcaccacagacctgggcctcatcatcgtgcggcggctgctggacttcatcttcagccagcacgacctggcctggattgacaacatcctgcctgagaaggagaagaaggagacagacaagaagaggaagaggaagaagggggcccacgaggactgtgatgaggagccccagtttcctccacccagcgtcatcaagatccccatggagagcgtgcagagcgacccccagaatggcatccactgcatcgccaggaagaggagcagctcctggagctacagcctgtag

SEQ ID NO: 170814 - DNA, 3645 bp, Artificial Sequence
  Description of Artificial Sequence: Synthetic coding sequence
atggagcgcttccggctggagaagaagctgcccggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaggaggatgtggaggatggaggagaccgctggagcaagccctacgtggccaccctgagcctgcacagcctgtttgagctgcggagctgcatcctgaatggaacagtgatgctggacatgagggccagcaccctggatgaaattgctgacatggtgctggacaacatgattgccagcggccagctggatgagagcatccgggagaatgtgcgggaggccctgctgaagaggcaccaccaccagaatgagaagcgcttcaccagccgcatccccctggtgcgcagctttgctgacatcggcaagaagcacagcgacccccacctgctggagagaaatggagagggcctgagcgccagccgccacagcctgaggacaggcctgagcgccagcaacctgagcctgcggggggagagccccctgagcctgctgctgggccacctgctgcccagcagcagagctggcaccccagctggcagccgctgcaccacccctgtgcccaccccccagaacagcccccccagcagccccagcatcagccggctgaccagccgcagcagccaggagagccagaggcaggcccctgagctgctggtgtccccagccagtgatgacatccccaccgtggtgatccaccccccagaggaggacctggaggccgccctgaagggggaggagcagaagaatgaggagaatgtggacctgaccccaggcatcctggccagcccccagagcgcccctggcaacctggacaacagcaagagcggggagatcaagggaaatggcagcggcggcagccgggagaacagcacagtggacttcagcaaggtggacatgaacttcatgaggaagatccccaccggggctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccacgagatcggccgcagcatcgccaccctgatgacagatgagatcttccatgatgtggcctacaaggccaaggacagaaatgacctgctgagcggcattgatgagttcctggaccaggtgacagtgctgcccccaggagagtgggaccccagcatcagaattgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcaccttcggcggcctgctgggggaggccacagagggccgcatcagcgccatcgagagcctgtttggagccagcctgaccggcatcgcctacagcctgtttgctggccagcccctgaccatcctgggcagcacaggccctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggagctggctaccacctggacctgctgatggtgggcgtgatgctgggcgtgtgcagcgtgatgggcctgccctggtttgtggccgccaccgtgctgagcatcagccacgtgaacagcctgaaggtggagagcgagtgcagcgcccctggagagcagcccaagttcctgggcatccgggagcagagggtgacaggcctgatgatcttcatcctgatgggcctgagcgtcttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgagggcggcagcctgctgcagatccctgtgaaggccctgaagtacagcccagacaagcctgtgtctgtgaagatcagctttgaagatgagcccaggaagaagtatgtggatgctgagaccagcctgtag

SEQ ID NO: 170815 - DNA, 2403 bp, Artificial Sequence
  Description of Artificial Sequence: Synthetic coding sequence
atggaggtggtggaggccgagaagatcgtgctgctgaccagcgcccgcttcctgttcctgctgctgggccctgctgggaaggccccccagtaccacgagatcggccgcagcatcgccaccctgatgacagatgagatcttccatgatgtggcctacaaggccaaggacagaaatgacctgctgagcggcattgatgagttcctggaccaggtgacagtgctgcccccaggagagtgggaccccagcatcagaattgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcaccttcggcggcctgctgggggaggccacagagggccgcatcagcgccatcgagagcctgtttggagccagcctgaccggcatcgcctacagcctgtttgctggccagcccctgaccatcctgggcagcacaggccctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggagctggctaccacctggacctgctgatggtgggcgtgatgctgggcgtgtgcagcgtgatgggcctgccctggtttgtggccgccaccgtgctgagcatcagccacgtgaacagcctgaaggtggagagcgagtgcagcgcccctggagagcagcccaagttcctgggcatccgggagcagagggtgacaggcctgatgatcttcatcctgatgggcctgagcgtcttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgagggcggcagcctgctgcagatccctgtgaaggccctgaagtacagcgtggaccccagcatcgtgaacatcagtgatgagatggccaagacagcccagtggaaggccctgtccatgaacacagaaaatgccaaggtgaccaggagcaacatgagcccagacaagcctgtgtctgtgaagatcagctttgaagatgagcccaggaagaagtatgtggatgctgagaccagcctgtag

SEQ ID NO: 170816 - DNA, 1725 bp, Artificial Sequence
  Description of Artificial Sequence: Synthetic coding sequence
atggaggctgatggagctggggagcagatgaggcccctgctgacccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggggagggcctgagcgccagccgccacagcctgaggacaggcctgagcgccagcaacctgagcctgcggggggagagccccctgagcctgctgctgggccacctgctgcccagcagcagagctggcaccccagctggcagccgctgcaccacccctgtgcccaccccccagaacagcccccccagcagccccagcatcagccggctgaccagccgcagcagccaggagagccagaggcaggcccctgagctgctggtgtccccagccagtgatgacatccccaccgtggtgatccaccccccagaggaggacctggaggccgccctgaagggggaggagcagaagaatgaggagaatgtggacctgaccccaggcatcctggccagcccccagagcgcccctggcaacctggacaacagcaagagcggggagatcaagggaaatggcagcggcggcagccgggagaacagcacagtggacttcagcaaggtggacatgaacttcatgaggaagatccccaccggggctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccacgagatcggccgcagcatcgccaccctgatgacagatgagatcttccatgatgtggcctacaaggccaaggacagaaatgacctgctgagcggcattgatgagttcctggaccaggtgacagtgctgcccccaggagagtgggaccccagcatcagaattgagccccccaagtctgtgcccagccaggagaagaggaagatccctgtgttccacaacggcagcacccccaccctgggggagacccccaaggaggccgcccaccacgccggccctgagctgcagaggacaggccgggtgcagtag

SEQ ID NO: 170817 - DNA, 3273 bp, Artificial Sequence
  Description of Artificial Sequence: Synthetic coding sequence
atggagcgcttccggctggagaagaagctgcccggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaggaggatgtggaggatggaggagaccgctggagcaagccctacgtggccaccctgagcctgcacagcctgtttgagctgcggagctgcatcctgaatggaacagtgatgctggacatgagggccagcaccctggatgaaattgctgacatggtgctggacaacatgattgccagcggccagctggatgagagcatccgggagaatgtgcgggaggccctgctgaagaggcaccaccaccagaatgagaagcgcttcaccagccgcatccccctggtgcgcagctttgctgacatcggcaagaagcacagcgacccccacctgctggagagaaatggcatcctggccagcccccagagcgcccctggcaacctggacaacagcaagagcggggagatcaagggaaatggcagcggcggcagccgggagaacagcacagtggacttcagcaaggtggacatgaacttcatgaggaagatccccaccggggctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccacgagatcggccgcagcatcgccaccctgatgacagatgagatcttccatgatgtggcctacaaggccaaggacagaaatgacctgctgagcggcattgatgagttcctggaccaggtgacagtgctgcccccaggagagtgggaccccagcatcagaattgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcaccttcggcggcctgctgggggaggccacagagggccgcatcagcgccatcgagagcctgtttggagccagcctgaccggcatcgcctacagcctgtttgctggccagcccctgaccatcctgggcagcacaggccctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggagctggctaccacctggacctgctgatggtgggcgtgatgctgggcgtgtgcagcgtgatgggcctgccctggtttgtggccgccaccgtgctgagcatcagccacgtgaacagcctgaaggtggagagcgagtgcagcgcccctggagagcagcccaagttcctgggcatccgggagcagagggtgacaggcctgatgatcttcatcctgatgggcctgagcgtcttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgagggcggcagcctgctgcagatccctgtgaaggccctgaagtacagcccagacaagcctgtgtctgtgaagatcagctttgaagatgagcccaggaagaagtatgtggatgctgagaccagcctgtag

SEQ ID NO: 170818 - DNA, 3408 bp, Artificial Sequence
  Description of Artificial Sequence: Synthetic coding sequence
atggaggctgatggagctggggagcagatgaggcccctgctgaccagggtgaccagccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggcaagaagcacagcgacccccacctgctggagagaaatggcatcctggccagcccccagagcgcccctggcaacctggacaacagcaagtctggagagatcaagggaaatggaagtggcggcagccgggagaacagcacagtggacttcagcaaggtggacatgaacttcatgaggaagatccccactggagctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccatgaaattggccgcagcatcgccaccctgatgacagatgagatcttccatgatgtggcctacaaggccaaggacagaaatgacctgctgtctggaattgatgagttcctggaccaggtgacagtgctgcccccaggagagtgggaccccagcatccgcatcgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcacctttggaggcctgctgggggaggccacagagggccgcatcagcgccatcgagagcctgtttggagccagcctgactggaattgcctacagcctgtttgctggccagcccctgaccatcctgggcagcactggacctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggggccggctaccacctggacctgctgatggtgggcgtgatgctgggcgtgtgcagcgtgatgggcctgccctggtttgtggccgccaccgtgctgagcatcagccacgtgaacagcctgaaggtggagagtgaatgttctgcccctggagagcagcccaagttcctgggcatccgggagcagagggtgacaggcctgatgatcttcatcctgatgggcctgtctgtgttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgaaggaggcagcctgctgcagatccctgtgaaggccctgaagtacagcgtggaccccagcatcgtgaacatcagtgatgagatggccaagacagcccagtggaaggccctgtccatgaacacagaaaatgccaaggtgaccaggagcaacatgagcccagacaagcctgtgtctgtgaagatcagctttgaagatgagcccaggaagaagtatgtggatgctgagaccagcctgtag

SEQ ID NO: 170819 - DNA, 3288 bp, Artificial Sequence
  Description of Artificial Sequence: Synthetic coding sequence
atggaggctgatggagctggggagcagatgaggcccctgctgacccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggcaagaagcacagcgacccccacctgctggagagaaatggcatcctggccagcccccagagcgcccctggcaacctggacaacagcaagtctggagagatcaagggaaatggaagtggcggcagccgggagaacagcacagtggacttcagcaaggtggacatgaacttcatgaggaagatccccactggagctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccatgaaattggccgcagcatcgccaccctgatgacagatgagatcttccatgatgtggcctacaaggccaaggacagaaatgacctgctgtctggaattgatgagttcctggaccaggtgacagtgctgcccccaggagagtgggaccccagcatccgcatcgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcacctttggaggcctgctgggggaggccacagagggccgcatcagcgccatcgagagcctgtttggagccagcctgactggaattgcctacagcctgtttgctggccagcccctgaccatcctgggcagcactggacctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggggccggctaccacctggacctgctgatggtgggcgtgatgctgggcgtgtgcagcgtgatgggcctgccctggtttgtggccgccaccgtgctgagcatcagccacgtgaacagcctgaaggtggagagtgaatgttctgcccctggagagcagcccaagttcctgggcatccgggagcagagggtgacaggcctgatgatcttcatcctgatgggcctgtctgtgttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgaaggaggcagcctgctgcagatccctgtgaaggccctgaagtacagcccagacaagcctgtgtctgtgaagatcagctttgaagatgagcccaggaagaagtatgtggatgctgagaccagcctgtag

SEQ ID NO: 170820 - DNA, 1392 bp, Artificial Sequence
  Description of Artificial Sequence: Synthetic coding sequence
atggaggctgatggagctggggagcagatgaggcccctgctgacccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggcaagaagcacagcgacccccacctgctggagagaaatggcatcctggccagcccccagagcgcccctggcaacctggacaacagcaagtctggagagatcaagggaaatggaagtggcggcagccgggagaacagcacagtggacttcagcaaggtggacatgaacttcatgaggaagatccccactggagctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccatgaaattggccgcagcatcgccaccctgatgacagatgagatcttccatgatgtggcctacaaggccaaggacagaaatgacctgctgtctggaattgatgagttcctggaccaggtgacagtgctgcccccaggagagtgggaccccagcatccgcatcgagccccccaagtctgtgcccagccaggagaagaggaagatccctgtgttccacaacggcagcacccccaccctgggggagacccccaaggaggccgcccaccacgccggccctgagctgcagaggacaggccgggtgcagtag

SEQ ID NO: 170821 - DNA, 1725 bp, Artificial Sequence; identical to SEQ ID NO: 170816
  Description of Artificial Sequence: Synthetic coding sequence

SEQ ID NO: 170822 - DNA, 3741 bp, Artificial Sequence
  Description of Artificial Sequence: Synthetic coding sequence
atggaggctgatggagctggggagcagatgaggcccctgctgaccagggtgaccagccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggggagggcctgagcgccagccgccacagcctgaggacaggcctgagcgccagcaacctgagcctgcggggggagagccccctgagcctgctgctgggccacctgctgcccagcagcagagctggcaccccagctggcagccgctgcaccacccctgtgcccaccccccagaacagcccccccagcagccccagcatcagccggctgaccagccgcagcagccaggagagccagaggcaggcccctgagctgctggtgtccccagccagtgatgacatccccaccgtggtgatccaccccccagaggaggacctggaggccgccctgaagggggaggagcagaagaatgaggagaatgtggacctgaccccaggcatcctggccagcccccagagcgcccctggcaacctggacaacagcaagagcggggagatcaagggaaatggcagcggcggcagccgggagaacagcacagtggacttcagcaaggtggacatgaacttcatgaggaagatccccaccggggctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccacgagatcggccgcagcatcgccaccctgatgacagatgagatcttccatgatgtggcctacaaggccaaggacagaaatgacctgctgagcggcattgatgagttcctggaccaggtgacagtgctgcccccaggagagtgggaccccagcatcagaattgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcaccttcggcggcctgctgggggaggccacagagggccgcatcagcgccatcgagagcctgtttggagccagcctgaccggcatcgcctacagcctgtttgctggccagcccctgaccatcctgggcagcacaggccctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggagctggctaccacctggacctgctgatggtgggcgtgatgctgggcgtgtgcagcgtgatgggcctgccctggtttgtggccgccaccgtgctgagcatcagccacgtgaacagcctgaaggtggagagcgagtgcagcgcccctggagagcagcccaagttcctgggcatccgggagcagagggtgacaggcctgatgatcttcatcctgatgggcctgagcgtcttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgagggcggcagcctgctgcagatccctgtgaaggccctgaagtacagcgtggaccccagcatcgtgaacatcagtgatgagatggccaagacagcccagtggaaggccctgtccatgaacacagaaaatgccaaggtgaccaggagcaacatgagcccagacaagcctgtgtctgtgaagatcagctttgaagatgagcccaggaagaagtatgtggatgctgagaccagcctgtag

SEQ ID NO: 170823 - DNA, 3780 bp, Artificial Sequence
  Description of Artificial Sequence: Synthetic coding sequence
atggaggctgatggagctggggagcagatgaggcccctgctgaccagggtgaccagccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggcaagaagcacagcgacccccacctgctggagagaaatggagagggcctgagcgccagccgccacagcctgaggacaggcctgagcgccagcaacctgagcctgcggggggagagccccctgagcctgctgctgggccacctgctgcccagcagccgggccggcaccccagctggcagccgctgcaccacccctgtgcccaccccccagaacagcccccccagcagccccagcatcagccggctgaccagccgcagcagccaggagagccagaggcaggcccctgagctgctggtgtccccagccagtgatgacatccccaccgtggtgatccaccccccagaggaggacctggaggccgccctgaagggggaggagcagaagaatgaagaaaatgtggacctgaccccaggcatcctggccagcccccagagcgcccctggcaacctggacaacagcaagtctggagagatcaagggaaatggaagtggcggcagccgggagaacagcacagtggacttcagcaaggtggacatgaacttcatgaggaagatccccactggagctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccatgaaattggccgcagcatcgccaccctgatgacagatgagatcttccatgatgtggcctacaaggccaaggacagaaatgacctgctgtctggaattgatgagttcctggaccaggtgacagtgctgcccccaggagagtgggaccccagcatccgcatcgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcacctttggaggcctgctgggggaggccacagagggccgcatcagcgccatcgagagcctgtttggagccagcctgactggaattgcctacagcctgtttgctggccagcccctgaccatcctgggcagcactggacctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggggccggctaccacctggacctgctgatggtgggcgtgatgctgggcgtgtgcagcgtgatgggcctgccctggtttgtggccgccaccgtgctgagcatcagccacgtgaacagcctgaaggtggagagtgaatgttctgcccctggagagcagcccaagttcctgggcatccgggagcagagggtgacaggcctgatgatcttcatcctgatgggcctgtctgtgttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgaaggaggcagcctgctgcagatccctgtgaaggccctgaagtacagcgtggaccccagcatcgtgaacatcagtgatgagatggccaagacagcccagtggaaggccctgtccatgaacacagaaaatgccaaggtgaccaggagcaacatgagcccagacaagcctgtgtctgtgaagatcagctttgaagatgagcccaggaagaagtatgtggatgctgagaccagcctgtag

SEQ ID NO: 170824 - DNA, 3396 bp, Artificial Sequence
  Description of Artificial Sequence: Synthetic coding sequence
atggaggctgatggagctggggagcagatgaggcccctgctgacccggggcccagatgaggaggccgtggtggacctgggcaagaccagcagcacagtgaacaccaagtttgagaaggaggagctggagagccacagagctgtgtacatcggcgtgcacgtgcccttcagcaaggagagcagaagaagacaccgccaccggggccacaagcaccaccacagaagaaggaaggacaaggagagtgacaaggaggatggccgggagagccccagctatgacacccccagccagagggtgcagttcatcctgggcacagaagatgatgatgaggagcacatcccccatgacctcttcacagagatggatgagctgtgctacagagatggagaggagtatgagtggaaggagacagcccgctggctgaagtttgaagaagatgtggaggatggaggagaccgctggagcaagccctacgtggccaccctgagcctgcacagcctgtttgagctgcggagctgcatcctgaatggcaccgtgatgctggacatgagggccagcaccctggatgaaattgctgacatggtgctggacaacatgattgccagcggccagctggatgagagcatcagagaaaatgtgcgggaggccctgctgaagaggcaccaccaccagaatgagaagcgcttcaccagccgcatccccctggtgcgcagctttgctgacatcggcaagaagcacagcgacccccacctgctggagagaaatggcatcctggccagcccccagagcgcccctggcaacctggacaacagcaagtctggagagatcaagggaaatggaagtggcggcagccgggagaacagcacagtggacttcagcaaggtggacatgaacttcatgaggaagatccccactggagctgaggccagcaatgtgctggtgggggaggtggacttcctggagcggcccatcatcgcctttgtgcggctggccccagctgtgctgctgaccggcctgacagaggtgcctgtgcccacccgcttcctgttcctgctgctgggccctgctgggaaggccccccagtaccatgaaattggccgcagcatcgccaccctgatgacagatgagatcttccatgatgtggcctacaaggccaaggacagaaatgacctgctgtctggaattgatgagttcctggaccaggtgacagtgctgcccccaggagagtgggaccccagcatccgcatcgagccccccaagtctgtgcccagccaggagaagaggaagatccctgtgttccacaacggcagcacccccaccctgggggagacccccaaggaggccgcccaccacgccggccctgagctgcagaggacaggccgcctgtttggaggcctcatcctggacatcaagaggaaggcccccttcttcctgagtgacttcaaggatgccctgagcctgcagtgcctggccagcatcctcttcctgtactgtgcctgcatgagccctgtgatcacctttggaggcctgctgggggaggccacagagggccgcatcagcgccatcgagagcctgtttggagccagcctgactggaattgcctacagcctgtttgctggccagcccctgaccatcctgggcagcactggacctgtgctggtgtttgagaagatcctgtacaagttctgccgggactaccagctgagctacctgagcctgcggaccagcatcggcctgtggaccagcttcctgtgcatcgtgctggtggccacagatgccagcagcctggtgtgctacatcacccgcttcacagaggaggcctttgctgccctgatctgcatcatcttcatctatgaggccctggagaagctgtttgacctgggggagacctacgccttcaacatgcacaacaacctggacaagctgaccagctacagctgtgtgtgcacagagccccccaaccccagcaatgagaccctggcccagtggaagaaggacaacatcacagcccacaacatctcctggaggaacctgactgtgtctgagtgcaagaagctgcggggcgtcttcctgggcagcgcctgtggccaccacggcccctacatcccagatgtgctcttctggtgtgtgatcctcttcttcaccaccttcttcctgagcagcttcctgaagcagttcaagaccaagcgctacttccccaccaaggtgcgcagcaccatcagtgactttgctgtgttcctgaccatcgtcatcatggtgaccatcgactacctggtgggcgtgcccagccccaagctgcacgtgcctgagaagtttgagcccacccaccctgagcggggctggatcatcagccccctgggggacaacccctggtggaccctgctgattgctgccatcccagccctgctgtgcaccatcctgatcttcatggaccagcagatcacagctgtgatcatcaacaggaaggagcacaagctgaagaagggggccggctaccacctggacctgctgatggtgggcgtgatgctgggcgtgtgcagcgtgatgggcctgccctggtttgtggccgccaccgtgctgagcatcagccacgtgaacagcctgaaggtggagagtgaatgttctgcccctggagagcagcccaagttcctgggcatccgggagcagagggtgacaggcctgatgatcttcatcctgatgggcctgtctgtgttcatgacctctgtgctgaagttcatccccatgcctgtgctgtatggagtcttcctgtacatgggcgtgagcagcctgaagggcatccagctgtttgaccgcatcaagctgtttggcatgcctgccaagcaccagcctgacctgatctacctgcgctacgtgcccctgtggaaggtgcacatcttcaccgtcatccagctgacctgcctggtgctgctgtgggtgatcaaggtgtctgctgctgctgtggtgttccccatgatggtgctggccctggtgtttgtgaggaagctgatggacctgtgcttcaccaagcgggagctgtcctggctggatgacctgatgcctgagagcaagaagaagaaggaggatgacaagaagaagaaggagaaggaggaggccgagaggatgctgcaggatgatgatgacacagtgcacctgccctttgaaggaggcagcctgctgcagatccctgtgaaggccctgaagtacagcgtggaccccagcatcgtgaacatcagtgatgagatggccaagacagcccagtggaaggccctgtccatgaacacagaaaatgccaaggtgaccaggagcaacatgagcccagacaagcctgtgtctgtgaagatcagctttgaagatgagcccaggaagaagtatgtggatgctgagaccagcctgtag

SEQ ID NO: 170825 - DNA, 1392 bp, Artificial Sequence; identical to SEQ ID NO: 170820
  Description of Artificial Sequence: Synthetic coding sequence

SEQ ID NO: 170826 - DNA, 3135 bp, Artificial Sequence; identical to SEQ ID NO: 170788
  Description of Artificial Sequence: Synthetic coding sequence

SEQ ID NO: 170827 - DNA, 3216 bp, Artificial Sequence
  Description of Artificial Sequence: Synthetic coding sequence
atgttcaacaagaacaacagcaacaagctgcggagcaccccccgctacagaagaggagaccccggctacctgaacttcacagagctgggccccctgaagccagagcagaaggaccagtggagccagcacaggccagatgaggaggccgtggtggaccagggcggcaccagcaccatcctgaacatccactatgagaaggaggagctggagggccacaggaccctgtatgtgggcgtgaggatgcccctgggccggcagagccaccgccaccacaggacccacggccagaagcacagaagaagaggccggggcaaaggagccagccagggcgaggagggcctggaggccctggcccatgacacccccagccagagggtgcagttcatcctgggcacagaggaggatgaggagcacgtgccccatgagctgttcacagagctggatgagatctgcatgaaggagggggaggatgctgagtggaaggagacagcccgctggctgaagtttgaagaagatgtggaggatggaggagagcgctggagcaagccctacgtggccaccctgagcctgcacagcctgtttgagctgcggagctgcctgatcaatggcaccgtgctgctggacatgcacgccaacagcattgaggagatcagtgacctgatcctggaccagcaggagctgagcagtgacctgaatgacagcatgagggtgaaggtgcgggaggccctgctgaagaagcaccaccaccagaatgagaagaagaggaacaacctgatccccatcgtgcgcagctttgctgaggtgggcaagaagcagagcgacccccacctgatggacaagcacggccagacagtgagcccccagagcgtgcccaccaccaacctggaggtgaagaatggagtgaactgtgagcacagccctgtggacctgagcaaggtggacctgcacttcatgaagaagatccccactggagctgaggccagcaatgtgctggtgggggaggtggacatcctggaccggcccatcgtggcctttgtgcggctgagccctgctgtgctgctgagcggcctgacagaggtgcccatccccacccgcttcctgttcatcctgctgggccctgtgggcaagggccagcagtaccatgaaattggccgctccatggccaccatcatgacagatgagatcttccatgatgtggcctacaaggccaaggagagagatgacctgctggccggcattgatgagttcctggaccaggtgacagtgctgcccccaggagagtgggaccccagcatccgcatcgagccccccaagaatgtgcccagccaggagaagaggaagatgcctggggtgcccaatggaaatgtgtgccacatcgagcaggagccccacggcggccacagcggccctgagctgcagaggacaggccgcctgtttggaggcctggtgctggacatcaagaggaaggccccctggtactggagcgactacagagatgccctgagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttgctggccaggccctgaccatcctgggcagcactggacctgtgctggtgtttgagaagatcctcttcaagttctgcaaggactatgccctgagctacctgagcctgcgggcctgcatcggcctgtggacagccttcctgtgcatcgtgctggtggccacagatgccagcagcctggtgtgctacatcacccgcttcacagaggaggcctttgccagcctcatctgcatcatcttcatctatgaggccatcgagaagctgatccacctggccgagacctaccccatccacatgcacagccagctggaccacctgagcctgtactactgccgctgcaccctgcctgagaaccccaacaaccacaccctgcagtactggaaggaccacaacatcgtgacagctgaggtgcactgggccaacctgactgtgtctgagtgccaggagatgcatggagagttcatgggcagcgcctgtggccaccacggcccctacaccccagatgtgctcttctggagctgcatcctcttcttcaccaccttcatcctgagcagcaccctgaagaccttcaagaccagccgctacttccccaccagggtgcgctccatggtgtctgactttgctgtgttcctgaccatcttcaccatggtgatcatcgacttcctgattggagtgcccagccccaagctgcaggtgcccagcgtcttcaagcccaccagagatgaccggggctggatcatcaaccccatcggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccatcatgctgggcgtgtgcagcatcatgggcctgccctggtttgtggccgccaccgtgctgagcatcacccacgtgaacagcctgaagctggagagtgaatgttctgcccctggagagcagcccaagttcctgggcatccgggagcagagggtgacaggcctgatgatctttgtgctgatgggctgcagcgtcttcatgacagccatcctgaagttcatccccatgcctgtgctgtatggagtcttcctgtacatgggcgtgagcagcctgcagggcatccagttctttgaccggctgaagctgtttggcatgcctgccaagcaccagcctgacttcatctacctgcggcacgtgcccctgaggaaggtgcacctgttcaccctcatccagctgacctgcctggtgctgctgtgggtgatcaaggccagccctgctgccatcgtgttccccatgatggtgctggccctggtgtttgtgaggaaggtgatggacctgtgcttcagcaagcgggagctgtcctggctggatgacctgatgcctgagagcaagaagaagaagctggatgatgccaagaagaaggccaaggaggaggaggtgattgtgctggcccccaccgtgtacctgggcgccagcaactaccgcacctag

SEQ ID NO: 170828 - DNA, 2244 bp, Artificial Sequence; identical to SEQ ID NO: 170787
  Description of Artificial Sequence: Synthetic coding sequence

SEQ ID NO: 170829 - DNA, 3282 bp, Artificial Sequence
  Description of Artificial Sequence: Synthetic coding sequence
atgcctgctgctggcagcaatgaaccagatggagtgctgagctaccagaggccagatgaggaggccgtggtggaccagggcggcaccagcaccatcctgaacatccactatgagaaggaggagctggagggccacaggaccctgtatgtgggcgtgaggatgcccctgggccggcagagccaccgccaccacaggacccacggccagaagcacagaagaagaggccggggcaagggggccagccagggcgaggagggcctggaggccctggcccatgacacccccagccagagggtgcagttcatcctgggcacagaagaagatgaggagcacgtgccccatgagctgttcacagagctggatgagatctgcatgaaggagggagaagatgctgagtggaaggagacagcccgctggctgaagtttgaggaggatgtggaggatggaggagagcgctggagcaagccctacgtggccaccctgagcctgcacagcctgtttgagctgcggagctgcctgatcaatggaacagtgctgctggacatgcacgccaacagcattgaggagatcagtgacctgatcctggaccagcaggagctgagcagtgacctgaatgacagcatgagggtgaaggtgcgggaggccctgctgaagaagcaccaccaccagaatgagaagaagaggaacaacctgatccccatcgtgcgcagctttgctgaggtgggcaagaagcagagcgacccccacctgatggacaagcacggccagacagtgagcccccagagcgtgcccaccaccaacctggaggtgaagaatggagtgaactgtgagcacagccctgtggacctgagcaaggtggacctgcacttcatgaagaagatccccaccggggctgaggccagcaatgtgctggtgggggaggtggacatcctggaccggcccatcgtggcctttgtgcggctgagccctgctgtgctgctgagcggcctgacagaggtgcccatccccacccgcttcctgttcatcctgctgggccctgtgggcaagggccagcagtaccacgagatcggccgctccatggccaccatcatgacagatgagatcttccatgatgtggcctacaaggccaaggagagagatgacctgctggccggcattgatgagttcctggaccaggtgacagtgctgcccccaggagagtgggaccccagcatcagaattgagccccccaagaatgtgcccagccaggagaagaggaagatgcctggggtgcccaatggaaatgtgtgccacatcgagcaggagccccatggaggccacagcggccctgagctgcagaggacaggccgcctgtttggaggcctggtgctggacatcaagaggaaggccccctggtactggagcgactacagagatgccctgagcctgcagtgcctggccagcttcctgttcctgtactgtgcctgcatgagccctgtgatcaccttcggcggcctgctgggggaggccacagagggccgcatcagcgccatcgagagcctgtttggagcctccatgacaggcatcgcctacagcctgtttgctggccaggccctgaccatcctgggcagcacaggccctgtgctggtgtttgagaagatcctcttcaagttctgcaaggactatgccctgagctacctgagcctgcgggcctgcatcggcctgtggacagccttcctgtgcatcgtgctggtggccacagatgccagcagcctggtgtgctacatcacccgcttcacagaggaggcctttgccagcctcatctgcatcatcttcatctatgaggccatcgagaagctgatccacctggccgagacctaccccatccacatgcacagccagctggaccacctgagcctgtactactgccgctgcaccctgcctgagaaccccaacaaccacaccctgcagtactggaaggaccacaacatcgtgacagctgaggtgcactgggccaacctgactgtgtctgagtgccaggagatgcacggggagttcatgggcagcgcctgtggccaccacggcccctacaccccagatgtgctcttctggagctgcatcctcttcttcaccaccttcatcctgagcagcaccctgaagaccttcaagaccagccgctacttccccaccagggtgcgctccatggtgtctgactttgctgtgttcctgaccatcttcaccatggtgatcatcgacttcctgattggagtgcccagccccaagctgcaggtgcccagcgtcttcaagcccaccagagatgaccggggctggatcatcaaccccatcggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccatcatgctgggcgtgtgcagcatcatgggcctgccctggtttgtggccgccaccgtgctgagcatcacccacgtgaacagcctgaagctggagagcgagtgcagcgcccctggagagcagcccaagttcctgggcatccgggagcagagggtgacaggcctgatgatctttgtgctgatgggctgcagcgtcttcatgacagccatcctgaagttcatccccatgcctgtgctgtatggagtcttcctgtacatgggcgtgagcagcctgcagggcatccagttctttgaccggctgaagctgtttggcatgcctgccaagcaccagcctgacttcatctacctgcggcacgtgcccctgaggaaggtgcacctgttcaccctcatccagctgacctgcctggtgctgctgtgggtgatcaaggccagccctgctgccatcgtgttccccatgatggtgctggccctggtgtttgtgaggaaggtgatggacctgtgcttcagcaagcgggagctgtcctggctggatgacctgatgcctgagagcaagaagaagaagctggatgatgccaagaagaaggccaaggaggaggaggaggccgagaagatgctggagattggaggagacaagttccccctggagagcaggaagctgctgagcagccctgggaagaacatcagctgccgctgtgaccccagcgagatcaacatcagtgatgagatgcccaagaccaccgtgtggaaggccctgtccatgaacagcggaaatgccaaggagaagagcctcttcaactag

SEQ ID NO: 170830 - DNA, 1917 bp, Artificial Sequence
  Description of Artificial Sequence: Synthetic coding sequence
atgcccctgggccggcagagccaccgccaccacaggacccacggccagaagcacagaagaagaggccggggcaaaggagccagccagggcgaggagggcctggaggccctggcccatgacacccccagccagagggtgcagttcatcctgggcacagaggaggatgaggagcacgtgccccatgagctgttcacagagctggatgagatctgcatgaaggagggggaggatgctgagtggaaggagacagcccgctggctgaagtttgaagaagatgtggaggatggaggagagcgctggagcaagccctacgtggccaccctgagcctgcacagcctgtttgagctgcggagctgcctgatcaatggcaccgtgctgctggacatgcacgccaacagcattgaggagatcagtgacctgatcctggaccagcaggagctgagcagtgacctgaatgacagcatgagggtgaaggtgcgggaggccctgctgaagaagcaccaccaccagaatgagaagaagaggaacaacctgatccccatcgtgcgcagctttgctgaggtgggcaagaagcagagcgacccccacctgatggacaagcacggccagacagtgagcccccagagcgtgcccaccaccaacctggaggtgaagaatggagtgaactgtgagcacagccctgtggacctgagcaaggtggacctgcacttcatgaagaagatccccactggagctgaggccagcaatgtgctggtgggggaggtggacatcctggaccggcccatcgtggcctttgtgcggctgagccctgctgtgctgctgagcggcctgacagaggtgcccatccccacccgcttcctgttcatcctgctgggccctgtgggcaagggccagcagtaccatgaaattggccgctccatggccaccatcatgacagatgagatcttccatgatgtggcctacaaggccaaggagagagatgacctgctggccggcattgatgagttcctggaccaggtgacagtgctgcccccaggagagtgggaccccagcatccgcatcgagccccccaagaatgtgcccagccaggagaagaggaagatgcctggggtgcccaatggaaatgtgtgccacatcgagcaggagccccacggcggccacagcggccctgagctgcagaggacaggccgcctgtttggaggcctggtgctggacatcaagaggaaggccccctggtactggagcgactacagagatgccctgagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttgctggccaggccctgaccatcctgggcagcactggacctgtgctggtgtttgagaagatcctcttcaagttctgcaaggactatgccctgagctacctgagcctgcgggcctgcatcggcctgtggacagccttcctgtgcatcgtgctggtggccacagatgccagcagcctggtgtgctacatcacccgcttcacagaggaggcctttgccagcctcatctgcatcatcttcatctatgaggccatcgagaagctgatccacctggccgagacctaccccatccacatgcacagccagctggaccacctgagcctgtactactgccgctgcaccctgcctgagaaccccaacaaccacaccctgcagtactggaaggaccacaacatcgtgacagctgaggtgcactgggccaacctgactgtgtctgtgtccctgggcgccgcccgctgccccagcatcgtgaccaccggcctgggcggcaccagcaagtag

SEQ ID NO: 170831 - DNA, 2976 bp, Artificial Sequence
  Description of Artificial Sequence: Synthetic coding sequence
atgcccctgggccggcagagccaccgccaccacaggacccacggccagaagcacagaagaagaggccggggcaaaggagccagccagggcgaggagggcctggaggccctggcccatgacacccccagccagagggtgcagttcatcctgggcacagaggaggatgaggagcacgtgccccatgagctgttcacagagctggatgagatctgcatgaaggagggggaggatgctgagtggaaggagacagcccgctggctgaagtttgaagaagatgtggaggatggaggagagcgctggagcaagccctacgtggccaccctgagcctgcacagcctgtttgagctgcggagctgcctgatcaatggcaccgtgctgctggacatgcacgccaacagcattgaggagatcagtgacctgatcctggaccagcaggagctgagcagtgacctgaatgacagcatgagggtgaaggtgcgggaggccctgctgaagaagcaccaccaccagaatgagaagaagaggaacaacctgatccccatcgtgcgcagctttgctgaggtgggcaagaagcagagcgacccccacctgatggacaagcacggccagacagtgagcccccagagcgtgcccaccaccaacctggaggtgaagaatggagtgaactgtgagcacagccctgtggacctgagcaaggtggacctgcacttcatgaagaagatccccactggagctgaggccagcaatgtgctggtgggggaggtggacatcctggaccggcccatcgtggcctttgtgcggctgagccctgctgtgctgctgagcggcctgacagaggtgcccatccccacccgcttcctgttcatcctgctgggccctgtgggcaagggccagcagtaccatgaaattggccgctccatggccaccatcatgacagatgagatcttccatgatgtggcctacaaggccaaggagagagatgacctgctggccggcattgatgagttcctggaccaggtgacagtgctgcccccaggagagtgggaccccagcatccgcatcgagccccccaagaatgtgcccagccaggagaagaggaagatgcctggggtgcccaatggaaatgtgtgccacatcgagcaggagccccacggcggccacagcggccctgagctgcagaggacaggccgcctgtttggaggcctggtgctggacatcaagaggaaggccccctggtactggagcgactacagagatgccctgagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttgctggccaggccctgaccatcctgggcagcactggacctgtgctggtgtttgagaagatcctcttcaagttctgcaaggactatgccctgagctacctgagcctgcgggcctgcatcggcctgtggacagccttcctgtgcatcgtgctggtggccacagatgccagcagcctggtgtgctacatcacccgcttcacagaggaggcctttgccagcctcatctgcatcatcttcatctatgaggccatcgagaagctgatccacctggccgagacctaccccatccacatgcacagccagctggaccacctgagcctgtactactgccgctgcaccctgcctgagaaccccaacaaccacaccctgcagtactggaaggaccacaacatcgtgacagctgaggtgcactgggccaacctgactgtgtctgagtgccaggagatgcatggagagttcatgggcagcgcctgtggccaccacggcccctacaccccagatgtgctcttctggagctgcatcctcttcttcaccaccttcatcctgagcagcaccctgaagaccttcaagaccagccgctacttccccaccagggtgcgctccatggtgtctgactttgctgtgttcctgaccatcttcaccatggtgatcatcgacttcctgattggagtgcccagccccaagctgcaggtgcccagcgtcttcaagcccaccagagatgaccggggctggatcatcaaccccatcggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccatcatgctgggcgtgtgcagcatcatgggcctgccctggtttgtggccgccaccgtgctgagcatcacccacgtgaacagcctgaagctggagagtgaatgttctgcccctggagagcagcccaagttcctgggcatccgggagcagagggtgacaggcctgatgatctttgtgctgatgggctgcagcgtcttcatgacagccatcctgaagttcatccccatgcctgtgctgtatggagtcttcctgtacatgggcgtgagcagcctgcagggcatccagttctttgaccggctgaagctgtttggcatgcctgccaagcaccagcctgacttcatctacctgcggcacgtgcccctgaggaaggtgcacctgttcaccctcatccagctgacctgcctggtgctgctgtgggtgatcaaggccagccctgctgccatcgtgttccccatgatggtgctggccctggtgtttgtgaggaaggtgatggacctgtgcttcagcaagcgggagctgtcctggctggatgacctgatgcctgagagcaagaagaagaagctggatgatgccaagaagaaggccaaggaggaggaggtgattgtgctggcccccaccgtgtacctgggcgccagcaactaccgcacctag

SEQ ID NO: 170832 - DNA, 3321 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatgccggccaggtggtgagcccccagagcgccccagcctgtgtggagaacaagaatgatgtgtcccgggagaacagcacagtggacttcagcaaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccatgaaattggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatccgcatcgagccccccaagaatgtgcccagccaggagaagaggaagatcccagctgtgcccaatggaacagctgcccacggggaggccgagccccacggcggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttggaggccagcccctgaccatcctgggcagcactggacctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcatggagaatatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagtgaatgttctgcccctggagagcagcccaagttcctgggcatccgggagcagagggtgacaggcctgatgatcttcatcctgatgggcagctctgtgttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtccagagctgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggaggaggagcagagcatgctggccatggaggatgagggcaccgtgcagctgcccctggagggccactacagagatgaccccagcgtcatcaacatcagtgatgagatgagcaagacagccctgtggaggaacctgctgatcacagctgacaacagcaaggacaaggagagcagcttccccagcaagagcattgagagcaggaaggagaagaaggctgacagcggcaagggcgtggaccgggagacctgcctgtag

SEQ ID NO: 170833 - DNA, 3300 bp, Artificial Sequence
  Description of Artificial Sequence: Synthetic coding sequence
atgcagagcctgggcgtgtctggcaacaggaaggtgatgcagagcggcacctgtgagcccttccagagcctgagccaccagagaaatgatgaggaggccgtggtggaccggggcggcaccaggagcatcctgaagacccactttgagaaggaggacctggagggccacaggaccctcttcatcggcgtgcacgtgcccctgggcggcaggaagagccaccggcggcaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagagaaggagaagatgctgagtggagggagacagcccgctggctgaagtttgaggaggatgtggaggatggaggagagcgctggagcaagccctacgtggccaccctgagcctgcacagcctgtttgagctgcggagctgcatcctgaatggaacagtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatgccggccaggtggtgagcccccagagcgccccagcctgtgtggagaacaagaatgatgtgtcccgggagaacagcacagtggacttcagcaaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccacgagatcggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatcagaattgagccccccaagaatgtgcccagccaggagaagaggaagatcccagctgtgcccaacggcacagctgcccatggagaggccgagccccatggaggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcaccttcggcggcctgctgggggaggccacagagggccgcatcagcgccatcgagagcctgtttggagcctccatgacaggcatcgcctacagcctgtttggaggccagcccctgaccatcctgggcagcacaggccctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcacggggagtatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagcgagtgcagcgcccctggagagcagcccaagttcctgggcatccgggagcagagggtgacaggcctgatgatcttcatcctgatgggcagcagcgtcttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtcccgggccgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggaggaggagcagagcatgctggccatggaggatgagggcaccgtgcagctgcccctggagggccactacagagatgaccccagcgtcatcaacatcagtgatgagatgagcaagacagccctgtggaggaacctgctgatcacagctgacaacagcaaggacaaggagagcagcttccccagcaagagcagccccagctag

SEQ ID NO: 170834 - DNA, 3354 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatggccaggtggtgagcccccagagcgccccagcctgtgtggagaacaagaatgatgtgtcccgggagaacagcacagtggacttcagcaagggcctgggcggccagcagaagggccacaccagcccctgtggcatgaagcagagacatgagaagggccccccccaccagcaggagcgggaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccacgagatcggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatcagaattgagccccccaagaatgtgcccagccaggagaagaggaagatcccagctgtgcccaacggcacagctgcccatggagaggccgagccccatggaggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcaccttcggcggcctgctgggggaggccacagagggccgcatcagcgccatcgagagcctgtttggagcctccatgacaggcatcgcctacagcctgtttggaggccagcccctgaccatcctgggcagcacaggccctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcacggggagtatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagcgagtgcagcgcccctggagagcagcccaagttcctgggcatccgggagcagagggtgacaggcctgatgatcttcatcctgatgggcagcagcgtcttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtcccgggccgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggaggaggagcagagcatgctggccatggaggatgagggcaccgtgcagctgcccctggagggccactacagagatgaccccagcgtcatcaacatcagtgatgagatgagcaagacagccctgtggaggaacctgctgatcacagctgacaacagcaaggacaaggagagcagcttccccagcaagagcagccccagctag

SEQ ID NO: 170835 - DNA, 3267 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatgccggccaggtggtgagcccccagagcgccccagcctgtgtggagaacaagaatgatgtgtcccgggagaacagcacagtggacttcagcaaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccatgaaattggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatccgcatcgagccccccaagaatgtgcccagccaggagaagaggaagatcccagctgtgcccaatggaacagctgcccacggggaggccgagccccacggcggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttggaggccagcccctgaccatcctgggcagcactggacctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcatggagaatatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagtgaatgttctgcccctggagagcagcccaagttcctgggcatccgggagcagagggtgacaggcctgatgatcttcatcctgatgggcagctctgtgttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtccagagctgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggaggaggagcagagcatgctggccatggaggatgagggcaccgtgcagctgcccctggagggccactacagagatgaccccagcgtcatcaacatcagtgatgagatgagcaagacagccctgtggaggaacctgctgatcacagctgacaacagcaaggacaaggagagcagcttccccagcaagagcagccccagctag

SEQ ID NO: 170836 - DNA, 3165 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatgccggccaggtggtgagcccccagagcgccccagcctgtgtggagaacaagaatgatgtgtcccgggagaacagcacagtggacttcagcaagggcctgggcggccagcagaagggccacaccagcccctgtggcatgaagcagagacatgagaagggccccccccaccagcaggagcgggaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccatgaaattggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatccgcatcgagccccccaagaatgtgcccagccaggagaagaggaagatcccagctgtgcccaatggaacagctgcccacggggaggccgagccccacggcggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttggaggccagcccctgaccatcctgggcagcactggacctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcatggagaatatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagtgaatgttctgcccctggagagcagcccaagttcctgggcatccgggagcagagggtgacaggcctgatgatcttcatcctgatgggcagctctgtgttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtccagagctgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggagcactag

SEQ ID NO: 170837 - DNA, 3357 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatgccggccaggtggtgagcccccagagcgccccagcctgtgtggagaacaagaatgatgtgtcccgggagaacagcacagtggacttcagcaagggcctgggcggccagcagaagggccacaccagcccctgtggcatgaagcagagacatgagaagggccccccccaccagcaggagcgggaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccatgaaattggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatccgcatcgagccccccaagaatgtgcccagccaggagaagaggaagatcccagctgtgcccaatggaacagctgcccacggggaggccgagccccacggcggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcacctttggaggcctgctgggggaggccacagagggccgcatcagcgccatcgagagcctgtttggagcctccatgactggaattgcctacagcctgtttggaggccagcccctgaccatcctgggcagcactggacctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcatggagaatatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagtgaatgttctgcccctggagagcagcccaagttcctgggcatccgggagcagagggtgacaggcctgatgatcttcatcctgatgggcagctctgtgttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtccagagctgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggaggaggagcagagcatgctggccatggaggatgagggcaccgtgcagctgcccctggagggccactacagagatgaccccagcgtcatcaacatcagtgatgagatgagcaagacagccctgtggaggaacctgctgatcacagctgacaacagcaaggacaaggagagcagcttccccagcaagagcagccccagctag

SEQ ID NO: 170838 - DNA, 3318 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatggccaggtggtgagcccccagagcgccccagcctgtgtggagaacaagaatgatgtgtcccgggagaacagcacagtggacttcagcaaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgcttcctgttcatcctgctgggccccctgggcaagggccagcagtaccacgagatcggccgcagcatcgccaccctgatgacagatgaggtgttccatgatgtggcctacaaggccaaggacagaaatgacctggtgtctggaattgatgagttcctggaccaggtgacagtgctgcccccaggagagtgggaccccagcatcagaattgagccccccaagaatgtgcccagccaggagaagaggaagatcccagctgtgcccaacggcacagctgcccatggagaggccgagccccatggaggccacagcggccctgagctgcagaggacaggccgcatctttggaggcctcatcctggacatcaagaggaaggccccctacttctggagcgacttcagagatgccttcagcctgcagtgcctggccagcttcctgttcctgtactgtgcctgcatgagccctgtgatcaccttcggcggcctgctgggggaggccacagagggccgcatcagcgccatcgagagcctgtttggagcctccatgacaggcatcgcctacagcctgtttggaggccagcccctgaccatcctgggcagcacaggccctgtgctggtgtttgagaagatcctcttcaagttctgcaaggagtatggcctgagctacctgagcctgcgggccagcatcggcctgtggacagccaccctgtgcatcatcctggtggccacagatgccagcagcctggtgtgctacatcacccgcttcacagaggaggcctttgccagcctcatctgcatcatcttcatctatgaggccctggagaagctgtttgagctgtctgaggcctaccccatcaacatgcacaatgacctggagctgctgacccagtacagctgcaactgtgtggagccccacaaccccagcaatggcaccctgaaggagtggagggagagcaacatcagcgccagtgacatcatctgggagaacctgactgtgtctgagtgcaagagcctgcacggggagtatgtgggccgggcctgtggccatgaccacccctacgtgcctgatgtgctcttctggagcgtcatcctcttcttcagcacagtgaccctgagcgccaccctgaagcagttcaagaccagccgctacttccccaccaaggtgcgcagcatcgtgtctgactttgctgtgttcctgaccatcctgtgcatggtgctgattgattatgccatcggcatccccagccccaagctgcaggtgcccagcgtcttcaagcccaccagagatgaccggggctggtttgtgacccccctgggccccaacccctggtggacagtgattgctgccatcatcccagccctgctgtgcaccatcctgatcttcatggaccagcagatcacagctgtgatcatcaacaggaaggagcacaagctgaagaagggctgcggctaccacctggacctgctgatggtggccgtgatgctgggcgtgtgcagcatcatgggcctgccctggtttgtggccgccaccgtgctgagcatcacccacgtgaacagcctgaagctggagagcgagtgcagcgcccctggagagcagcccaagttcctgggcatccgggagcagagggtgacaggcctgatgatcttcatcctgatgggcagcagcgtcttcatgaccagcatcctgaagttcatccccatgcctgtgctgtatggagtcttcctgtacatgggcgccagcagcctgaagggcatccagttctttgaccgcatcaagctgttctggatgcctgccaagcaccagcctgacttcatctacctgcggcacgtgcccctgaggaaggtgcacctgttcaccatcatccagatgagctgcctgggcctgctgtggatcatcaaggtgtcccgggccgccatcgtgttccccatgatggtgctggccctggtgtttgtgaggaagctgatggacctgctcttcaccaagcgggagctgtcctggctggatgacctgatgcctgagagcaagaagaagaagctggaggatgctgagaaggaggaggagcagagcatgctggccatggaggatgagggcaccgtgcagctgcccctggagggccactacagagatgaccccagcgtcatcaacatcagtgatgagatgagcaagacagccctgtggaggaacctgctgatcacagctgacaacagcaaggacaaggagagcagcttccccagcaagagcattgagagcaggaaggagaagaaggctgacagcgggaaaggagtggaccgggagacctgcctgtag

SEQ ID NO: 170839 - DNA, 1227 bp, Artificial Sequence
  Description of Artificial Sequence: Synthetic coding sequence
atggagatcaaggaccagggcgcccagatggagcccctgctgcccaccagaaatgatgaggaggccgtggtggacagaggaggcaccaggagcatcctgaagacccactttgagaaggaggacctggagggccacaggaccctcttcatcggcgtgcacgtgcccctgggcggcaggaagagccacagaagacaccgccaccggggccacaagcacaggaagagggaccgggagcgggacagcggcctggaggatggccgggagagccccagctttgacacccccagccagagggtgcagttcatcctgggcacagaagatgatgatgaggagcacatcccccatgacctcttcacagagctggatgagatctgctggagggagggggaggatgctgagtggagggagacagcccgctggctgaagtttgaagaagatgtggaggatggaggagagcgctggagcaagccctacgtggccaccctgagcctgcacagcctgtttgagctgcggagctgcatcctgaatggcaccgtgctgctggacatgcacgccaacaccctggaggagattgctgacatggtgctggaccagcaggtgagcagcggccagctgaatgaagatgtgcgccaccgggtgcatgaggccctgatgaagcagcaccaccaccagaaccagaagaagctgaccaaccgcatccccatcgtgcgcagctttgctgacatcggcaagaagcagagcgagcccaacagcatggacaagaatgccggccaggtggtgagcccccagagcgccccagcctgtgtggagaacaagaatgatgtgtcccgggagaacagcacagtggacttcagcaagggcctgggcggccagcagaagggccacaccagcccctgtggcatgaagcagagacatgagaagggccccccccaccagcaggagcgggaggtggacctgcacttcatgaagaagatccccccaggagctgaggccagcaacatcctggtgggggagctggagttcctggacagaacagtggtggcctttgtgcggctgagccctgctgtgctgctgcagggcctggccgaggtgcccatccccacccgctacttcatgatgctgcccatcaagctgaagatcgtgatgacctggtaccaggagctgatgtccttctggatccggctgctcttcagcctgctggagaatggcatccaggcctttgaatag

SEQ ID NO: 170840 - DNA, 2676 bp, Artificial Sequence
  Description of Artificial Sequence: Synthetic coding sequence
atgagccaggtgggcggccgcggggaccgctgcacccaggaggtgcagggcctggtgcacggggccggggacctgagcgccagcctggccgagaacagccccaccatgagccagaatggctactttgaggacagcagctactacaagtgtgacacagatgacacctttgaggcccgggaggagatcctgggagatgaggcctttgacacagccaacagcagcatcgtgtctggagagagcatccgcttctttgtgaatgtgaacctggagatgcaggccaccaacacagaaaatgaggccaccagcggcggctgtgtgctgctgcacaccagcaggaagtacctgaagctgaagaacttcaaggaggagatccgggcccaccgggacctggatggcttcctggcccaggccagcatcgtgctgaatgaaacagccaccagcctggacaacgtgctgcggaccatgctgcggagatttgcccgggaccctgacaacaatgagcccaactgcaacctggacctgctgatggccatgctgttcacagatgctggggcccccatgaggggcaaggtgcacctgctgagtgacaccatccagggcgtgacagccaccgtgactggagtgcgctaccagcagagctggctgtgcatcatctgcaccatgaaggccctgcagaagagacatgtgtgcatcagccggctggtgcggccccagaactggggcgagaacagctgtgaggtgcgctttgtgatcctggtgctggccccacccaagatgaagagcaccaagacagccatggaggtggcccggacctttgccaccatgttcagtgacatcgccttccggcagaagctgctggagaccaggacagaggaggagttcaaggaggccctggtgcaccagaggcagctgctgaccatggtgagccacggccctgtggcccccaggaccaaggagaggagcacagtgtccctgcctgcccaccgccaccctgagccccccaagtgcaaggactttgtgccctttgggaagggcatccgggaggacatcgcccggcgcttccccctgtaccccctggacttcacagatggcatcatcggcaagaacaaggctgtgggcaagtacatcaccaccaccctcttcctgtactttgcctgcctgctgcccaccatcgccttcggcagcctgaatgatgaaaatacagatggagccattgatgtgcagaagaccatcgccggccagagcatcggcggcctgctgtatgccctcttcagcggccagcccctggtgatcctgctgaccacagcccccctggccctgtacatccaggtgatccgggtcatctgtgatgattatgacctggacttcaacagcttctacgcctggacaggcctgtggaacagcttcttcctggccctgtatgccttcttcaacctgagcctggtgatgagcctcttcaagaggagcacagaggagatcatcgccctcttcatcagcatcacctttgtgctggatgctgtgaagggcaccgtgaagatcttctggaagtactactacggccactacctggatgactaccacaccaagaggaccagcagcctggtgtccctgagcggcctgggcgccagcctgaatgccagcctgcacacagccctgaatgccagcttcctggccagccccacagagctgcccagcgccacccacagcggccaggccacagctgtgctgagcctgctgatcatgctgggcaccctgtggctgggctacaccctgtaccagttcaagaagagcccctacctgcacccctgtgtgcgggagatcctgagtgactgtgccctgcccatcgctgtgctggccttcagcctcatcagcagccacggcttccgggagattgagatgagcaagttccgctacaaccccagcgagagcccctttgccatggcccagatccagagcctgagcctgcgggctgtgtctggggccatgggcctgggcttcctgctgtccatgctgttcttcatcgagcagaacctggtggccgccctggtgaatgccccagaaaatcggctggtgaagggcacagcctaccactgggacctgctgctgctggccatcatcaacacaggcctgagcctgtttggcctgccctggattcatgctgcctacccccacagccccctgcacgtgcgggccctggccctggtggaggagcgggtggagaatggccacatctatgacaccatcgtgaatgtgaaggagacccggctgaccagcctgggcgcctctgtgctggtgggcctgagcctgctgctgctgcctgtgcccctgcagtggatccccaagcctgtgctgtatggcctcttcctgtacatcgccctgaccagcctggatggcaaccagctggtgcagagggtggccctgctgctgaaggagcagacagcctacccacccacccactacatccggcgggtgccccagaggaagatccactacttcaccggcctgcaggtgctgcagctgctgctgctgtgtgccttcggcatgagcagcctgccctacatgaagatgatcttccccctcatcatgattgccatgatccccatccgctacatcctgctgccccgcatcatcgaggccaagtacctggatgtgatggatgctgagcaccggccctag

SEQ ID NO: 170841 - DNA, 2757 bp, Artificial Sequence
  Description of Artificial Sequence: Synthetic coding sequence
atgggcgtgtatggcccccaggacagaagtgagagcgagaagagagatgtgcagagggaccccccaccctggcacccccggcgggagggggagaggcctgcccgggcccggagcctgcccctggccgccgccggccagggcttcctgaggaagacctggatcagcgagcacgagaacagccccaccatgagccagaatggctactttgaggacagcagctactacaagtgtgacacagatgacacctttgaggcccgggaggagatcctgggagatgaggcctttgacacagccaacagcagcatcgtgtctggagagagcatccgcttctttgtgaatgtgaacctggagatgcaggccaccaacacagaaaatgaggccaccagcggcggctgtgtgctgctgcacaccagcaggaagtacctgaagctgaagaacttcaaggaggagatccgggcccaccgggacctggatggcttcctggcccaggccagcatcgtgctgaatgaaacagccaccagcctggacaacgtgctgcggaccatgctgcggagatttgcccgggaccctgacaacaatgagcccaactgcaacctggacctgctgatggccatgctgttcacagatgctggggcccccatgaggggcaaggtgcacctgctgagtgacaccatccagggcgtgacagccaccgtgactggagtgcgctaccagcagagctggctgtgcatcatctgcaccatgaaggccctgcagaagagacatgtgtgcatcagccggctggtgcggccccagaactggggcgagaacagctgtgaggtgcgcttcgtcatcctggtgctggccccacccaagatgaagagcaccaagacagccatggaggtggcccggacctttgccaccatgttcagtgacatcgccttccggcagaagctgctggagaccaggacagaggaggagttcaaggaggccctggtgcaccagaggcagctgctgaccatggtgagccacggccctgtggcccccaggaccaaggagaggagcacagtgtccctgcctgcccaccgccaccctgagccccccaagtgcaaggactttgtgccctttgggaagggcatcagagaagatattgcccggcgcttccccctgtaccccctggacttcacagatggcatcatcggcaagaacaaggctgtgggcaagtacatcaccaccaccctcttcctgtactttgcctgcctgctgcccaccatcgccttcggcagcctgaatgatgagaacacagatggagccattgatgtgcagaagaccatcgccggccagagcattggaggcctgctgtatgccctcttcagcggccagcccctggtgatcctgctgaccacagcccccctggccctgtacatccaggtgatccgggtcatctgtgatgattatgacctggacttcaacagcttctacgcctggacaggcctgtggaacagcttcttcctggccctgtatgccttcttcaacctgagcctggtgatgagcctcttcaagaggagcacagaggagatcatcgccctcttcatcagcatcacctttgtgctggatgctgtgaagggcaccgtgaagatcttctggaagtactactacggccactacctggatgactaccacaccaagaggaccagcagcctggtgtccctgagcggcctgggcgccagcctgaatgccagcctgcacacagccctgaatgccagcttcctggccagccccacagagctgcccagcgccacccacagcggccaggccacagctgtgctgagcctgctgatcatgctgggcaccctgtggctgggctacaccctgtaccagttcaagaagagcccctacctgcacccctgtgtgcgggagatcctgagtgactgtgccctgcccatcgctgtgctggccttcagcctcatcagcagccacggcttccgggagattgagatgagcaagttccgctacaaccccagcgagagcccctttgccatggcccagatccagagcctgagcctgcgggctgtgtctggggccatgggcctgggcttcctgctgtccatgctgttcttcatcgagcagaacctggtggccgccctggtgaatgcccctgagaaccggctggtgaagggcacagcctaccactgggacctgctgctgctggccatcatcaacacaggcctgagcctgtttggcctgccctggattcatgctgcctacccccacagccccctgcacgtgcgggccctggccctggtggaggagcgggtggagaatggccacatctatgacaccatcgtgaatgtgaaggagacccggctgaccagcctgggcgcctctgtgctggtgggcctgagcctgctgctgctgcctgtgcccctgcagtggatccccaagcctgtgctgtatggcctcttcctgtacatcgccctgaccagcctggatggcaaccagctggtgcagagggtggccctgctgctgaaggagcagacagcctacccacccacccactacatcagaagagtgccccagaggaagatccactacttcaccggcctgcaggtgctgcagctgctgctgctgtgtgccttcggcatgagcagcctgccctacatgaagatgatcttccccctcatcatgattgccatgatccccatccgctacatcctgctgccccgcatcatcgaggccaagtacctggatgtgatggatgctgagcaccggccctag

SEQ ID NO: 170842 - DNA, 951 bp, Artificial Sequence
  Description of Artificial Sequence: Synthetic coding sequence
atggctgctgccacccggcgggtcttccacctgcagccctgtgagaacagccccaccatgagccagaatggctactttgaggacagcagctactacaagtgtgacacagatgacacctttgaggcccgggaggagatcctgggagatgaggcctttgacacagccaacagcagcatcgtgtctggagagagcatccgcttctttgtgaatgtgaacctggagatgcaggccaccaacacagaaaatgaggccaccagcggcggctgtgtgctgctgcacaccagcaggaagtacctgaagctgaagaacttcaaggaggagatccgggcccaccgggacctggatggcttcctggcccaggccagcatcgtgctgaatgaaacagccaccagcctggacaacgtgctgcggaccatgctgcggagatttgcccgggaccctgacaacaatgagcccaactgcaacctggacctgctgatggccatgctgttcacagatgctggggcccccatgaggggcaaggtgcacctgctgagtgacaccatccagggcgtgacagccaccgtgactggagtgcgctaccagcagagctggctgtgcatcatctgcaccatgaaggccctgcagaagagacatgtgtgcatcagccggctggtgcggccccagaactggggcgagaacagctgtgaggtgcgctttgtgatcctggtgctggccccacccaagatgaagagcaccaagacagccatggaggtggcccggacctttgccaccatgttcagtgacatcgccttccggcagaagctgctggagaccaggacagaggaggagttcaaggaggccctggtgcaccagaggcagctgctgaccatggtgagccacggccctgtggcccccaggaccaaggagaggagcacagtgtccctgcctgcccaccgccaccctgagtag

SEQ ID NO: 170843 - DNA, 2628 bp, Artificial Sequence
  Description of Artificial Sequence: Synthetic coding sequence
atggctgctgccacccggcgggtcttccacctgcagccctgtgagaacagccccaccatgagccagaatggctactttgaggacagcagctactacaagtgtgacacagatgacacctttgaggcccgggaggagatcctgggagatgaggcctttgacacagccaacagcagcatcgtgtctggagagagcatccgcttctttgtgaatgtgaacctggagatgcaggccaccaacacagaaaatgaggccaccagcggcggctgtgtgctgctgcacaccagcaggaagtacctgaagctgaagaacttcaaggaggagatccgggcccaccgggacctggatggcttcctggcccaggccagcatcgtgctgaatgaaacagccaccagcctggacaacgtgctgcggaccatgctgcggagatttgcccgggaccctgacaacaatgagcccaactgcaacctggacctgctgatggccatgctgttcacagatgctggggcccccatgaggggcaaggtgcacctgctgagtgacaccatccagggcgtgacagccaccgtgactggagtgcgctaccagcagagctggctgtgcatcatctgcaccatgaaggccctgcagaagagacatgtgtgcatcagccggctggtgcggccccagaactggggcgagaacagctgtgaggtgcgctttgtgatcctggtgctggccccacccaagatgaagagcaccaagacagccatggaggtggcccggacctttgccaccatgttcagtgacatcgccttccggcagaagctgctggagaccaggacagaggaggagttcaaggaggccctggtgcaccagaggcagctgctgaccatggtgagccacggccctgtggcccccaggaccaaggagaggagcacagtgtccctgcctgcccaccgccaccctgagccccccaagtgcaaggactttgtgccctttgggaagggcatccgggaggacatcgcccggcgcttccccctgtaccccctggacttcacagatggcatcatcggcaagaacaaggctgtgggcaagtacatcaccaccaccctcttcctgtactttgcctgcctgctgcccaccatcgccttcggcagcctgaatgatgaaaatacagatggagccattgatgtgcagaagaccatcgccggccagagcatcggcggcctgctgtatgccctcttcagcggccagcccctggtgatcctgctgaccacagcccccctggccctgtacatccaggtgatccgggtcatctgtgatgattatgacctggacttcaacagcttctacgcctggacaggcctgtggaacagcttcttcctggccctgtatgccttcttcaacctgagcctggtgatgagcctcttcaagaggagcacagaggagatcatcgccctcttcatcagcatcacctttgtgctggatgctgtgaagggcaccgtgaagatcttctggaagtactactacggccactacctggatgactaccacaccaagaggaccagcagcctggtgtccctgagcggcctgggcgccagcctgaatgccagcctgcacacagccctgaatgccagcttcctggccagccccacagagctgcccagcgccacccacagcggccaggccacagctgtgctgagcctgctgatcatgctgggcaccctgtggctgggctacaccctgtaccagttcaagaagagcccctacctgcacccctgtgtgcgggagatcctgagtgactgtgccctgcccatcgctgtgctggccttcagcctcatcagcagccacggcttccgggagattgagatgagcaagttccgctacaaccccagcgagagcccctttgccatggcccagatccagagcctgagcctgcgggctgtgtctggggccatgggcctgggcttcctgctgtccatgctgttcttcatcgagcagaacctggtggccgccctggtgaatgccccagaaaatcggctggtgaagggcacagcctaccactgggacctgctgctgctggccatcatcaacacaggcctgagcctgtttggcctgccctggattcatgctgcctacccccacagccccctgcacgtgcgggccctggccctggtggaggagcgggtggagaatggccacatctatgacaccatcgtgaatgtgaaggagacccggctgaccagcctgggcgcctctgtgctggtgggcctgagcctgctgctgctgcctgtgcccctgcagtggatccccaagcctgtgctgtatggcctcttcctgtacatcgccctgaccagcctggatggcaaccagctggtgcagagggtggccctgctgctgaaggagcagacagcctacccacccacccactacatccggcgggtgccccagaggaagatccactacttcaccggcctgcaggtgctgcagctgctgctgctgtgtgccttcggcatgagcagcctgccctacatgaagatgatcttccccctcatcatgattgccatgatccccatccgctacatcctgctgccccgcatcatcgaggccaagtacctggatgtgatggatgctgagcaccggccctag

SEQ ID NO: 170844 - DNA, 1113 bp, Artificial Sequence
  Description of Artificial Sequence: Synthetic coding sequence
atgaccctggccagccggctgagcacagctgccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggcgtgctgatggtgtgcatcgtgattggagccaggaagctgggcgtgaacccagacaacatcgccacccccatcgccgccagcctgggggacctgatcaccctgagcatcctggccctggtgtcctccttcttctaccgccacaaggacagccgctacctgacccccctggtgtgcctgagctttgctgccctgacccctgtgtgggtgctgattgccaagcagagcccccccatcgtgaagatcctgaagtttggctggttccccatcatcctggccatggtgatcagcagctttggaggcctcatcctgagcaagacagtgtccaagcagcagtacaagggcatggccatcttcacccctgtgatctgtggggtgggcggcaacctggtggccatccagaccagccgcatcagcacctacctgcacatgtggagcgcccctggggtgctgcccctgcagatgaagaagttctggcccaacccctgcagcaccttctgcaccagcgagatcaacagcatgtctgcccgggtgctgctgctgctggtggtgcccggccacctgatcttcttctacatcatctacctggtggagggccagagcgtcatcaacagccagacctttgtggtgctgtacctgctggccggcctcatccaggtgaccatcctgctgtacctggccgaggtgatggtgcggctgacctggcaccaggccctggaccctgacaaccactgcatcccctacctgaccggcctgggggacctgctgggcaccggcctgctggccctgtgcttcttcacagactggctgctgaagagcaaggccgagctgggcggcatcagcgagctggccagcggccccccatag

SEQ ID NO: 170845 - DNA, 1542 bp, Artificial Sequence
  Description of Artificial Sequence: Synthetic coding sequence
atgagcagcaagccagagcccaaggatgtgcaccagctgaatggcaccggccccagcgccagcccctgcagcagtgatggccctggccgggagcccctggccggcaccagcgagttcctgggcccagatggagctggggtggaggtggtgattgagagccgggccaatgccaagggcgtgcgggaggaggatgccctgctggagaatggcagccagagcaatgaaagtgatgatgtgtccacagaccggggccctgccccacccagccccctgaaggagaccagcttcagcatcggcctgcaggtgctcttccccttcctgctggccggctttggaacagtggccgccggcatggtgctggacatcgtgcagcactgggaggtgttccagaaggtgacagaggtgttcatcctggtgcctgccctgctgggcctgaagggcaacctggagatgaccctggccagccggctgagcacagctgccaacatcggccacatggacacccccaaggagctgtggaggatgatcactggaaacatggccctgatccaggtgcaggccaccgtggtgggcttcctggccagcattgctgctgtggtgtttggctggatcccagatggccacttcagcatcccccacgccttcctgctgtgtgccagctctgtggccacagccttcatcgccagcctggtgctgggcatgatcatgattggagtcatcatcggcagcaggaagattggcatcaacccagacaacgtggccacccccatcgccgccagcctgggggacctgatcaccctggccctgctgagcggcatctcctggggcctgtacctggagctgaaccactggagatacatctaccccctggtgtgtgccttctttgtggccctgctgcctgtgtgggtggtgctggcccggcgcagccctgccacccgggaggtgctgtacagcggctgggagcccgtcatcatcgccatggccatcagctctgtgggcggcctcatcctggacaagacagtgtctgaccccaactttgctggcatggctgtgttcacccctgtgatcaatggagtgggcggcaacctggtggccgtgcaggccagccgcatcagcaccttcctgcacatgaatggcatgcctggagaaaattctgagcaggccccccggcgctgccccagcccctgcaccaccttcttctccccagatgtgaacagccgcagcgcccgggtgctcttcctgctggtggtgcccggccacctggtgttcctgtacaccatcagctgcatgcagggcggccacaccaccctgaccctcatcttcatcatcttctacatgacagctgccctgctgcaggtgctgatcctgctgtacatcgctgactggatggtgcactggatgtggggccggggcctggaccctgacaacttcagcatcccctacctgacagccctgggggacctgctgggcaccggcctgctggccctgtccttccacgtgctgtggctgattggagaccgggacacagatgtgggggactag

SEQ ID NO: 170846 - DNA, 1722 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgcctgtgatctaccagaagaaccaggaggacagacacaagaaggccaacggcatctggcaggacggcctgagcacagctgtgcagaccttcagcaacagaagtgagcagcacatggagtaccacagcttcagcgagcagagcttccacgccaacaacggccacgccagcagcagctgcagccagaagtatgatgattatgccaactacaactactgtgatggccgggagaccagcgagaccacagccatgctgcaggatgaggacatcagcagtgatggagatgaagatgccatcgtggaggtgacccccaagctgcccaaggagagcagcggcatcatggccctgcagatcctggtgcccttcctgctggccggcttcggcaccgtgtctgctggcatggtgctggacatcgtgcagcactgggaggtgttcaggaaggtgacagaggtgttcatcctggtgcctgccctgctgggcctgaagggcaacctggagatgaccctggccagccggctgagcacagctgtgaacatcggcaagatggacagccccatcgagaagtggaacctgatcatcggcaacctggccctgaagcaggtgcaggccaccgtggtgggcttcctggccgctgtggccgccatcatcctgggctggatccctgagggcaagtactacctggaccacagcatcctgctgtgcagcagctctgtggccacagccttcatcgccagcctgctgcagggcatcatcatggtgggcgtgattgtgggcagcaagaagacaggcatcaacccagacaacgtggccacccccatcgccgccagctttggagacctgatcaccctggccatcctggcctggatcagccagggcctgtacagctgcctggagacctactactacatcagccccctggtgggcgtcttcttcctggccctgacccccatctggatcatcatcgccgccaagcacccagccaccaggacagtgctgcacagcggctgggagcctgtgatcacagccatggtgatcagcagcattggaggcctcatcctggacaccaccgtgtctgaccccaacctggtgggcatcgtggtgtacacccctgtgatcaatggcatcggcggcaacctggtggccatccaggccagccgcatcagcacctacctgcacctgcacagcatccctggagagctgcctgatgagcccaagggctgctactaccccttccgcaccttcttcggccctggggtgaacaacaagagcgcccaggtgctgctgctgctggtgattcctggccacctgatcttcctgtacaccatccacctgatgaagagcggccacaccagcctgaccatcatcttcatcgtggtgtacctgtttggagctgtgctgcaggtgttcaccctgctgtggattgctgactggatggtgcaccacttctggaggaagggcaaggaccctgacagcttcagcatcccctacctgacagccctgggggacctgctgggcacagccctgctggccctgtccttccacttcctgtggctgattggagacagagatggagatgtgggggactag

SEQ ID NO: 170847 - DNA, 369 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgcctgtgatctaccagaagaaccaggaggacagacacaagaaggccaacggcatctggcaggacggcctgagcacagctgtgcagaccttcagcaacagaagtgagcagcacatggagtaccacagcttcagcgagcagagcttccacgccaacaacggccacgccagcagcagctgcagccagaagtatgatgattatgccaactacaactactgtgatggccgggagtag

SEQ ID NO: 170848 - DNA, 432 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgcctgtgatctaccagaagaaccaggaggacagacacaagaaggccaacggcatctggcaggacggcctgagcacagctgtgcagaccttcagcaacagaagtgagcagcacatggagtaccacagcttcagcgagcagagcttccacgccaacaacggccacgccagcagcagctgcagccagaagtatgatgattatgccaactacaactactgtgatggccgggagaccagcgagaccacagccatgctgcaggatgaggacatcagcagtgatggagatgaagatgcctag

SEQ ID NO: 170849 - DNA, 141 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgtag

SEQ ID NO: 170850 - DNA, 219 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgcctgtgatctaccagaagaaccaggaggacagacacaagaaggccaacggcatctggcaggacggcctgagcacagcctag

SEQ ID NO: 170851 - DNA, 39 bp, Artificial Sequence
  Description of Artificial Sequence: Synthetic coding sequence
atgaccaacagcaagggccgcagcatcacagacaagtag

SEQ ID NO: 170852 - DNA, 231 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgcctgtgatctaccagaagaaccaggaggacagacacaagaaggccaacggcatctggcaggacggcctgagcacagctgtgcagaccttctag

SEQ ID NO: 170853 - DNA, 285 bp, Artificial Sequence
  Description of Artificial Sequence: Synthetic coding sequence
atgaccaacagcaagggccgcagcatcacagacaagaccagcggcggccccagcagcggcggcggctttgtggactggaccctgcggctgaacaccatccagagcgacaagttcctgaacctgctgctgtccatggtgcctgtgatctaccagaagaaccaggaggacagacacaagaaggccaacggcatctggcaggacggcctgagcacagctgtgcagaccttcagcaacagaagtgagcagcacatggagtaccacagcttcagcgagcagagcttctag

SEQ ID NO: 170854 - DNA, 1524 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgctggactacttccagcactggcctgtgtttgtggaggtgaaggacctgctgaccctggtgccccccctggtgggcctgaagggcaacctggagatgaccctggccagccggctgagcacagctgccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggcgtgctgatggtgtgcatcgtcatcggggccaggaagctgggcgtgaacccagacaacatcgccacccccatcgccgccagcctgggggacctgatcaccctgagcatcctggccctggtgagcagcttcttctaccgccacaaggacagccgctacctgacccccctggtgtgcctgagctttgctgccctgacccctgtgtgggtgctgattgccaagcagagcccccccatcgtgaagatcctgaagtttggctggttccccatcatcctggccatggtgatcagcagctttggaggcctcatcctgagcaagacagtgtccaagcagcagtacaagggcatggccatcttcacccctgtgatctgtggggtgggcggcaacctggtggccatccagaccagccgcatcagcacctacctgcacatgtggagcgcccctggggtgctgcccctgcagatgaagaagttctggcccaacccctgcagcaccttctgcaccagcgagatcaacagcatgtctgcccgggtgctgctgctgctggtggtgcccggccacctgatcttcttctacatcatctacctggtggagggccagagcgtcatcaacagccagacctttgtggtgctgtacctgctggccggcctcatccaggtgaccatcctgctgtacctggccgaggtgatggtgcggctgacctggcaccaggccctggaccctgacaaccactgcatcccctacctgaccggcctgggggacctgctgggcagcagctctgtgggccacacagctgctgtgccccggcgctgcacagccagccctggctggggcctcatccagcccttcatctgcacccagcacctgattgtgtccctgctgtccttctacttccccttctgcctgctggccaagaccagcatctag

SEQ ID NO: 170855 - DNA, 1416 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgctggactacttccaggccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggcgtgctgatggtgtgcatcgtcatcggggccaggaagctgggcgtgaacccagacaacatcgccacccccatcgccgccagcctgggggacctgatcaccctgagcatcctggccctggtgagcagcttcttctaccgccacaaggacagccgctacctgacccccctggtgtgcctgagctttgctgccctgacccctgtgtgggtgctgattgccaagcagagcccccccatcgtgaagatcctgaagtttggctggttccccatcatcctggccatggtgatcagcagctttggaggcctcatcctgagcaagacagtgtccaagcagcagtacaagggcatggccatcttcacccctgtgatctgtggggtgggcggcaacctggtggccatccagaccagccgcatcagcacctacctgcacatgtggagcgcccctggggtgctgcccctgcagatgaagaagttctggcccaacccctgcagcaccttctgcaccagcgagatcaacagcatgtctgcccgggtgctgctgctgctggtggtgcccggccacctgatcttcttctacatcatctacctggtggagggccagagcgtcatcaacagccagacctttgtggtgctgtacctgctggccggcctcatccaggtgaccatcctgctgtacctggccgaggtgatggtgcggctgacctggcaccaggccctggaccctgacaaccactgcatcccctacctgaccggcctgggggacctgctgggcagcagctctgtgggccacacagctgctgtgccccggcgctgcacagccagccctggctggggcctcatccagcccttcatctgcacccagcacctgattgtgtccctgctgtccttctacttccccttctgcctgctggccaagaccagcatctag

SEQ ID NO: 170856 - DNA, 1464 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgctggactacttccagcactggcctgtgtttgtggaggtgaaggacctgctgaccctggtgccccccctggtgggcctgaagggcaacctggagatgaccctggccagccggctgagcacagctgccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggcgtgctgatggtgtgcatcgtcatcggggccaggaagctgggcgtgaacccagacaacatcgccacccccatcgccgccagcctgggggacctgatcaccctgagcatcctggccctggtgagcagcttcttctaccgccacaaggacagccgctacctgacccccctggtgtgcctgagctttgctgccctgacccctgtgtgggtgctgattgccaagcagagcccccccatcgtgaagatcctgaagtttggctggttccccatcatcctggccatggtgatcagcagctttggaggcctcatcctgagcaagacagtgtccaagcagcagtacaagggcatggccatcttcacccctgtgatctgtggggtgggcggcaacctggtggccatccagaccagccgcatcagcacctacctgcacatgtggagcgcccctggggtgctgcccctgcagatgaagaagttctggcccaacccctgcagcaccttctgcaccagcgagatcaacagcatgtctgcccgggtgctgctgctgctggtggtgcccggccacctgatcttcttctacatcatctacctggtggagggccagagcgtcatcaacagccagacctttgtggtgctgtacctgctggccggcctcatccaggtgaccatcctgctgtacctggccgaggtgatggtgcggctgacctggcaccaggccctggaccctgacaaccactgcatcccctacctgaccggcctgggggacctgctgggcaccggcctgctggccctgtgcttcttcacagactggctgctgaagagcaaggccgagctgggcggcatcagcgagctggccagcggccccccatag

SEQ ID NO: 170857 - DNA, 1386 bp, Artificial Sequence
  Description of Artificial Sequence: Synthetic coding sequence
atggtggtgacccagctgaacctggagttctgcttccagggcaagaagctgcggggcttcagctgtgagctgaccaggagcccccatggagtgctgcctgagagcttcttcaccatcatgtgccaggtggtggtgcccatcctgctgagcggcctgtgcatgatgacagctggcctggtgatgaacaccatccagcactggcctgtgtttgtggaggtgaaggacctgctgaccctggtgccccccctggtgggcctgaagggcaacctggagatgaccctggccagccggctgagcacagctgccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggcgtgctgatggtgtgcatcgtcatcggggccaggaagctgggcgtgaacccagacaacatcgccacccccatcgccgccagcctgggggacctgatcaccctgagcatcctggccctggtgagcagcttcttctaccgccacaaggacagccgctacctgacccccctggtgtgcctgagctttgctgccctgacccctgtgtgggtgctgattgccaagcagagcccccccatcgtgaagatcctgaagtttggctggttccccatcatcctggccatggtgatcagcagctttggaggcctcatcctgagcaagacagtgtccaagcagcagtacaagggcatggccatcttcacccctgtgatctgtggggtgggcggcaacctggtggccatccagaccagccgcatcagcacctacctgcacatgtggagcgcccctggggtgctgcccctgcagatgaagaagttctggcccaacccctgcagcaccttctgcaccagcgagatcaacagcatgtctgcccgggtgctgctgctgctggtggtgcccggccacctgatcttcttctacatcatctacctggtggagggccagagcgtcatcaacagccagacctttgtggtgctgtacctgctggccggcctcatccaggtgaccatcctgctgtacctggccgaggtgatggtgcggctgacctggcaccaggccctggaccctgacaaccactgcatcccctacctgaccggcctgggggacctgctgggcaccggcctgctggccctgtgcttcttcacagactggctgctgaagagcaaggccgagctgggcggcatcagcgagctggccagcggccccccatag

SEQ ID NO: 170858 - DNA, 1437 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggtgacagtgcccttcatgtttgctggcctgggcctgtcctgggccggcatgctgctggactacttccagcactggcctgtgtttgtggaggtgaaggacctgctgaccctggtgccccccctggtgggcctgaagggcaacctggagatgaccctggccagccggctgagcacagctgccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggcgtgctgatggtgtgcatcgtgattggagccaggaagctgggcgtgaacccagacaacatcgccacccccatcgccgccagcctgggggacctgatcaccctgagcatcctggccctggtgtcctccttcttctaccgccacaaggacagccgctacctgacccccctggtgtgcctgagctttgctgccctgacccctgtgtgggtgctgattgccaagcagagcccccccatcgtgaagatcctgaagtttggctggttccccatcatcctggccatggtgatcagcagctttggaggcctcatcctgagcaagacagtgtccaagcagcagtacaagggcatggccatcttcacccctgtgatctgtggggtgggcggcaacctggtggccatccagaccagccgcatcagcacctacctgcacatgtggagcgcccctggggtgctgcccctgcagatgaagaagttctggcccaacccctgcagcaccttctgcaccagcgagatcaacagcatgtctgcccgggtgctgctgctgctggtggtgcccggccacctgatcttcttctacatcatctacctggtggagggccagagcgtcatcaacagccagacctttgtggtgctgtacctgctggccggcctcatccaggtgaccatcctgctgtacctggccgaggtgatggtgcggctgacctggcaccaggccctggaccctgacaaccactgcatcccctacctgaccggcctgggggacctgctgggcaccggcctgctggccctgtgcttcttcacagactggctgctgaagagcaaggccgagctgggcggcatcagcgagctggccagcggccccccatag

SEQ ID NO: 170859 - DNA, 459 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgctggactacttccagcactggcctgtgtttgtggaggtgaaggacctgctgaccctggtgccccccctggtgggcctgaagggcaacctggagatgaccctggccagccggctgagcacagctgccaacacaggccagattgatgacccccaggagcagcacagggtcatcagcagcaacctggccctgatccaggtgtag

SEQ ID NO: 170860 - DNA, 459 bp, Artificial Sequence; identical to SEQ ID NO: 170859
  Description of Artificial Sequence: Synthetic coding sequence

SEQ ID NO: 170861 - DNA, 261 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgtag

SEQ ID NO: 170862 - DNA, 606 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgctggactacttccagcactggcctgtgtttgtggaggtgaaggacctgctgaccctggtgccccccctggtgggcctgaagggcaacctggagatgaccctggccagccggctgagcacagctgccaacacaggccagattgatgacccccaggagcagcacagggtcatcagcagcaacctggccctgatccaggtgcaggccaccgtggtgggcctgctggccgctgtggccgccctgctgctgggcgtggtgtcccgggaggaggtggatgtggccaaggtggagctgctgtgtgccagctctgtgctgacagccttcctggccgcctttgccctgggggagtag

SEQ ID NO: 170863 - DNA, 414 bp, Artificial Sequence
  Description of Artificial Sequence: Synthetic coding sequence
atggatggaacagagacccggcagaggcggctggacagctgtgggaagccaggagagctgggcctgccccaccccctgagcactggaggcctgcctgtggcctctgaagatggagccctgcgggcccctgagagccagagcgtgacccccaagcccctggagacagagcccagccgggagaccacctggagcatcggcctgcaggtgacagtgcccttcatgtttgctggcctgggcctgtcctgggccggcatgctgctggactacttccaggccaacacaggccagattgatgacccccaggagcagcacagggtcatcagcagcaacctggccctgatccaggtgcaggccaccgtggtgggcctgctggccgctgtggccgccctgctgctgggcgtggtgtccaggtag

SEQ ID NO: 170864 - DNA, 459 bp, Artificial Sequence; identical to SEQ ID NO: 170859
  Description of Artificial Sequence: Synthetic coding sequence

SEQ ID NO: 170865 - DNA, 1680 bp, Artificial Sequence
  Description of Artificial Sequence: Synthetic coding sequence
atggcccccaccctgcagcaggcctacagaagacgctggtggatggcctgcacagctgtgctggagaacctcttcttctctgctgtgctgctgggctggggcagcctgctgatcatcctgaagaatgaaggcttctacagcagcacctgcccagctgagagcagcaccaacaccacccaggatgagcagaggcgctggccaggctgtgaccagcaggatgagatgctgaacctgggcttcaccatcggcagctttgtgctgagcgccaccaccctgcccctgggcatcctgatggacagatttggccccaggcctgtgcggctggtgggcagcgcctgcttcaccgccagctgcaccctgatggccctggccagcagagatgtggaggccctgagccccctcatcttcctggccctgagcctgaatggatttggaggcatctgcctgaccttcaccagcctgaccctgcccaacatgtttggaaacctgcggagcaccctgatggccctgatgattggcagctatgccagcagcgccatcaccttccctggcatcaagctgatctatgatgctggggtggcctttgtggtgatcatgttcacctggagcggcctggcctgcctgatcttcctgaactgcaccctgaactggcccatcgaggccttccctgcccctgaggaggtgaactacaccaagaagatcaagctgagcggcctggccctggaccacaaggtgactggagacctcttctacacccacgtgaccaccatgggccagaggctgagccagaaggcccccagcctggaggatggcagtgatgccttcatgagcccccaggatgtgcggggcaccagcgagaacctgcctgagaggtctgtgcccctgaggaagagcctgtgcagccccaccttcctgtggagcctgctgaccatgggcatgacccagctgcgcatcatcttctacatggctgctgtgaacaagatgctggagtacctggtgactggaggccaggagcacgagaccaatgagcagcagcagaaggtggccgagaccgtgggcttctacagctctgtgtttggagccatgcagctgctgtgcctgctgacctgccccctgattggctacatcatggactggaggatcaaggactgtgtggatgcccccacccagggcaccgtgctgggagatgccagagatggagtggccaccaagagcatccggccccgctactgcaagatccagaagctgaccaatgccatcagcgccttcaccctgaccaacctgctgctggtgggcttcggcatcacctgcctgatcaacaacctgcacctgcagtttgtgacctttgtgctgcacaccatcgtgcggggcttcttccacagcgcctgtggcagcctgtatgctgctgtgttccccagcaaccacttcggcaccctgaccggcctgcagagcctcatctctgctgtgtttgccctgctgcagcagcccctcttcatggccatggtgggccccctgaagggggagcccttctgggtgaacctgggcctgctgctcttcagcctgctgggcttcctgctgcccagctacctgttctactaccgggcccggctgcagcaggagtatgctgccaacggcatgggccccctgaaggtgctgagcggcagcgaggtgacagcctag

SEQ ID NO: 170866 - DNA, 1680 bp, Artificial Sequence; identical to SEQ ID NO: 170865
  Description of Artificial Sequence: Synthetic coding sequence

SEQ ID NO: 170867 - DNA, 333 bp, Artificial Sequence
  Description of Artificial Sequence: Synthetic coding sequence
atggcccccaccctgcagcaggcctacagaagacgctggtggatggcctgcacagctgtgctggagaacctcttcttctctgctgtgctgctgggctggggcagcctgctgatcatcctgaagaatgaaggcttctacagcagcacctgcccagctgagagcagcaccaacaccacccaggatgagcagaggcgctggccaggctgtgaccagcaggatgagatgctgaacctgggcttcaccatcggcagctttgtgctgagcgccaccaccctgcccctgggcatcctgatggacagatttggccccaggcctgtgcggctggtgggctag

SEQ ID NO: 170868 - DNA, 1710 bp, Artificial Sequence
  Description of Artificial Sequence: Synthetic coding sequence
atggcccccaccctggccacagcccacagaagacgctggtggatggcctgcacagctgtgctggagaacctgctcttctctgctgtgctgctgggctggggcagcctgctgatcatgctgaagtctgagggcttctacagctacctgtgcacagagccagaaaatgtgaccaacggcaccgtgggcggcacagctgagcccggccacgaggaggtgtcctggatgaatggctggctgagctgccaggcccaggatgagatgctgaacctggccttcaccgtgggcagcttcctgctgagcgccatcaccctgcccctgggcatcgtgatggacaagtatggccccaggaagctgcggctgctgggcagcgcctgctttgctgtgtcctgcctgctgattgcctatggagccagcaagcccaatgccctgtctgtgctgatcttcatcgccctggccctgaatggatttggaggcatgtgcatgaccttcaccagcctgaccctgcccaacatgtttggagacctgcggagcaccttcatcgccctgatgattggcagctatgccagcagcgctgtgaccttccctggcatcaagctgatctatgatgctggggtgtccttcatcgtggtgctggtggtgtgggccggctgcagcggcctggtgttcctgaactgcttcttcaactggcccctggagcccttccctggccctgaggacatggactacagcgtgaagatcaagttctcctggctgggctttgaccacaagatcaccgggaagcagttctacaagcaggtgaccaccgtgggccgccgcctgtctgtgggcagctccatgaggtctgccaaggagcaggtggccctgcaggagggccacaagctgtgcctgagcacagtggacctggaggtgaagtgccagccagatgctgctgtggcccccagcttcatgcacagcgtcttcagccccatcctgctgctgagcctggtgaccatgtgtgtgacccagctgcggctcatcttctacatgggcgccatgaacaacatcctgaagttcctggtgtctggggaccagaagacagtgggcctgtacaccagcatctttggagtgctgcagctgctgtgcctgctgacagcccctgtgattggctacatcatggactggaggctgaaggaatgtgaagatgccagcgaggagcctgaggagaaggatgccaaccagggcgagaagaagaagaagaagagggaccggcagatccagaagatcaccaatgccatgagggcctttgccttcaccaacctgctgctggtgggcttcggcgtgacctgcctgatccccaacctgcccctgcagatcctgtccttcatcctgcacaccatcgtgcggggcttcatccacagcgctgtgggcggcctgtatgctgctgtgtaccccagcacccagtttggcagcctgaccggcctgcagagcctcatcagcgccctgtttgccctgctgcagcagcccctcttcctggccatgatgggccccctgcagggcgaccccctgtgggtgaatgtgggcctgctgctgctgagcctgctgggcttctgcctgcccctgtacctgatctgctaccgccggcagctggagcggcagctgcagcagaggcaggaggatgacaagctgttcctgaagatcaatggcagcagcaaccaggaggcctttgtgtag

SEQ ID NO: 170869 - DNA, 1722 bp, Artificial Sequence
  Description of Artificial Sequence: Synthetic coding sequence
atggcccccaccctggccacagcccacagaagacgctggtggatggcctgcacagctgtgctggagaacctgctcttctctgctgtgctgctgggctggggcagcctgctgatcatgctgaagtctgagggcttctacagctacctgtgcacagagccagaaaatgtgaccaacggcaccgtgggcggcacagctgagcccggccacgaggaggtgtcctggatgaatggctggctgagctgccaggcccaggatgagatgctgaacctggccttcaccgtgggcagcttcctgctgagcgccatcaccctgcccctgggcatcgtgatggacaagtatggccccaggaagctgcggctgctgggcagcgcctgctttgctgtgtcctgcctgctgattgcctatggagccagcaagcccaatgccctgtctgtgctgatcttcatcgccctggccctgaatggatttggaggcatgtgcatgaccttcaccagcctgaccctgcccaacatgtttggagacctgcggagcaccttcatcgccctgatgattggcagctatgccagcagcgctgtgaccttccctggcatcaagctgatctatgatgctggggtgtccttcatcgtggtgctggtggtgtgggccggctgcagcggcctggtgttcctgaactgcttcttcaactggcccctggagcccttccctggccctgaggacatggactacagcgtgaagatcaagttctcctggctgggctttgaccacaagatcaccgggaagcagttctacaagcaggtgaccaccgtgggccgccgcctgtctgtgggcagctccatgaggtctgccaaggagcaggtggccctgcaggagggccacaagctgtgcctgagcacagtggacctggaggtgaagtgccagccagatgctgctgtggcccccagcttcatgcacagcgtcttcagccccatcctgctgctgagcctggtgaccatgtgtgtgacccagctgcggctcatcttctacatgggcgccatgaacaacatcctgaagttcctggtgtctggggaccagaagacagccagcagcacagtgggcctgtacaccagcatctttggagtgctgcagctgctgtgcctgctgacagcccctgtgattggctacatcatggactggaggctgaaggaatgtgaagatgccagcgaggagcctgaggagaaggatgccaaccagggcgagaagaagaagaagaagagggaccggcagatccagaagatcaccaatgccatgagggcctttgccttcaccaacctgctgctggtgggcttcggcgtgacctgcctgatccccaacctgcccctgcagatcctgtccttcatcctgcacaccatcgtgcggggcttcatccacagcgctgtgggcggcctgtatgctgctgtgtaccccagcacccagtttggcagcctgaccggcctgcagagcctcatcagcgccctgtttgccctgctgcagcagcccctcttcctggccatgatgggccccctgcagggcgaccccctgtgggtgaatgtgggcctgctgctgctgagcctgctgggcttctgcctgcccctgtacctgatctgctaccgccggcagctggagcggcagctgcagcagaggcaggaggatgacaagctgttcctgaagatcaatggcagcagcaaccaggaggcctttgtgtag

SEQ ID NO: 170870 - DNA, 1299 bp, Artificial Sequence
  Description of Artificial Sequence: Synthetic coding sequence
atgacctacggcagcccccaggccaatgccagccccagtgatgctgtggccctggaccacggggaggtgtcccggcggcagcagcaggagctgcccaacatgtttggagacctgcggagcaccttcatcgccctgatgattggcagctatgccagcagcgctgtgaccttccctggcatcaagctgatctatgatgctggggtgtccttcatcgtggtgctggtggtgtgggccggctgcagcggcctggtgttcctgaactgcttcttcaactggcccctggagcccttccctggccctgaggacatggactacagcgtgaagatcaagttctcctggctgggctttgaccacaagatcaccgggaagcagttctacaagcaggtgaccaccgtgggccggcggctgtctgtgggcagctccatgaggtctgccaaggagcaggtggccctgcaggagggccacaagctgtgcctgagcacagtggacctggaggtgaagtgccagccagatgctgctgtggcccccagcttcatgcacagcgtcttcagccccatcctgctgctgagcctggtgaccatgtgtgtgacccagctgcggctcatcttctacatgggcgccatgaacaacatcctgaagttcctggtgtctggggaccagaagacagtgggcctgtacaccagcatcttcggcgtgctgcagctgctgtgcctgctgacagcccctgtgattggctacatcatggactggaggctgaaggaatgtgaagatgccagcgaggagcctgaggagaaggatgccaaccagggcgagaagaagaagaagaagagggaccggcagatccagaagatcaccaatgccatgagggcctttgccttcaccaacctgctgctggtgggctttggagtgacctgcctgatccccaacctgcccctgcagatcctgtccttcatcctgcacaccatcgtgcggggcttcatccacagcgctgtgggcggcctgtatgctgctgtgtaccccagcacccagtttggcagcctgaccggcctgcagagcctcatcagcgccctgtttgccctgctgcagcagcccctcttcctggccatgatgggccccctgcagggcgaccccctgtgggtgaatgtgggcctgctgctgctgagcctgctgggcttctgcctgcccctgtacctgatctgctaccgccggcagctggagcggcagctgcagcagaggcaggaggatgacaagctgttcctgaagatcaatggcagcagcaaccaggaggcctttgtgtag

SEQ ID NO: 170871 - DNA, 1341 bp, Artificial Sequence
  Description of Artificial Sequence: Synthetic coding sequence
atgaccagcaaggagatcatcctgggcctgtgcctgctgagcctggtgctgtccatgatcctgatggtgatcatccgctacatcagccgggtgctggtgtggatcctgaccatcctggtgatcctgggcagcctgggcggcaccggggtgctgtggtggctgtatgccaagcagaggaggagccccaaggagaccgtgaccccagagcagctgcagattgctgaggacaacctgcgggccctgctgatctatgccatcagcgccaccgtcttcaccgtcatcctcttcctgatcatgctggtgatgaggaagagggtggccctgaccatcgccctcttccacgtggccggcaaggtgttcatccacctgcccctgctggtgttccagcccttctggaccttctttgccctggtgctcttctgggtgtactggatcatgaccctgctcttcctgggcaccaccggcagccctgtgcagaatgagcagggctttgtggagttcaagatcagcggccccctgcagtacatgtggtggtaccacgtggtgggcctcatctggatcagcgagttcatcctggcctgccagcagatgacagtggccggggctgtggtgacctactacttcacccgggacaagaggaacctgcccttcacccccatcctggcctctgtgaacagactcatccgctaccacctgggcaccgtggccaagggcagcttcatcatcaccctggtgaagatccccaggatgatcctgatgtacatccacagccagctgaagggcaaggaaaatgcctgtgcccgctgtgtgctgaagagctgcatctgctgcctgtggtgcctggagaagtgcctgaactacctgaaccagaatgcctacacagccacagccatcaacagcaccaacttctgcaccagcgccaaggatgcctttgtgatcctggtggagaatgccctgcgggtggccaccatcaacacagtgggggacttcatgctgttcctgggcaaggtgctgattgtgtgcagcacaggcctggccggcatcatgctgctgaactaccagcaggactacacagtgtgggtgctgcccctcatcatcgtgtgcctgtttgccttcctggtggcccactgcttcctgagcatctatgagatggtggtggatgtgctcttcctgtgctttgccatcgacaccaagtacaatgatggcagccctggccgggagttctacatggacaaggtgctgatggagtttgtggagaacagcaggaaggccatgaaggaggccggcaagggcggcgtggccgacagccgggagctgaagcccatgctgaagaagaggtag

SEQ ID NO: 170872 - DNA, 1974 bp, Artificial Sequence
  Description of Artificial Sequence: Synthetic coding sequence
atgggctgctgcagcagcgccagcagcgctgcccagagcagcaagcgggagtggaagcccctggaggacaggagctgcacagacatcccctggctgctgctcttcatcctcttctgcatcggcatgggcttcatctgtggcttcagcatcgccaccggggctgctgcccggctggtgtctggctatgacagctatggcaacatctgtggccagaagaacaccaagctggaggccatccccaacagcggcatggaccacacccagaggaaatatgtgttcttcctggacccctgcaacctggacctgatcaacaggaagatcaagtctgtggccctgtgtgtggccgcctgcccccggcaggagctgaagaccctgagtgatgtgcagaagtttgctgagatcaatggaagtgccctgtgcagctacaacctgaagcccagcgagtacaccaccagccccaagagctctgtgctgtgccccaagctgcctgtgcctgccagcgcccccatccccttcttccaccgctgtgcccctgtgaacatcagctgctacgccaagtttgctgaggccctgatcacctttgtgtctgacaacagcgtgctgcacaggctcatcagcggcgtgatgaccagcaaggagatcatcctgggcctgtgcctgctgagcctggtgctgtccatgatcctgatggtgatcatccgctacatcagccgggtgctggtgtggatcctgaccatcctggtgatcctgggcagcctgggcggcaccggggtgctgtggtggctgtatgccaagcagaggaggagccccaaggagaccgtgaccccagagcagctgcagattgctgaggacaacctgcgggccctgctgatctatgccatcagcgccaccgtcttcaccgtcatcctcttcctgatcatgctggtgatgaggaagagggtggccctgaccatcgccctcttccacgtggccggcaaggtgttcatccacctgcccctgctggtgttccagcccttctggaccttctttgccctggtgctcttctgggtgtactggatcatgaccctgctcttcctgggcaccaccggcagccctgtgcagaatgagcagggctttgtggagttcaagatcagcggccccctgcagtacatgtggtggtaccacgtggtgggcctcatctggatcagcgagttcatcctggcctgccagcagatgacagtggccggggctgtggtgacctactacttcacccgggacaagaggaacctgcccttcacccccatcctggcctctgtgaacagactcatccgctaccacctgggcaccgtggccaagggcagcttcatcatcaccctggtgaagatccccaggatgatcctgatgtacatccacagccagctgaagggcaaggaaaatgcctgtgcccgctgtgtgctgaagagctgcatctgctgcctgtggtgcctggagaagtgcctgaactacctgaaccagaatgcctacacagccacagccatcaacagcaccaacttctgcaccagcgccaaggatgcctttgtgatcctggtggagaatgccctgcgggtggccaccatcaacacagtgggggacttcatgctgttcctgggcaaggtgctgattgtgtgcagcacaggcctggccggcatcatgctgctgaactaccagcaggactacacagtgtgggtgctgcccctcatcatcgtgtgcctgtttgccttcctggtggcccactgcttcctgagcatctatgagatggtggtggatgtgctcttcctgtgctttgccatcgacaccaagtacaatgatggcagccctggccgggagttctacatggacaaggtgctgatggagtttgtggagaacagcaggaaggccatgaaggaggccggcaagggcggcgtggccgacagccgggagctgaagcccatggccagcggggccagcagcgcctag

SEQ ID NO: 170873 - DNA, 1959 bp, Artificial Sequence
  Description of Artificial Sequence: Synthetic coding sequence
atgggctgctgcagcagcgccagcagcgctgcccagagcagcaagcgggagtggaagcccctggaggacaggagctgcacagacatcccctggctgctgctcttcatcctcttctgcatcggcatgggcttcatctgtggcttcagcatcgccaccggggctgctgcccggctggtgtctggctatgacagctatggcaacatctgtggccagaagaacaccaagctggaggccatccccaacagcggcatggaccacacccagaggaaatatgtgttcttcctggacccctgcaacctggacctgatcaacaggaagatcaagtctgtggccctgtgtgtggccgcctgcccccggcaggagctgaagaccctgagtgatgtgcagaagtttgctgagatcaatggaagtgccctgtgcagctacaacctgaagcccagcgagtacaccaccagccccaagagctctgtgctgtgccccaagctgcctgtgcctgccagcgcccccatccccttcttccaccgctgtgcccctgtgaacatcagctgctacgccaagtttgctgaggccctgatcacctttgtgtctgacaacagcgtgctgcacaggctcatcagcggcgtgatgaccagcaaggagatcatcctgggcctgtgcctgctgagcctggtgctgtccatgatcctgatggtgatcatccgctacatcagccgggtgctggtgtggatcctgaccatcctggtgatcctgggcagcctgggcggcaccggggtgctgtggtggctgtatgccaagcagaggaggagccccaaggagaccgtgaccccagagcagctgcagattgctgaggacaacctgcgggccctgctgatctatgccatcagcgccaccgtcttcaccgtcatcctcttcctgatcatgctggtgatgaggaagagggtggccctgaccatcgccctcttccacgtggccggcaaggtgttcatccacctgcccctgctggtgttccagcccttctggaccttctttgccctggtgctcttctgggtgtactggatcatgaccctgctcttcctgggcaccaccggcagccctgtgcagaatgagcagggctttgtggagttcaagatcagcggccccctgcagtacatgtggtggtaccacgtggtgggcctcatctggatcagcgagttcatcctggcctgccagcagatgacagtggccggggctgtggtgacctactacttcacccgggacaagaggaacctgcccttcacccccatcctggcctctgtgaacagactcatccgctaccacctgggcaccgtggccaagggcagcttcatcatcaccctggtgaagatccccaggatgatcctgatgtacatccacagccagctgaagggcaaggaaaatgcctgtgcccgctgtgtgctgaagagctgcatctgctgcctgtggtgcctggagaagtgcctgaactacctgaaccagaatgcctacacagccacagccatcaacagcaccaacttctgcaccagcgccaaggatgcctttgtgatcctggtggagaatgccctgcgggtggccaccatcaacacagtgggggacttcatgctgttcctgggcaaggtgctgattgtgtgcagcacaggcctggccggcatcatgctgctgaactaccagcaggactacacagtgtgggtgctgcccctcatcatcgtgtgcctgtttgccttcctggtggcccactgcttcctgagcatctatgagatggtggtggatgtgctcttcctgtgctttgccatcgacaccaagtacaatgatggcagccctggccgggagttctacatggacaaggtgctgatggagtttgtggagaacagcaggaaggccatgaaggaggccggcaagggcggcgtggccgacagccgggagctgaagcccatgatcaagtag

SEQ ID NO: 170874 - DNA, 1965 bp, Artificial Sequence
  Description of Artificial Sequence: Synthetic coding sequence
atgggctgctgcagcagcgccagcagcgctgcccagagcagcaagcgggagtggaagcccctggaggacaggagctgcacagacatcccctggctgctgctcttcatcctcttctgcatcggcatgggcttcatctgtggcttcagcatcgccaccggggctgctgcccggctggtgtctggctatgacagctatggcaacatctgtggccagaagaacaccaagctggaggccatccccaacagcggcatggaccacacccagaggaaatatgtgttcttcctggacccctgcaacctggacctgatcaacaggaagatcaagtctgtggccctgtgtgtggccgcctgcccccggcaggagctgaagaccctgagtgatgtgcagaagtttgctgagatcaatggaagtgccctgtgcagctacaacctgaagcccagcgagtacaccaccagccccaagagctctgtgctgtgccccaagctgcctgtgcctgccagcgcccccatccccttcttccaccgctgtgcccctgtgaacatcagctgctacgccaagtttgctgaggccctgatcacctttgtgtctgacaacagcgtgctgcacaggctcatcagcggcgtgatgaccagcaaggagatcatcctgggcctgtgcctgctgagcctggtgctgtccatgatcctgatggtgatcatccgctacatcagccgggtgctggtgtggatcctgaccatcctggtgatcctgggcagcctgggcggcaccggggtgctgtggtggctgtatgccaagcagaggaggagccccaaggagaccgtgaccccagagcagctgcagattgctgaggacaacctgcgggccctgctgatctatgccatcagcgccaccgtcttcaccgtcatcctcttcctgatcatgctggtgatgaggaagagggtggccctgaccatcgccctcttccacgtggccggcaaggtgttcatccacctgcccctgctggtgttccagcccttctggaccttctttgccctggtgctcttctgggtgtactggatcatgaccctgctcttcctgggcaccaccggcagccctgtgcagaatgagcagggctttgtggagttcaagatcagcggccccctgcagtacatgtggtggtaccacgtggtgggcctcatctggatcagcgagttcatcctggcctgccagcagatgacagtggccggggctgtggtgacctactacttcacccgggacaagaggaacctgcccttcacccccatcctggcctctgtgaacagactcatccgctaccacctgggcaccgtggccaagggcagcttcatcatcaccctggtgaagatccccaggatgatcctgatgtacatccacagccagctgaagggcaaggaaaatgcctgtgcccgctgtgtgctgaagagctgcatctgctgcctgtggtgcctggagaagtgcctgaactacctgaaccagaatgcctacacagccacagccatcaacagcaccaacttctgcaccagcgccaaggatgcctttgtgatcctggtggagaatgccctgcgggtggccaccatcaacacagtgggggacttcatgctgttcctgggcaaggtgctgattgtgtgcagcacaggcctggccggcatcatgctgctgaactaccagcaggactacacagtgtgggtgctgcccctcatcatcgtgtgcctgtttgccttcctggtggcccactgcttcctgagcatctatgagatggtggtggatgtgctcttcctgtgctttgccatcgacaccaagtacaatgatggcagccctggccgggagttctacatggacaaggtgctgatggagtttgtggagaacagcaggaaggccatgaaggaggccggcaagggcggcgtggccgacagccgggagctgaagcccatgctgaagaagaggtag

SEQ ID NO: 170875 - DNA, 1974 bp, Artificial Sequence; identical to SEQ ID NO: 170872
  Description of Artificial Sequence: Synthetic coding sequence

SEQ ID NO: 170876 - DNA, 2121 bp, Artificial Sequence
  Description of Artificial Sequence: Synthetic coding sequence
atgggagatgagcggccccactactacggcaagcacggcaccccccagaagtatgaccccaccttcaagggccccatctacaacagaggctgcacagacatcatctgctgcgtgttcctgctgctggccatcgtgggctacgtggccgtgggcatcatcgcctggacccatggagaccccaggaaggtgatctaccccacagacagcagaggagagttctgtggccagaagggcaccaagaatgaaaacaagccctacctgttctacttcaacatcgtgaagtgtgccagccccctggtgctgctggagttccagtgccccaccccccagatctgtgtggagaagtgcccagaccgctacctgacctacctgaatgcccggagcagccgggactttgagtactacaagcagttctgtgtgcccggcttcaagaacaacaagggcgtggccgaggtgctgcaggatggagactgcccagctgtgctgatccccagcaagcccctggcccggcgctgcttccctgccatccacgcctacaagggcgtgctgatggtgggcaatgagaccacctatgaagatggccacggcagcaggaagaacatcacagacctggtggagggcgccaagaaggccaacggggtgctggaggcccggcagctggccatgaggatctttgaggactacacagtgtcctggtactggatcatcatcggcctggtgattgccatggccatgagcctgctcttcatcatcctgctgcgcttcctggccggcatcatggtgtgggtgatgatcatcatggtgatcctggtgctgggctacggcatcttccactgctacatggagtacagccggctgcggggggaggccggcagtgatgtgtccctggtggacctgggcttccagacagacttccgggtgtacctgcacctgcggcagacctggctggccttcatgatcatcctgagcatcctggaggtgatcatcatcctgctgctgatcttcctgaggaagaggatcctgattgccatcgccctgatcaaggaggccagcagagctgtgggctacgtgatgtgcagcctgctgtaccccctggtgaccttcttcctgctgtgcctgtgcatcgcctactgggccagcacagctgtgttcctgagcaccagcaatgaagctgtgtacaagatctttgatgacagcccctgccccttcaccgccaagacctgcaaccctgagaccttccccagcagcaatgaaagccggcagtgccccaatgcccgctgccagtttgccttctacggcggggagagcggctaccaccgggccctgctgggcctgcagatcttcaatgccttcatgttcttctggctggccaactttgtgctggccctgggccaggtgaccctggccggggcctttgccagctactactgggccctgaggaagccagatgacctgcctgccttccccctcttcagcgccttcggccgggccctgcgctaccacacaggcagcctggcctttggagccctgatcctggccatcgtgcagatcatccgggtcatcctggagtacctggaccagaggctgaaggctgctgagaacaagtttgccaagtgcctgatgacctgcctgaagtgctgcttctggtgcctggagaagttcatcaagttcctgaacagaaatgcctacatcatgattgccatctacggcaccaacttctgcaccagcgccagaaatgccttcttcctgctgatgaggaacatcatccgggtggccgtgctggacaaggtgacagacttcctgttcctgctgggcaagctgctgattgtgggctctgtgggcatcctggccttcttcttcttcacccaccgcatcagaattgtgcaggacacagccccacccctgaactactactgggtgcccatcctgaccgtcatcgtgggcagctacctgattgcccacggcttcttctctgtgtatggcatgtgtgtggacaccctcttcctgtgcttcctggaggacctggagagaaatgatggcagcgctgagcggccctacttcatgagcagcaccctgaagaagctgctgaacaagaccaacaagaaggctgctgagagctag

SEQ ID NO: 170877 - DNA, 2121 bp, Artificial Sequence
  Description of Artificial Sequence: Synthetic coding sequence
atgggagatgagcggccccactactacggcaagcacggcaccccccagaagtatgaccccaccttcaagggccccatctacaacagaggctgcacagacatcatctgctgcgtgttcctgctgctggccatcgtgggctacgtggccgtgggcatcatcgcctggacccatggagaccccaggaaggtgatctaccccacagacagcagaggagagttctgtggccagaagggcaccaagaatgaaaacaagccctacctgttctacttcaacatcgtgaagtgtgccagccccctggtgctgctggagttccagtgccccaccccccagatctgtgtggagaagtgcccagaccgctacctgacctacctgaatgcccggagcagccgggactttgagtactacaagcagttctgtgtgcccggcttcaagaacaacaagggcgtggccgaggtgctgcaggatggagactgcccagctgtgctgatccccagcaagcccctggcccggcgctgcttccctgccatccacgcctacaagggcgtgctgatggtgggcaatgagaccacctatgaagatggccacggcagcaggaagaacatcacagacctggtggagggcgccaagaaggccaacggggtgctggaggcccggcagctggccatgaggatctttgaggactacacagtgtcctggtactggatcatcatcggcctggtgattgccatggccatgagcctgctcttcatcatcctgctgcgcttcctggccggcatcatggtgtgggtgatgatcatcatggtgatcctggtgctgggctacggcatcttccactgctacatggagtacagccggctgcggggggaggccggcagtgatgtgtccctggtggacctgggcttccagacagacttccgggtgtacctgcacctgcggcagacctggctggccttcatgatcatcctgagcatcctggaggtgatcatcatcctgctgctgatcttcctgaggaagaggatcctgattgccatcgccctgatcaaggaggccagcagagctgtgggctacgtgatgtgcagcctgctgtaccccctggtgaccttcttcctgctgtgcctgtgcatcgcctactgggccagcacagctgtgttcctgagcaccagcaatgaagctgtgtacaagatctttgatgacagcccctgccccttcaccgccaagacctgcaaccctgagaccttccccagcagcaatgaaagccggcagtgccccaatgcccgctgccagtttgccttctacggcggggagagcggctaccaccgggccctgctgggcctgcagatcttcaatgccttcatgttcttctggctggccaactttgtgctggccctgggccaggtgaccctggccggggcctttgccagctactactgggccctgaggaagccagatgacctgcctgccttccccctcttcagcgccttcggccgggccctgcgctaccacacaggcagcctggcctttggagccctgatcctggccatcgtgcagatcatccgggtcatcctggagtacctggaccagaggctgaaggctgctgagaacaagtttgccaagtgcctgatgacctgcctgaagtgctgcttctggtgcctggagaagttcatcaagttcctgaacagaaatgcctacatcatgattgccatctacggcaccaacttctgcaccagcgccagaaatgccttcttcctgctgatgaggaacatcatccgggtggccgtgctggacaaggtgacagacttcctgttcctgctgggcaagctgctgattgtgggctctgtgggcatcctggccttcttcttcttcacccaccgcatcagaattgtgcaggacacagccccacccctgaactactactgggtgcccatcctgaccgtcatcgtgggcagctacctgattgcccacggcttcttctctgtgtatggcatgtgtgtggacaccctcttcctgtgcttctgtgaggacctggagagaaatgatggcagccaggagcggccctacttcatgagccctgagctgcgggacatcctgctgaagggcagcgctgaggagggcaagaggtag

SEQ ID NO: 170878 - DNA, 2115 bp, Artificial Sequence
  Description of Artificial Sequence: Synthetic coding sequence
atggaggatgagaggaagaatggagcctacggcaccccccagaagtatgaccccaccttcaagggccccatctacaacagaggctgcacagacatcatctgctgcgtgttcctgctgctggccatcgtgggctacgtggccgtgggcatcatcgcctggacccatggagaccccaggaaggtgatctaccccacagacagcagaggagagttctgtggccagaagggcaccaagaatgaaaacaagccctacctgttctacttcaacatcgtgaagtgtgccagccccctggtgctgctggagttccagtgccccaccccccagatctgtgtggagaagtgcccagaccgctacctgacctacctgaatgcccggagcagccgggactttgagtactacaagcagttctgtgtgcccggcttcaagaacaacaagggcgtggccgaggtgctgcaggatggagactgcccagctgtgctgatccccagcaagcccctggcccggcgctgcttccctgccatccacgcctacaagggcgtgctgatggtgggcaatgagaccacctatgaagatggccacggcagcaggaagaacatcacagacctggtggagggcgccaagaaggccaacggggtgctggaggcccggcagctggccatgaggatctttgaggactacacagtgtcctggtactggatcatcatcggcctggtgattgccatggccatgagcctgctcttcatcatcctgctgcgcttcctggccggcatcatggtgtgggtgatgatcatcatggtgatcctggtgctgggctacggcatcttccactgctacatggagtacagccggctgcggggggaggccggcagtgatgtgtccctggtggacctgggcttccagacagacttccgggtgtacctgcacctgcggcagacctggctggccttcatgatcatcctgagcatcctggaggtgatcatcatcctgctgctgatcttcctgaggaagaggatcctgattgccatcgccctgatcaaggaggccagcagagctgtgggctacgtgatgtgcagcctgctgtaccccctggtgaccttcttcctgctgtgcctgtgcatcgcctactgggccagcacagctgtgttcctgagcaccagcaatgaagctgtgtacaagatctttgatgacagcccctgccccttcaccgccaagacctgcaaccctgagaccttccccagcagcaatgaaagccggcagtgccccaatgcccgctgccagtttgccttctacggcggggagagcggctaccaccgggccctgctgggcctgcagatcttcaatgccttcatgttcttctggctggccaactttgtgctggccctgggccaggtgaccctggccggggcctttgccagctactactgggccctgaggaagccagatgacctgcctgccttccccctcttcagcgccttcggccgggccctgcgctaccacacaggcagcctggcctttggagccctgatcctggccatcgtgcagatcatccgggtcatcctggagtacctggaccagaggctgaaggctgctgagaacaagtttgccaagtgcctgatgacctgcctgaagtgctgcttctggtgcctggagaagttcatcaagttcctgaacagaaatgcctacatcatgattgccatctacggcaccaacttctgcaccagcgccagaaatgccttcttcctgctgatgaggaacatcatccgggtggccgtgctggacaaggtgacagacttcctgttcctgctgggcaagctgctgattgtgggctctgtgggcatcctggccttcttcttcttcacccaccgcatcagaattgtgcaggacacagccccacccctgaactactactgggtgcccatcctgaccgtcatcgtgggcagctacctgattgcccacggcttcttctctgtgtatggcatgtgtgtggacaccctcttcctgtgcttcctggaggacctggagagaaatgatggcagcgctgagcggccctacttcatgagcagcaccctgaagaagctgctgaacaagaccaacaagaaggctgctgagagctag

SEQ ID NO: 170879 - DNA, 1248 bp, Artificial Sequence; identical to SEQ ID NO: 169713
  Description of Artificial Sequence: Synthetic coding sequence

SEQ ID NO: 170880 - DNA, 2007 bp, Artificial Sequence
  Description of Artificial Sequence: Synthetic coding sequence
atgggcggcaagcagagagatgaagatgatgaggcctacggcaagcctgtgaagtatgaccccagcttccggggccccatcaagaacagaagctgcacagatgtgatctgctgcgtgctcttcctgctcttcatcctgggctacatcgtggtgggcatcgtggcctggctgtatggagacccccggcaggtgctgtaccccaggaacagcactggagcctactgcggcatgggagagaacaaggacaagccctacctgctgtacttcaacatcttcagctgcatcctgagcagcaacatcatctctgtggctgaaaatggcctgcagtgccccaccccccagaccgtcatcaccagcctgcagcaggagctgtgccccagcttcctgctgcccagcgccccagccctgggccgctgcttcccctggaccaacgtgaccccaccagccctgcccggcatcaccaatgacaccaccatccagcagggcatcagcggcctgattgacagcctgaatgcccgggacatctctgtgaagatctttgaagattttgcccagagctggtactggatcctggtggccctgggcgtggccctggtgctgagcctgctcttcatcctgctgctgcggctggtggccggccccctggtgctggtgctgatcctgggcgtgctgggcgtgctggcctacggcatctactactgctgggaggagtacagagtgctgcgggacaagggggccagcatcagccagctgggcttcaccaccaacctgagcgcctaccagagcgtgcaggagacctggctggccgccctgattgtgctggccgtgctggaggccatcctgctgctgatgctgatcttcctgcggcagaggatccgcatcgccatcgccctgctgaaggaggccagcaaggctgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgcggggcgtgcagaaccctgtggcccgctgcatcatgtgctgcttcaagtgctgcctgtggtgcctggagaagttcatcaagttcctgaacagaaatgcctacatcatgattgccatctacggcaagaacttctgtgtgtctgccaagaatgccttcatgctgctgatgagaaatattgtgcgggtggtggtgctggacaaggtgacagacctgctgctcttcttcggcaagctgctggtggtgggcggcgtgggcgtgctgtccttcttcttcttcagcggccgcatccctggcctgggcaaggacttcaagagcccccacctgaactactactggctgcccatcatgaccagcatcctgggcgcctacgtgattgccagcggcttcttctctgtgtttggcatgtgtgtggacaccctcttcctgtgcttcctggaggacctggagaggaacaacggcagcctggaccggccctactacatgagcaagagcctgctgaagatcctgggcaagaagaatgaggcccccccagacaacaagaagaggaagaagtag

SEQ ID NO: 170881 - DNA, 2133 bp, Artificial Sequence; identical to SEQ ID NO: 152256
  Description of Artificial Sequence: Synthetic coding sequence

SEQ ID NO: 170882 - DNA, 1236 bp, Artificial Sequence
  Description of Artificial Sequence: Synthetic coding sequence
tgaagagatgaagatgatgaggcctacggcaagcctgtgaagtatgaccccagcttccggggccccatcaagaacagaagctgcacagatgtgatctgctgcgtgctcttcctgctcttcatcctgggctacatcgtggtgggcatcgtggcctggctgtatggagacccccggcaggtgctgtaccccaggaacagcactggagcctactgcggcatgggagagaacaaggacaagccctacctgctgtacttcaacatcttcagctgcatcctgagcagcaacatcatctctgtggctgaaaatggcctgcagtgccccaccccccaggtgtgtgtgagcagctgcccagaggacccctggacagtgggcaagaatgagttcagccagacagtgggggaggtgttctacaccaagaacagaaacttctgcctgcccggggtgccctggaacatgaccgtcatcaccagcctgcagcaggagctgtgccccagcttcctgctgcccagcgccccagccctgggccgctgcttcccctggaccaacgtgaccccaccagccctgcccggcatcaccaatgacaccaccatccagcagggcatcagcggcctgattgacagcctgaatgcccgggacatctctgtgaagatctttgaagattttgcccagagctggtactggatcctggtggccgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgaggtag

SEQ ID NO: 170883 - DNA, 1236 bp, Artificial Sequence
  Description of Artificial Sequence: Synthetic coding sequence
tgaagagatgaagatgatgaggcctacggcaagcctgtgaagtatgaccccagcttccggggccccatcaagaacagaagctgcacagatgtgatctgctgcgtgctcttcctgctcttcatcctgggctacatcgtggtgggcatcgtggcctggctgtatggagacccccggcaggtgctgtaccccaggaacagcactggagcctactgcggcatgggagagaacaaggacaagccctacctgctgtacttcaacatcttcagctgcatcctgagcagcaacatcatctctgtggctgaaaatggcctgcagtgccccaccccccaggtgtgtgtgagcagctgcccagaggacccctggacagtgggcaagaatgagttcagccagacagtgggggaggtgttctacaccaagaacagaaacttctgcctgcccggggtgccctggaacatgaccgtcatcaccagcctgcagcaggagctgtgccccagcttcctgctgcccagcgccccagccctgggccgctgcttcccctggaccaacatcaccccaccagccctgcccggcatcaccaatgacaccaccatccagcagggcatcagcggcctgattgacagcctgaatgcccgggacatctctgtgaagatctttgaagattttgcccagagctggtactggatcctggtggccgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgaggtag

SEQ ID NO: 170884 - DNA, 2133 bp, Artificial Sequence
  Description of Artificial Sequence: Synthetic coding sequence
atgggcggcaagcagagagatgaagatgatgaggcctacggcaagcctgtgaagtatgaccccagcttccggggccccatcaagaacagaagctgcacagatgtgatctgctgcgtgctcttcctgctcttcatcctgggctacatcgtggtgggcatcgtggcctggctgtatggagacccccggcaggtgctgtaccccaggaacagcactggagcctactgcggcatgggagagaacaaggacaagccctacctgctgtacttcaacatcttcagctgcatcctgagcagcaacatcatctctgtggctgaaaatggcctgcagtgccccaccccccaggtgtgtgtgagcagctgcccagaggacccctggacagtgggcaagaatgagttcagccagacagtgggggaggtgttctacaccaagaacagaaacttctgcctgcccggggtgccctggaacatgaccgtcatcaccagcctgcagcaggagctgtgccccagcttcctgctgcccagcgccccagccctgggccgctgcttcccctggaccaacatcaccccaccagccctgcccggcatcaccaatgacaccaccatccagcagggcatcagcggcctgattgacagcctgaatgcccgggacatctctgtgaagatctttgaagattttgcccagagctggtactggatcctggtggccctgggcgtggccctggtgctgagcctgctcttcatcctgctgctgcggctggtggccggccccctggtgctggtgctgatcctgggcgtgctgggcgtgctggcctacggcatctactactgctgggaggagtacagagtgctgcgggacaagggggccagcatcagccagctgggcttcaccaccaacctgagcgcctaccagagcgtgcaggagacctggctggccgccctgattgtgctggccgtgctggaggccatcctgctgctggtgctgatcttcctgcggcagaggatccgcatcgccatcgccctgctgaaggaggccagcaaggctgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgcggggcgtgcagaaccctgtggcccgctgcatcatgtgctgcttcaagtgctgcctgtggtgcctggagaagttcatcaagttcctgaacagaaatgcctacatcatgattgccatctacggcaagaacttctgtgtgtctgccaagaatgccttcatgctgctgatgagaaatattgtgcgggtggtggtgctggacaaggtgacagacctgctgctcttcttcggcaagctgctggtggtgggcggcgtgggcgtgctgtccttcttcttcttcagcggccgcatccctggcctgggcaaggacttcaagagcccccacctgaactactactggctgcccatcatgaccagcatcctgggcgcctacgtgattgccagcggcttcttctctgtgtttggcatgtgtgtggacaccctcttcctgtgcttcctggaggacctggagaggaacaacggcagcctggaccggccctactacatgagcaagagcctgctgaagatcctgggcaagaagaatgaggcccccccagacaacaagaagaggaagaagtag

SEQ ID NO: 170885 - DNA, 2133 bp, Artificial Sequence; identical to SEQ ID NO: 170884
  Description of Artificial Sequence: Synthetic coding sequence

SEQ ID NO: 170886 - DNA, 2133 bp, Artificial Sequence; identical to SEQ ID NO: 152256
  Description of Artificial Sequence: Synthetic coding sequence

SEQ ID NO: 170887 - DNA, 1236 bp, Artificial Sequence; identical to SEQ ID NO: 170882
  Description of Artificial Sequence: Synthetic coding sequence

SEQ ID NO: 170888 - DNA, 1236 bp, Artificial Sequence; identical to SEQ ID NO: 170882
  Description of Artificial Sequence: Synthetic coding sequence

SEQ ID NO: 170889 - DNA, 1236 bp, Artificial Sequence; identical to SEQ ID NO: 170883
  Description of Artificial Sequence: Synthetic coding sequence

SEQ ID NO: 170890 - DNA, 2133 bp, Artificial Sequence; identical to SEQ ID NO: 170884
  Description of Artificial Sequence: Synthetic coding sequence

SEQ ID NO: 170891 - DNA, 1236 bp, Artificial Sequence; identical to SEQ ID NO: 170883
  Description of Artificial Sequence: Synthetic coding sequence

SEQ ID NO: 170892 - DNA, 2133 bp, Artificial Sequence; identical to SEQ ID NO: 152256
  Description of Artificial Sequence: Synthetic coding sequence

SEQ ID NO: 170893 - DNA, 1236 bp, Artificial Sequence; identical to SEQ ID NO: 170882
  Description of Artificial Sequence: Synthetic coding sequence

SEQ ID NO: 170894 - DNA, 1905 bp, Artificial Sequence
  Description of Artificial Sequence: Synthetic coding sequence
atgggagagaacaaggacaagccctacctgctgtacttcaacatcttcagctgcatcctgagcagcaacatcatctctgtggctgaaaatggcctgcagtgccccaccccccaggtgtgtgtgagcagctgcccagaggacccctggacagtgggcaagaatgagttcagccagacagtgggggaggtgttctacaccaagaacagaaacttctgcctgcccggggtgccctggaacatgaccgtcatcaccagcctgcagcaggagctgtgccccagcttcctgctgcccagcgccccagccctgggccgctgcttcccctggaccaacgtgaccccaccagccctgcccggcatcaccaatgacaccaccatccagcagggcatcagcggcctgattgacagcctgaatgcccgggacatctctgtgaagatctttgaagattttgcccagagctggtactggatcctggtggccctgggcgtggccctggtgctgagcctgctcttcatcctgctgctgcggctggtggccggccccctggtgctggtgctgatcctgggcgtgctgggcgtgctggcctacggcatctactactgctgggaggagtacagagtgctgcgggacaagggggccagcatcagccagctgggcttcaccaccaacctgagcgcctaccagagcgtgcaggagacctggctggccgccctgattgtgctggccgtgctggaggccatcctgctgctgatgctgatcttcctgcggcagaggatccgcatcgccatcgccctgctgaaggaggccagcaaggctgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgcggggcgtgcagaaccctgtggcccgctgcatcatgtgctgcttcaagtgctgcctgtggtgcctggagaagttcatcaagttcctgaacagaaatgcctacatcatgattgccatctacggcaagaacttctgtgtgtctgccaagaatgccttcatgctgctgatgagaaatattgtgcgggtggtggtgctggacaaggtgacagacctgctgctcttcttcggcaagctgctggtggtgggcggcgtgggcgtgctgtccttcttcttcttcagcggccgcatccctggcctgggcaaggacttcaagagcccccacctgaactactactggctgcccatcatgaccagcatcctgggcgcctacgtgattgccagcggcttcttctctgtgtttggcatgtgtgtggacaccctcttcctgtgcttcctggaggacctggagaggaacaacggcagcctggaccggccctactacatgagcaagagcctgctgaagatcctgggcaagaagaatgaggcccccccagacaacaagaagaggaagaagtag

SEQ ID NO: 170895 - DNA, 1905 bp, Artificial Sequence; identical to SEQ ID NO: 170894
  Description of Artificial Sequence: Synthetic coding sequence

SEQ ID NO: 170896 - DNA, 1905 bp, Artificial Sequence
  Description of Artificial Sequence: Synthetic coding sequence
atgggagagaacaaggacaagccctacctgctgtacttcaacatcttcagctgcatcctgagcagcaacatcatctctgtggctgaaaatggcctgcagtgccccaccccccaggtgtgtgtgagcagctgcccagaggacccctggacagtgggcaagaatgagttcagccagacagtgggggaggtgttctacaccaagaacagaaacttctgcctgcccggggtgccctggaacatgaccgtcatcaccagcctgcagcaggagctgtgccccagcttcctgctgcccagcgccccagccctgggccgctgcttcccctggaccaacatcaccccaccagccctgcccggcatcaccaatgacaccaccatccagcagggcatcagcggcctgattgacagcctgaatgcccgggacatctctgtgaagatctttgaagattttgcccagagctggtactggatcctggtggccctgggcgtggccctggtgctgagcctgctcttcatcctgctgctgcggctggtggccggccccctggtgctggtgctgatcctgggcgtgctgggcgtgctggcctacggcatctactactgctgggaggagtacagagtgctgcgggacaagggggccagcatcagccagctgggcttcaccaccaacctgagcgcctaccagagcgtgcaggagacctggctggccgccctgattgtgctggccgtgctggaggccatcctgctgctggtgctgatcttcctgcggcagaggatccgcatcgccatcgccctgctgaaggaggccagcaaggctgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgcggggcgtgcagaaccctgtggcccgctgcatcatgtgctgcttcaagtgctgcctgtggtgcctggagaagttcatcaagttcctgaacagaaatgcctacatcatgattgccatctacggcaagaacttctgtgtgtctgccaagaatgccttcatgctgctgatgagaaatattgtgcgggtggtggtgctggacaaggtgacagacctgctgctcttcttcggcaagctgctggtggtgggcggcgtgggcgtgctgtccttcttcttcttcagcggccgcatccctggcctgggcaaggacttcaagagcccccacctgaactactactggctgcccatcatgaccagcatcctgggcgcctacgtgattgccagcggcttcttctctgtgtttggcatgtgtgtggacaccctcttcctgtgcttcctggaggacctggagaggaacaacggcagcctggaccggccctactacatgagcaagagcctgctgaagatcctgggcaagaagaatgaggcccccccagacaacaagaagaggaagaagtag

SEQ ID NO: 170897 - DNA, 2007 bp, Artificial Sequence
  Description of Artificial Sequence: Synthetic coding sequence
atgggcggcaagcagagagatgaagatgatgaggcctacggcaagcctgtgaagtatgaccccagcttccggggccccatcaagaacagaagctgcacagatgtgatctgctgcgtgctcttcctgctcttcatcctgggctacatcgtggtgggcatcgtggcctggctgtatggagacccccggcaggtgctgtaccccaggaacagcactggagcctactgcggcatgggagagaacaaggacaagccctacctgctgtacttcaacatcttcagctgcatcctgagcagcaacatcatctctgtggctgaaaatggcctgcagtgccccaccccccagaccgtcatcaccagcctgcagcaggagctgtgccccagcttcctgctgcccagcgccccagccctgggccgctgcttcccctggaccaacatcaccccaccagccctgcccggcatcaccaatgacaccaccatccagcagggcatcagcggcctgattgacagcctgaatgcccgggacatctctgtgaagatctttgaagattttgcccagagctggtactggatcctggtggccctgggcgtggccctggtgctgagcctgctcttcatcctgctgctgcggctggtggccggccccctggtgctggtgctgatcctgggcgtgctgggcgtgctggcctacggcatctactactgctgggaggagtacagagtgctgcgggacaagggggccagcatcagccagctgggcttcaccaccaacctgagcgcctaccagagcgtgcaggagacctggctggccgccctgattgtgctggccgtgctggaggccatcctgctgctggtgctgatcttcctgcggcagaggatccgcatcgccatcgccctgctgaaggaggccagcaaggctgtgggccagatgatgagcaccatgttctaccccctggtgacctttgtgctgctgctgatctgcatcgcctactgggccatgacagccctgtacctggccaccagcggccagccccagtatgtgctgtgggccagcaacatcagcagccctggctgtgagaaggtgcccatcaacaccagctgcaaccccacagcccacctggtgaacagcagctgccccggcctgatgtgtgtgttccagggctacagcagcaagggcctcatccagaggagcgtcttcaacctgcagatctatggagtgctgggcctcttctggaccctgaactgggtgctggccctgggccagtgtgtgctggccggggcctttgccagcttctactgggccttccacaagccccaggacatccccaccttccccctcatcagcgccttcatccgcaccctgcgctaccacacaggcagcctggccttcggggccctgatcctgaccctggtgcagatcgcccgggtcatcctggagtacatcgaccacaagctgcggggcgtgcagaaccctgtggcccgctgcatcatgtgctgcttcaagtgctgcctgtggtgcctggagaagttcatcaagttcctgaacagaaatgcctacatcatgattgccatctacggcaagaacttctgtgtgtctgccaagaatgccttcatgctgctgatgagaaatattgtgcgggtggtggtgctggacaaggtgacagacctgctgctcttcttcggcaagctgctggtggtgggcggcgtgggcgtgctgtccttcttcttcttcagcggccgcatccctggcctgggcaaggacttcaagagcccccacctgaactactactggctgcccatcatgaccagcatcctgggcgcctacgtgattgccagcggcttcttctctgtgtttggcatgtgtgtggacaccctcttcctgtgcttcctggaggacctggagaggaacaacggcagcctggaccggccctactacatgagcaagagcctgctgaagatcctgggcaagaagaatgaggcccccccagacaacaagaagaggaagaagtag

SEQ ID NO: 170898 - DNA, 1905 bp, Artificial Sequence; identical to SEQ ID NO: 170894
  Description of Artificial Sequence: Synthetic coding sequence

SEQ ID NO: 170899 - DNA, 1905 bp, Artificial Sequence; identical to SEQ ID NO: 170894
  Description of Artificial Sequence: Synthetic coding sequence

SEQ ID NO: 170900 - DNA, 2007 bp, Artificial Sequence; identical to SEQ ID NO: 170880
  Description of Artificial Sequence: Synthetic coding sequence

SEQ ID NO: 170901 - DNA, 2007 bp, Artificial Sequence; identical to SEQ ID NO: 170880
  Description of Artificial Sequence: Synthetic coding sequence

SEQ ID NO: 170902 - DNA, 2007 bp, Artificial Sequence; identical to SEQ ID NO: 170897
  Description of Artificial Sequence: Synthetic coding sequence

SEQ ID NO: 170903 - DNA, 1905 bp, Artificial Sequence; identical to SEQ ID NO: 170896
  Description of Artificial Sequence: Synthetic coding sequence

SEQ ID NO: 170904 - DNA, 2007 bp, Artificial Sequence; identical to SEQ ID NO: 170880
  Description of Artificial Sequence: Synthetic coding sequence

SEQ ID NO: 170905 - DNA, 2007 bp, Artificial Sequence; identical to SEQ ID NO: 170897
  Description of Artificial Sequence: Synthetic coding sequence

SEQ ID NO: 170906 - DNA, 1905 bp, Artificial Sequence; identical to SEQ ID NO: 170896
  Description of Artificial Sequence: Synthetic coding sequence

SEQ ID NO: 170907 - DNA, 2247 bp, Artificial Sequence
  Description of Artificial Sequence: Synthetic coding sequence
atgatcccagctgccagcagcaccccacctggagatgccctcttccccagcgtggccccccaggacttctggaggagccaggtgacaggctacagcggctctgtgaccaggcacctgagccaccgggccaacaacttcaagaggcaccccaagaggaggaagtgcatccggcccagccccccacctccacccaacaccccctgccccctggagctggtggactttggagacctgcacccccagaggagcttccgggagctgctcttcaacggctgcatcctgtttggaattgagttctcctatgccatggagacagcctacgtgacccctgtgctgctgcagatgggcctgcctgaccagctgtacagcctggtgtggttcatcagccccatcctgggcttcctgctgcagcccctgctgggcgcctggagcgaccgctgcaccagcagatttggaagaagaagacccttcatcctggtgctggccatcggggccctgctgggcctgagcctgctgctgaatggccgggacatcggcatcgccctggctgatgtgacaggcaaccacaagtggggcctgctgctgactgtgtgtggggtggtgctgatggacttctctgctgacagcgctgacaaccccagccacgcctacatgatggatgtgtgcagccctgctgaccaggaccggggcctgaacatccacgccctgctggccggcctgggcggcggcttcggctacgtggtgggcggcatccactgggacaagacaggcttcggccgggccctgggcggccagctgcgggtcatctacctgttcaccgctgtgaccctgtctgtgaccaccgtgctgaccctggtgtccatccctgagcggcccctgcggcccccatctgagaagagagctgccatgaagagccccagcctgcccctgccccccagcccccctgtgctgcctgaggagggccctggggacagcctgcccagccacacagccaccaacttcagcagccccatcagcccccccagccccctgacccccaagtatggcagcttcatcagccgggacagcagcctgaccggcatcagcgagtttgccagcagctttggaacagccaacattgattctgtgctgattgactgcttcaccggcggccatgacagctacctggccatccctggctctgtgccccggccccccatctctgtgtccttcccccgggccccagatggcttctaccggcaggaccggggcctgctggagggccgggagggcgccctgaccagcggctgtgatggagacatcctgcgggtgggcagcctggacaccagcaagcccaggagcagcggcatcctgaagaggccccagaccctggccatcccagatgctgctgggggcggcggccctgagaccagcagaagaagaaatgtgaccttcagccagcaggtggccaacatcctgctgaatggagtgaagtatgagagcgagctgaccggcagcagcgagagagctgagcagcccctgtctgtgggccgcctgtgcagcaccatctgcaacatgcccaaggccctgcggaccctgtgtgtgaaccacttcctgggctggctgagctttgagggcatgctgctcttctacacagacttcatgggagaggtggtgttccagggcgaccccaaggccccccacaccagcgaggcctaccagaagtacaacagcggcgtgaccatgggctgctggggcatgtgcatctatgccttctctgctgccttctacagcgccatcctggagaagctggaggagttcctgtctgtgaggaccctgtacttcatcgcctacctggccttcggcctgggcaccggcctggccaccctgagcaggaacctgtatgtggtgctgagcctgtgcatcacctacggcatcctcttcagcaccctgtgcaccctgccctacagcctgctgtgtgactactaccagagcaagaagtttgctggcagcagcgcagatggcacccggcggggcatgggcgtggacatcagcctgctgagctgccagtacttcctggcccagatcctggtgtccctggtgctgggccccctgaccagcgctgtgggcagcgccaacggggtgatgtacttcagcagcctggtgtccttcctgggctgcctgtacagcagcctcttcgtcatctatgagatccccccatctgatgctgctgatgaggagcaccggcccctgctgctgaatgtgtag

SEQ ID NO: 170908 - DNA, 2349 bp, Artificial Sequence
  Description of Artificial Sequence: Synthetic coding sequence
atgctgcagcagcccggccccaggcctggccggcagcagcccagcggggacagagatgcctgccgcctgcacccccagggccggcccccagccctgcccaccatgatcccagctgccagcagcaccccacctggagatgccctcttccccagcgtggccccccaggacttctggaggagccaggtgacaggctacagcggctctgtgaccaggcacctgagccaccgggccaacaacttcaagaggcaccccaagaggaggaagtgcatccggcccagccccccacctccacccaacaccccctgccccctggagctggtggactttggagacctgcacccccagaggagcttccgggagctgctcttcaacggctgcatcctgtttggaattgagttctcctatgccatggagacagcctacgtgacccctgtgctgctgcagatgggcctgcctgaccagctgtacagcctggtgtggttcatcagccccatcctgggcttcctgctgcagcccctgctgggcgcctggagcgaccgctgcaccagcagatttggaagaagaagacccttcatcctggtgctggccatcggggccctgctgggcctgagcctgctgctgaatggccgggacatcggcatcgccctggctgatgtgacaggcaaccacaagtggggcctgctgctgactgtgtgtggggtggtgctgatggacttctctgctgacagcgctgacaaccccagccacgcctacatgatggatgtgtgcagccctgctgaccaggaccggggcctgaacatccacgccctgctggccggcctgggcggcggcttcggctacgtggtgggcggcatccactgggacaagacaggcttcggccgggccctgggcggccagctgcgggtcatctacctgttcaccgctgtgaccctgtctgtgaccaccgtgctgaccctggtgtccatccctgagcggcccctgcggcccccatctgagaagagagctgccatgaagagccccagcctgcccctgccccccagcccccctgtgctgcctgaggagggccctggggacagcctgcccagccacacagccaccaacttcagcagccccatcagcccccccagccccctgacccccaagtatggcagcttcatcagccgggacagcagcctgaccggcatcagcgagtttgccagcagctttggaacagccaacattgattctgtgctgattgactgcttcaccggcggccatgacagctacctggccatccctggctctgtgccccggccccccatctctgtgtccttcccccgggccccagatggcttctaccggcaggaccggggcctgctggagggccgggagggcgccctgaccagcggctgtgatggagacatcctgcgggtgggcagcctggacaccagcaagcccaggagcagcggcatcctgaagaggccccagaccctggccatcccagatgctgctgggggcggcggccctgagaccagcagaagaagaaatgtgaccttcagccagcaggtggccaacatcctgctgaatggagtgaagtatgagagcgagctgaccggcagcagcgagagagctgagcagcccctgtctgtgggccgcctgtgcagcaccatctgcaacatgcccaaggccctgcggaccctgtgtgtgaaccacttcctgggctggctgagctttgagggcatgctgctcttctacacagacttcatgggagaggtggtgttccagggcgaccccaaggccccccacaccagcgaggcctaccagaagtacaacagcggcgtgaccatgggctgctggggcatgtgcatctatgccttctctgctgccttctacagcgccatcctggagaagctggaggagttcctgtctgtgaggaccctgtacttcatcgcctacctggccttcggcctgggcaccggcctggccaccctgagcaggaacctgtatgtggtgctgagcctgtgcatcacctacggcatcctcttcagcaccctgtgcaccctgccctacagcctgctgtgtgactactaccagagcaagaagtttgctggcagcagcgcagatggcacccggcggggcatgggcgtggacatcagcctgctgagctgccagtacttcctggcccagatcctggtgtccctggtgctgggccccctgaccagcgctgtgggcagcgccaacggggtgatgtacttcagcagcctggtgtccttcctgggctgcctgtacagcagcctcttcgtcatctatgagatccccccatctgatgctgctgatgaggagcaccggcccctgctgctgaatgtgtag

SEQ ID NO: 170909 - DNA, 2247 bp, Artificial Sequence; identical to SEQ ID NO: 170907
  Description of Artificial Sequence: Synthetic coding sequence

SEQ ID NO: 170910 - DNA, 1593 bp, Artificial Sequence
  Description of Artificial Sequence: Synthetic coding sequence
atgggcagcaacagcggccaggccggccgccacatctacaagagcctggctgatgatggcccctttgacagcgtggagccccccaagaggcccaccagccgcctcatcatgcacagcatggccatgtttggccgggagttctgctatgctgtggaggccgcctacgtgacccctgtgctgctgtctgtgggcctgcccagcagcctgtacagcatcgtgtggttcctgagccccatcctgggcttcctgctgcagcctgtggtgggcagcgccagtgaccactgccgcagccgctggggcagaagaagaccctacatcctgaccctgggcgtgatgatgctggtgggcatggccctgtacctgaatggagccaccgtggtggccgccctgattgccaaccccaggaggaagctggtgtgggccatctctgtgaccatgattggagtggtgctgtttgattttgctgctgacttcattgatggccccatcaaggcctacctgtttgatgtgtgcagccaccaggacaaggagaagggcctgcactaccacgccctcttcaccggctttggaggagccctgggctacctgctgggcgccatcgactgggcccacctggagctgggccgcctgctgggcacagagttccaggtgatgttcttcttcagcgccctggtgctgaccctgtgcttcaccgtgcacctgtgcagcatcagcgaggcccccctgacagaggtggccaagggcatccccccccagcagaccccccaggacccccccctgagcagtgatggcatgtatgaatatggcagcattgagaaggtgaagaatggctacgtgaaccctgagctggccatgcagggcgccaagaacaagaaccacgccgagcagacccggcgggccatgaccctgaagagcctgctgcgggccctggtgaacatgccaccccactaccgctacctgtgcatcagccacctgattggctggacagccttcctgagcaacatgctgttcttcacagacttcatgggccagatcgtgtacagaggagacccctacagcgcccacaacagcacagagttcctgatctatgagcggggcgtggaggtgggctgctggggcctgtgcatcaacagcgtcttcagcagcctgtacagctacttccagaaggtgctggtgtcctacatcggcctgaagggcctgtacttcaccggctacctgctgtttggcctgggcaccggcttcatcggcctcttccccaacgtgtacagcaccctggtgctgtgcagcctgtttggagtgatgagcagcaccctgtacacagtgcccttcaacctgatcacagagtaccaccgggaggaggagaaggagcggcagcaggcccctggaggagaccctgacaacagcgtgcggggcaagggcatggactgtgccaccctgacctgcatggtgcagctggcccagatcctggtgggcggcggcctgggcttcctggtgaacacagctggcaccgtggtggtggtggtgatcacagccagcgctgtggccctgattggctgctgctttgtggccctgtttgtgcgctacgtggactag

SEQ ID NO: 170911 - DNA, 1416 bp, Artificial Sequence
  Description of Artificial Sequence: Synthetic coding sequence
atgggcagcaacagcggccaggccggccgccacatctacaagagcctggctgatgatggcccctttgacagcgtggagccccccaagaggcccaccagccgcctcatcatgcacagcatggccatgtttggccgggagttctgctatgctgtggaggccgcctacgtgacccctgtgctgctgtctgtgggcctgcccagcagcctgtacagcatcgtgtggttcctgagccccatcctgggcttcctgctgcagcctgtggtgggcagcgccagtgaccactgccgcagccgctggggcagaagaagaccctacatcctgaccctgggcgtgatgatgctggtgggcatggccctgtacctgaatggagccaccgtggtggccggctttggaggagccctgggctacctgctgggcgccatcgactgggcccacctggagctgggccgcctgctgggcacagagttccaggtgatgttcttcttcagcgccctggtgctgaccctgtgcttcaccgtgcacctgtgcagcatcagcgaggcccccctgacagaggtggccaagggcatccccccccagcagaccccccaggacccccccctgagcagtgatggcatgtatgaatatggcagcattgagaaggtgaagaatggctacgtgaaccctgagctggccatgcagggcgccaagaacaagaaccacgccgagcagacccggcgggccatgaccctgaagagcctgctgcgggccctggtgaacatgccaccccactaccgctacctgtgcatcagccacctgattggctggacagccttcctgagcaacatgctgttcttcacagacttcatgggccagatcgtgtacagaggagacccctacagcgcccacaacagcacagagttcctgatctatgaaagaggagtggaggtgggctgctggggcctgtgcatcaacagcgtcttcagcagcctgtacagctacttccagaaggtgctggtgtcctacatcggcctgaagggcctgtacttcaccggctacctgctgtttggcctgggcaccggcttcatcggcctcttccccaacgtgtacagcaccctggtgctgtgcagcctgtttggagtgatgagcagcaccctgtacacagtgcccttcaacctgatcacagagtaccaccgggaggaggagaaggagcggcagcaggcccctggaggagaccctgacaacagcgtgcggggcaagggcatggactgtgccaccctgacctgcatggtgcagctggcccagatcctggtgggcggcggcctgggcttcctggtgaacacagctggcaccgtggtggtggtggtgatcacagccagcgctgtggccctgattggctgctgctttgtggccctgtttgtgcgctacgtggactag

SEQ ID NO: 170912 - DNA, 897 bp, Artificial Sequence
  Description of Artificial Sequence: Synthetic coding sequence
atgggcagcaacagcggccaggccggccgccacatctacaagagcctggctgatgatggcccctttgacagcgtggagccccccaagaggcccaccagccgcctcatcatgcacagcatggccatgtttggccgggagttctgctatgctgtggaggccgcctacgtgacccctgtgctgctgtctgtgggcctgcccagcagcctgtacagcatcgtgtggttcctgagccccatcctgggcttcctgctgcagcctgtggtgggcagcgccagtgaccactgccgcagccgctggggcagaagaagaccctacatcctgaccctgggcgtgatgatgctggtgggcatggccctgtacctgaatggagccaccgtggtggccgccctgattgccaaccccaggaggaagctggtgtgggccatctctgtgaccatgattggagtggtgctgtttgattttgctgctgacttcattgatggccccatcaaggcctacctgtttgatgtgtgcagccaccaggacaaggagaagggcctgcactaccacgccctcttcaccggcacccggcgggccatgaccctgaagagcctgctgcgggccctggtgaacatgccaccccactaccgctacctgtgcatcagccacctgattggctggacagccttcctgagcaacatgctgttcttcacagacttcatgggccagatcgtgtacagaggagacccctacagcgcccacaacagcacagagttcctgatctatgagcggggcgtggaggtgggctgctggggcctgtgcatcaacagcgtcttcagcagcctgtacagctgcaagagcttcagcctgctgaggatgagcagcaagagcttctggagcagcaccacctggatctag

SEQ ID NO: 170913 - DNA, 1383 bp, Artificial Sequence
  Description of Artificial Sequence: Synthetic coding sequence
atgggcagcaacagcggccaggccggccgccacatctacaagagcctggctgatgatggcccctttgacagcgtggagccccccaagaggcccaccagccgcctcatcatgcacagcatggccatgtttggccgggagttctgctatgctgtggaggccgcctacgtgacccctgtgctgctgtctgtgggcctgcccagcagcctgtacagcatcgtgtggttcctgagccccatcctgggcttcctgctgcagcctgtggtgggcagcgccagtgaccactgccgcagccgctggggcagaagaagaccctacatcctgaccctgggcgtgatgatgctggtgggcatggccctgtacctgaatggagccaccgtggtggccgccctgattgccaaccccaggaggaagctggtgtgggccatctctgtgaccatgattggagtggtgctgtttgattttgctgctgacttcattgatggccccatcaaggcctacctgtttgatgtgtgcagccaccaggacaaggagaagggcctgcactaccacgccctcttcaccggctttggaggagccctgggctacctgctgggcgccatcgactgggcccacctggagctgggccgcctgctgggcacagagttccaggtgatgttcttcttcagcgccctggtgctgaccctgtgcttcaccgtgcacctgtgcagcatcagcgaggcccccctgacagaggtggccaagggcatccccccccagcagaccccccaggacccccccctgagcagtgatggcatgtatgaatatggcagcattgagaaggtgaagaatggctacgtgaaccctgagctggccatgcagggcgccaagaacaagaaccacgccgagcagacccggcgggccatgaccctgaagagcctgctgcgggccctggtgaacatgccaccccactaccgctacctgtgcatcagccacctgattggctggacagccttcctgagcaacatgctgttcttcacagacttcatgggccagatcgtgtacagaggagacccctacagcgcccacaacagcacagagttcctgatctatgagcggggcgtggaggtgggctgctggggcctgtgcatcaacagcgtcttcagcagcctgtacagctacttccagaaggtgctggtgtcctacatcggcctgaagggcctgtacttcaccggctacctgctgtttggcctgggcaccggcttcatcggcctcttccccaacgtgtacagcaccctggtgctgtgcagcctgtttggagtgatgagcagcaccctgtacacagtgcccttcaacctgatcacagagtaccaccgggaggaggagaaggaggtgtgctgccactag

SEQ ID NO: 170914 - DNA, 732 bp, Artificial Sequence
  Description of Artificial Sequence: Synthetic coding sequence
atgggcagcaacagcggccaggccggccgccacatctacaagagcctggctgatgatggcccctttgacagcgtggagccccccaagaggcccaccagccgcctcatcatgcacagcatggccatgtttggccgggagttctgctatgctgtggaggccgcctacgtgacccctgtgctgctgtctgtgggcctgcccagcagcctgtacagcatcgtgtggttcctgagccccatcctgggcttcctgctgcagcctgtggtgggcagcgccagtgaccactgccgcagccgctggggcagaagaagaccctacatcctgaccctgggcgtgatgatgctggtgggcatggccctgtacctgaatggagccaccgtggtggccgccctgattgccaaccccaggaggaagctggtgtgggccatctctgtgaccatgattggagtggtgctgtttgattttgctgctgacttcattgatggccccatcaaggcctacctgtttgatgtgtgcagccaccaggacaaggagaagggcctgcactaccacgccctcttcacagacagccagggcaatgacatcaaggtgacagctgagagcactggagagcacgccagcagcctgcccctgcccctgcaccagcccccccactggatggacagcctgcctgtgcagcacgctgtgctgcaccgcttccacggccctgactgtgtgccccggggcagcctgtag

SEQ ID NO: 170915 - DNA, 741 bp, Artificial Sequence
  Description of Artificial Sequence: Synthetic coding sequence
atggccctgtacctgaatggagccaccgtggtggccggctttggaggagccctgggctacctgctgggcgccatcgactgggcccacctggagctgggccgcctgctgggcacagagttccaggtgatgttcttcttcagcgccctggtgctgaccctgtgcttcaccgtgcacctgtgcagcatcagcgaggcccccctgacagaggtggccaagggcatccccccccagcagaccccccaggacccccccctgagcagtgatggcatgtatgaatatggcagcattgagaaggtgaagaatggctacgtgaaccctgagctggccatgcagggcgccaagaacaagaaccacgccgagcagacccggcgggccatgaccctgaagagcctgctgcgggccctggtgaacatgccaccccactaccgctacctgtgcatcagccacctgattggctggacagccttcctgagcaacatgctgttcttcacagacttcatgggccagatcgtgtacagaggagacccctacagcgcccacaacagcacagagttcctgatctatgaaagaggagtggaggtgggctgctggggcctgtgcatcaacagcgtcttcagcagcctgtacagctacttccagaaggtgctggtgtcctacatcggcctgaagggcctgtacttcaccggctacctgctgtttggcctgggcaccggcttcatcggcctcttccccaacgtgtag

SEQ ID NO: 170916 - DNA, 1662 bp, Artificial Sequence
  Description of Artificial Sequence: Synthetic coding sequence
atggtgcagaggctgtgggtgtcccggctgctgcggcacaggaaggcccagctgctgctggtgaacctgctgaccttcggcctggaggtgtgcctggccgccggcatcacctacgtgccccccctgctgctggaggtgggcgtggaggagaagttcatgaccatggtgctgggcatcggccctgtgctgggcctggtgtgtgtgcccctgctgggcagcgccagtgaccactggaggggccgctatggaagaagaagacccttcatctgggccctgagcctgggcatcctgctgagcctcttcctgatcccccgggccggctggctggccggcctgctgtgcccagacccccggcccctggagctggccctgctgatcctgggcgtgggcctgctggacttctgtggccaggtgtgcttcacccccctggaggccctgctgagtgacctcttccgggaccctgaccactgccggcaggcctacagcgtgtatgccttcatgatcagcctgggcggctgcctgggctacctgctgcctgccatcgactgggacaccagcgccctggccccctacctgggcacccaggaggagtgcctgtttggcctgctgaccctcatcttcctgacctgtgtggccgccaccctgctggtggccgaggaggccgccctgggccccacagagcctgctgagggcctgagcgcccccagcctgagcccccactgctgcccctgccgggcccggctggccttcaggaacctgggcgccctgctgccccggctgcaccagctgtgctgcaggatgcccaggaccctgcggcggctgtttgtggccgagctgtgctcctggatggccctgatgaccttcaccctcttctacacagactttgtgggggagggcctgtaccagggcgtgcccagggctgagcctggaacagaggcccggcggcactatgatgagggcgtgaggatgggcagcctgggcctcttcctgcagtgtgccatcagcctggtgttcagcctggtgatggaccggctggtgcagagatttggcaccagggctgtgtacctggcctctgtggccgccttccctgtggccgccggggccacctgcctgagccacagcgtggccgtggtgacagccagcgctgccctgaccggcttcaccttcagcgccctgcagatcctgccctacaccctggccagcctgtaccaccgggagaagcaggtgttcctgcccaagtacagaggagacaccggcggggccagcagcgaggacagcctgatgaccagcttcctgcccggccccaagccaggggcccccttccccaatggacatgtgggcgctgggggcagcggcctgctgcccccacctccagccctgtgtggggccagcgcctgtgatgtgtctgtgcgggtggtggtgggggagcccacagaggcccgggtggtgcccggccggggcatctgcctggacctggccatcctggacagcgccttcctgctgagccaggtggcccccagcctcttcatgggcagcatcgtgcagctgagccagagcgtgacagcctacatggtgtctgctgctggcctgggcctggtggccatctactttgccacccaggtggtgtttgacaagagtgacctggccaagtacagcgcctag

SEQ ID NO: 170917 - DNA, 1293 bp, Artificial Sequence
  Description of Artificial Sequence: Synthetic coding sequence
atggagggcagcgccagccccccagagaagccccgggcccggcctgctgctgctgtgctgtgccggggccctgtggagcccctggtgttcctggccaactttgccctggtgctgcagggccccctgaccacccagtacctgtggcaccgcttctctgctgacctgggctacaacggcacccggcagaggggcggctgcagcaacagatctgctgaccccaccatgcaggaggtggagaccctgaccagccactggaccctgtacatgaatgtgggcggcttcctggtgggcctcttcagcagcaccctgctgggcgcctggagcgacagcgtgggcagaagacccctgctggtgctggccagcctgggcctgctgctgcaggccctggtgtctgtgtttgtggtgcagctgcagctgcacgtgggctactttgtgctgggccgcatcctgtgtgccctgctgggggactttggaggcctgctggccgccagctttgcctctgtggctgatgtgagcagcagccgcagcaggaccttcaggatggccctgctggaggccagcattggagtggccggcatgctggccagcctgctgggcggccactggctgcgggcccagggctacgccaaccccttctggctggccctggccctgctgattgccatgaccctgtatgctgccttctgcttcggggagaccctgaaggagcccaagagcaccaggctcttcaccttccgccaccacaggagcatcgtgcagctgtatgtggccccagcccctgagaagagcaggaagcacctggccctgtacagcctggccatctttgtggtgatcaccgtgcactttggagcccaggacatcctgaccctgtatgagctgagcacccccctgtgctgggacagcaagctgattggctacggcagcgctgcccagcacctgccctacctgaccagcctgctggccctgaagctgctgcagtactgcctggctgatgcctgggtggccgagatcggcctggccttcaacatcctgggcatggtggtgtttgcctttgccaccatcacccccctgatgttcaccggggccctcttctctgctgtggcctgtgtgaacagcctggccatgctgacagccagcggcttcaacagcctgtacccagccaccctgaacttcatgaagggcttccccttcctgctgggcgccggcctgctgctgatcccagctgtgctgattggcatgctggagaaggctgacccccacctggagttccagcagttcccccagagcccctag

SEQ ID NO: 170918 - DNA, 1380 bp, Artificial Sequence
  Description of Artificial Sequence: Synthetic coding sequence
atggagggcagcgccagccccccagagaagccccgggcccggcctgctgctgctgtgctgtgccggggccctgtggagcccctggtgttcctggccaactttgccctggtgctgcagggccccctgaccacccagtacctgtggcaccgcttctctgctgacctgggctacaacggcacccggcagaggggcggctgcagcaacagatctgctgaccccaccatgcaggaggtggagaccctgaccagccactggaccctgtacatgaatgtgggcggcttcctggtgggcctcttcagcagcaccctgctgggcgcctggagcgacagcgtgggcagaagacccctgctggtgctggccagcctgggcctgctgctgcaggccctggtgtctgtgtttgtggtgcagctgcagctgcacgtgggctactttgtgctgggccgcatcctgtgtgccctgctgggggactttggaggcctgctggccgccagctttgcctctgtggctgatgtgagcagcagccgcagcaggaccttcaggatggccctgctggaggccagcattggagtggccggcatgctggccagcctgctgggcggccactggctgcgggcccagggctacgccaaccccttctggctggccctggccctgctgattgccatgaccctgtatgctgccttctgcttcggggagaccctgaaggagcccaagagcaccaggctcttcaccttccgccaccacaggagcatcgtgcagctgtatgtggccccagcccctgagaagagcaggaagcacctggccctgtacagcctggccatctttgtggtgatcaccgtgcactttggagcccaggacatcctgaccctgtatgagctgagcacccccctgtgctgggacagcaagctgattggctacggcagcgctgcccagcacctgccctacctgaccagcctgctggccctgaagctgctgcagtactgcctggctgatgcctgggtggccgagatcggcctggccttcaacatcctgggcatggtggtgtttgcctttgccaccatcacccccctgatgttcaccggctacggcctgctcttcctgagcctggtgatcacccctgtgatccgggccaagctgagcaagctggtgcgggagacagagcagggcgccctcttctctgctgtggcctgtgtgaacagcctggccatgctgacagccagcggcatcttcaacagcctgtacccagccaccctgaacttcatgaagggcttccccttcctgctgggcgccggcctgctgctgatcccagctgtgctgattggcatgctggagaaggctgacccccacctggagttccagcagttcccccagagcccctag

SEQ ID NO: 170919 - DNA, 1428 bp, Artificial Sequence
  Description of Artificial Sequence: Synthetic coding sequence
atgagccctgaggtgacctgcccccggcggggccacctgccccgcttccaccccaggacctgggtggagcctgtggtggccagcagccaggtggccgccagcctgtatgatgctggcctgctgctggtggtgaaggccagctatggcaccggcggcagcagcaaccacagcgccagccccagccccaggggggccctggaggaccagcagcagagggccatcagcaacttctacatcatctacaacctggtggtgggcctgagccccctgctgagcgcctacggcctgggctggctgagtgaccgctaccacaggaagatcagcatctgcatgagcctgctgggcttcctgctgagccggctgggcctgctgctgaaggtgctgctggactggcctgtggaggtgctgtatggagctgctgccctgaatggcctgtttggaggcttcagcgccttctggagcggcgtgatggccctgggcagcctgggcagcagcgagggccgccgctctgtgcggctcatcctgattgacctgatgctgggcctggccggcttctgtggctccatggccagcggccacctgttcaagcagatggccggccacagcggccagggcctcatcctgacagcctgcagcgtgtcctgtgccagctttgccctgctgtacagcctgctggtgctgaaggtgcctgagagcgtggccaagcccagccaggagctgcctgctgtggacacagtgtctggaacagtgggcacctaccgcaccctggaccctgaccagctggaccagcagtatgctgtgggccacccccccagccctgggaaggccaagccccacaagaccaccatcgccctgctgtttgtgggcgccatcatctatgacctggccgtggtgggcaccgtggatgtgatccccctgtttgtgctgcgggagcccctgggctggaaccaggtgcaggtgggctacggcatggccgccggctacaccatcttcatcaccagcttcctgggcgtgctggtgttcagccgctgcttccgggacaccaccatgatcatgattggcatggtgtcctttggcagcggggccctgctgctggcctttgtgaaggagacctacatgttctacatcgcccgggctgtgatgctgtttgccctgatccctgtgaccaccatccgcagcgccatgagcaagctgatcaagggcagcagctatggcaaggtgtttgtgatcctgcagctgagcctggccctgactggagtggtgaccagcaccctgtacaacaagatctaccagctgaccatggacatgtttgtgggcagctgctttgccctgagcagcttcctgtccttcctggccatcatccccatcagcatcgtggcctacaagcaggtgcccctgagcccctatggagacatcatcgagaagtag

SEQ ID NO: 170920 - DNA, 1713 bp, Artificial Sequence
  Description of Artificial Sequence: Synthetic coding sequence
atggaggcccctgaggagcccgcccctgtgcggggcggccctgaggccaccctggaggtgcggggcagccgctgcctgcggctgagcgccttccgggaggagctgcgggccctgctggtgctggccggccctgccttcctggtgcagctgatggtgttcctgatctccttcatcagcagcgtcttctgtggccacctgggcaagctggagctggatgctgtgaccctggccatcgctgtgatcaacgtgactggagtgtctgtgggcttcggcctgagcagcgcctgtgacaccctcatcagccagacctacggcagccagaacctgaagcacgtgggcgtcatcctgcagaggtctgccctggtgctgctgctgtgctgcttcccctgctgggccctcttcctgaacacccagcacatcctgctgctcttccggcaggaccctgatgtgtcccggctgacccagacctacgtgaccatcttcatcccagccctgcctgccaccttcctgtacatgctgcaggtgaagtacctgctgaaccagggcatcgtgctgccccagatcgtgactggagtggccgccaacctggtgaatgccctggccaactacctgttcctgcaccagctgcacctgggcgtcatcggcagcgccctggccaacctgatcagccagtacaccctggccctgctgctcttcctgtacatcctgggcaagaagctgcaccaggccacctggggcggctggagcctggagtgcctgcaggactgggccagcttcctgcggctggccatccccagcatgctgatgctgtgcatggagtggtgggcctatgaggtgggcagcttcctgagcggcatcctgggcatggtggagctgggcgcccagagcatcgtgtatgagctggccatcatcgtgtacatggtgcctgctggcttctctgtggccgcctctgtgcgggtgggcaatgccctgggcgctggggacatggagcaggccaggaagagcagcacagtgtccctgctgatcaccgtgctgtttgctgtggccttctctgtgctgctgctgagctgcaaggaccacgtgggctacatcttcaccacagaccgggacatcatcaacctggtggcccaggtggtgcccatctatgctgtgagccacctgtttgaggccctggcctgcaccagcggaggagtgctgcggggcagcggcaaccagaaggtgggcgccatcgtgaacaccatcggctactacgtggtgggcctgcccatcggcatcgccctgatgtttgccaccaccctgggcgtgatgggcctgtggagcggcatcatcatctgcaccgtcttccaggccgtgtgcttcctgggcttcatcatccagctgaactggaagaaggcctgccagcaggcccaggtgcacgccaacctgaaggtgaacaacgtgcccaggagcggcaacagcgccctgccccaggaccccctgcaccctggctgcccagagaacctggagggcatcctgaccaatgatgtgggcaagacaggagagccccagagcgaccagcagatgaggcaggaggagcccctgcctgagcacccccaggatggagccaagctgagcaggaagcagctggtgctgcggcggggcctgctgctgctgggcgtcttcctgatcctgctggtgggcatcctggtgcgcttctacgtgcgcatccagtag

SEQ ID NO: 170921 - DNA, 1761 bp, Artificial Sequence
  Description of Artificial Sequence: Synthetic coding sequence
atggaggcccctgaggagcccgcccctgtgcggggcggccctgaggccaccctggaggtgcggggcagccgctgcctgcggctgagcgccttccgggaggagctgcgggccctgctggtgctggccggccctgccttcctggtgcagctgatggtgttcctgatctccttcatcagcagcgtcttctgtggccacctgggcaagctggagctggatgctgtgaccctggccatcgctgtgatcaacgtgactggagtgtctgtgggcttcggcctgagcagcgcctgtgacaccctcatcagccagacctacggcagccagaacctgaagcacgtgggcgtcatcctgcagaggtctgccctggtgctgctgctgtgctgcttcccctgctgggccctcttcctgaacacccagcacatcctgctgctcttccggcaggaccctgatgtgtcccggctgacccagacctacgtgaccatcttcatcccagccctgcctgccaccttcctgtacatgctgcaggtgaagtacctgctgaaccagggcatcgtgctgccccagatcgtgactggagtggccgccaacctggtgaatgccctggccaactacctgttcctgcaccagctgcacctgggcgtcatcggcagcgccctggccaacctgatcagccagtacaccctggccctgctgctcttcctgtacatcctgggcaagaagctgcaccaggccacctggggcggctggagcctggagtgcctgcaggactgggccagcttcctgcggctggccatccccagcatgctgatgctgtgcatggagtggtgggcctatgaggtgggcagcttcctgagcggcatcctgggcatggtggagctgggcgcccagagcatcgtgtatgagctggccatcatcgtgtacatggtgcctgctggcttctctgtggccgcctctgtgcgggtgggcaatgccctgggcgctggggacatggagcaggccaggaagagcagcacagtgtccctgctgatcaccgtgctgtttgctgtggccttctctgtgctgctgctgagctgcaaggaccacgtgggctacatcttcaccacagaccgggacatcatcaacctggtggcccaggtggtgcccatctatgctgtgagccacctgtttgaggccctggcctgcaccagcggaggagtgctgcggggcagcggcaaccagaaggtgggcgccatcgtgaacaccatcggctactacgtggtgggcctgcccatcggcatcgccctgatgtttgccaccaccctgggcgtgatgggcctgtggagcggcatcatcatctgcaccgtcttccaggccgtgtgcttcctgggcttcatcatccagctgaactggaagaaggcctgccagcaggcccaggtgcacgccaacctgaaggtgaacaacgtgcccaggagcggcaacagcgccctgccccaggaccccctgcaccctggctgcccagagaacctggagggcatcctgaccaatgatgtgggcaagacaggagagccccagagcgaccagcagatgaggcaggaggagcccctgcctgagcacccccaggatggagccaagctgagcaggaagcagctggtgctgcggcggggcctgctgctgctgggcgtcttcctgatcctgctggccggcgtgcgctggtgtgaccacagcagcctgcagcccaggaccctgggcctgcaggccatcctgctgtgccagcccccagagtag

SEQ ID NO: 170922 - DNA, 849 bp, Artificial Sequence
  Description of Artificial Sequence: Synthetic coding sequence
atggtggagctgggcgcccagagcatcgtgtatgagctggccatcatcgtgtacatggtgcctgctggcttctctgtggccgcctctgtgcgggtgggcaatgccctgggcgctggggacatggagcaggccaggaagagcagcacagtgtccctgctgatcaccgtgctgtttgctgtggccttctctgtgctgctgctgagctgcaaggaccacgtgggctacatcttcaccacagaccgggacatcatcaacctggtggcccaggtggtgcccatctatgctgtgagccacctgtttgaggccctggcctgcaccagcggaggagtgctgcggggcagcggcaaccagaaggtgggcgccatcgtgaacaccatcggctactacgtggtgggcctgcccatcggcatcgccctgatgtttgccaccaccctgggcgtgatgggcctgtggagcggcatcatcatctgcaccgtcttccaggccgtgtgcttcctgggcttcatcatccagctgaactggaagaaggcctgccagcaggcccaggtgcacgccaacctgaaggtgaacaacgtgcccaggagcggcaacagcgccctgccccaggaccccctgcaccctggctgcccagagaacctggagggcatcctgaccaatgatgtgggcaagacaggagagccccagagcgaccagcagatgaggcaggaggagcccctgcctgagcacccccaggatggagccaagctgagcaggaagcagctggtgctgcggcggggcctgctgctgctgggcgtcttcctgatcctgctggtgggcatcctggtgcgcttctacgtgcgcatccagtag

SEQ ID NO: 170923 - DNA, 1332 bp, Artificial Sequence
  Description of Artificial Sequence: Synthetic coding sequence
atggaggcccctgaggagcccgcccctgtgcggggcggccctgaggccaccctggaggtgcggggcagccgctgcctgcggctgagcgccttccgggaggagctgcgggccctgctggtgctggccggccctgccttcctggtgcagctgatggtgttcctgatctccttcatcagcagcgtcttctgtggccacctgggcaagctggagctggatgctgtgaccctggccatcgccacctacggcagccagaacctgaagcacgtgggcgtcatcctgcagaggtctgccctggtgctgctgctgtgctgcttcccctgctgggccctcttcctgaacacccagcacatcctgctgctcttccggcaggaccctgatgtgtcccggctgacccagacctacgtgaccatcttcatcccagccctgcctgccaccttcctgtacatgctgcaggtgaagtacctgctgaaccagggcatcgtgctgccccagatcgtgactggagtggccgccaacctggtgaatgccctggccaactacctgttcctgcaccagctgcacctgggcgtgattggcagcgccctggccaacctgatcagccagtacaccctggccctgctgctcttcctgtacatcctgggcaagaagctgcaccaggccacctggggcggctggagcctggagtgcctgcaggactgggccagcttcctgcggctggccatccccagcatgctgatgctgtgcatggagtggtgggcctatgaggtgggcagcttcctgagcggcatcctgggcatggtggagctgggcgcccagagcatcgtgtatgagctggccatcatcgtgtacatggtgcctgctggcttctctgtggccgcctctgtgcgggtgggcaatgccctgggcgctggggacatggagcaggccaggaagagcagcacagtgtccctgctgatcaccgtgctgtttgctgtggccttctctgtgctgctgctgagctgcaaggaccacgtgggctacatcttcaccacagaccgggacatcatcaacctggtggcccaggtggtgcccatctatgctgtgagccacctgtttgaggccctggcctgcaccagcggcggcgtgctgcggggcagcggcaaccagaaggtgggcgccatcgtgaacaccatcggctactacgtggtgggcctgcccatcggcatcgccctgatgtttgccaccaccctgggcgtgatgggcagcggcacccggcagtttgagagcaagcagagggccagcgagtgggagttctgcagccccagcggcagcgccagcccccgggtgccctag

SEQ ID NO: 170924 - DNA, 738 bp, Artificial Sequence
  Description of Artificial Sequence: Synthetic coding sequence
atgctgatgctgtgcatggagtggtgggcctatgaggtgggcagcttcctgagcggcatcctgggcatggtggagctgggcgcccagagcatcgtgtatgagctggccatcatcgtgtacatggtgcctgctggcttctctgtggccgcctctgtgcgggtgggcaatgccctgggcgctggggacatggagcaggccaggaagagcagcacagtgtccctgctgatcaccgtgctgtttgctgtggccttctctgtgctgctgctgagctgcaaggaccacgtgggctacatcttcaccacagaccgggacatcatcaacctggtggcccaggtggtgcccatctatgctgtgagccacctgtttgaggccctggcctgcaccagcggaggagtgctgcggggcagcggcaaccagaaggtgggcgccatcgtgaacaccatcggctactacgtggtgggcctgcccatcggcatcgccctgatgtttgccaccaccctgggcgtgatgggctgcccagagaacctggagggcatcctgaccaatgatgtgggcaagacaggagagccccagagcgaccagcagatgaggcaggaggagcccctgcctgagcacccccaggatggagccaagctgagcaggaagcagctggtgctgcggcggggcctgctgctgctgggcgtcttcctgatcctgctggtgggcatcctggtgcgcttctacgtgcgcatccagtag

SEQ ID NO: 170925 - DNA, 1761 bp, Artificial Sequence; identical to SEQ ID NO: 170921
  Description of Artificial Sequence: Synthetic coding sequence

SEQ ID NO: 170926 - DNA, 735 bp, Artificial Sequence
  Description of Artificial Sequence: Synthetic coding sequence
atggaggcccctgaggagcccgcccctgtgcggggcggccctgaggccaccctggaggtgcggggcagccgctgcctgcggctgagcgccttccgggaggagctgcgggccctgctggtgctggccggccctgccttcctggtgcagctgatggtgttcctgatctccttcatcagcagcgtcttctgtggccacctgggcaagctggagctggatgctgtgaccctggccatcgctgtgatcaacgtgactggagtgtctgtgggcttcggcctgagcagcgcctgtgacaccctcatcagccagacctacggcagccagaacctgaagcacgtgggcgtcatcctgcagaggtctgccctggtgctgctgctgtgctgcttcccctgctgggccctcttcctgaacacccagcacatcctgctgctcttccggcaggaccctgatgtgtcccggctgacccagacctacgtgaccatcttcatcccagccctgcctgccaccttcctgtacatgctgcaggtgaagtacctgctgaaccagaggctgtgcaccgggaagctggacttccctgtgcaccctggcagcacccccctgagcctgcacccccgggagaagacagccagcagctacatgggccgcctggtgccccgggtgcctgctggcctgggcctgctgcccccacctggccacccccagcacgcccatgctgtgcatggagtggtgggcctgtag

SEQ ID NO: 170927 - DNA, 1809 bp, Artificial Sequence
  Description of Artificial Sequence: Synthetic coding sequence
atggacagcctgcaggacacagtggccctggaccacggcggctgctgcccagccctgagccggctggtgccccggggctttggaacagagatgtggaccctgtttgccctgagcggccccctcttcctgttccaggtgctgaccttcatgatctacatcgtgtccaccgtcttctgtggccacctgggcaaggtggagctggcctctgtgaccctggccgtggcctttgtgaatgtgtgtggggtgtctgtgggcgtgggcctgagcagcgcctgtgacaccctgatgagccagagctttggcagccccaacaagaagcacgtgggcgtcatcctgcagagaggagccctggtgctgctgctgtgctgcctgccctgctgggccctcttcctgaacacccagcacatcctgctgctcttccggcaggaccctgatgtgtcccggctgacccaggactatgtgatgatcttcatccctggcctgcccgtcatcttcctgtacaacctgctggccaagtacctgcagaaccagggctggctgaagggccaggaggaggagagccccttccagaccccaggcctgagcatcctgcaccccagccacagccacctgagccgggccagcttccacctgttccagaagatcacctggccccaggtgctgagcggcgtggtgggcaactgtgtgaatggagtggccaactatgccctggtgtctgtgctgaacctgggcgtgcggggcagcgcctatgccaacatcatcagccagtttgcccagaccgtcttcctgctgctgtacatcgtgctgaagaagctgcacctggagacctgggccggctggagcagccagtgcctgcaggactggggccccttcttcagcctggccgtgcccagcatgctgatgatctgtgtggagtggtgggcctatgaaattggcagcttcctgatgggcctgctgtctgtggtggacctgagcgcccaggccgtcatctatgaggtggccaccgtgacctacatgatccccctgggcctgagcattggagtgtgtgtgcgggtgggcatggccctgggcgctgctgacacagtgcaggccaagaggtctgctgtgtctggagtgctgagcatcgtgggcatcagcctggtgctgggcaccctcatcagcatcctgaagaaccagctgggccacatcttcaccaatgatgaagatgtgattgccctggtgtcccaggtgctgcctgtgtacagcgtcttccacgtgtttgaggccatctgctgcgtgtatggaggagtgctgcggggcaccgggaagcaggcctttggagctgctgtgaatgccatcacctactacatcatcggcctgcccctgggcatcctgctgacctttgtggtgaggatgaggatcatgggcctgtggctgggcatgctggcctgtgtgttcctggccacagctgcctttgtggcctacacagcccggctggactggaagctggccgctgaggaggccaagaagcacagcggccggcagcagcagcagagagctgagagcacagccacccggcccggccctgagaaggctgtgctgagctctgtggccaccggcagcagccctggcatcaccctgaccacctacagccgctcagaatgtcatgtggacttcttccgcaccccagaggaggcccacgccctgagcgcccccaccagccggctgtctgtgaagcagctggtgatcagaagaggagctgccctgggcgccgccagcgccaccctgatggtgggcctgactgtgcgcatcctggccaccaggcactag

SEQ ID NO: 170928 - DNA, 1743 bp, Artificial Sequence
  Description of Artificial Sequence: Synthetic coding sequence
atggacagcctgcaggacacagtggccctggaccacggcggctgctgcccagccctgagccggctggtgccccggggctttggaacagagatgtggaccctgtttgccctgagcggccccctcttcctgttccaggtgctgaccttcatgatctacatcgtgtccaccgtcttctgtggccacctgggcaaggtggagctggcctctgtgaccctggccgtggcctttgtgaatgtgtgtggggtgtctgtgggcgtgggcctgagcagcgcctgtgacaccctgatgagccagagctttggcagccccaacaagaagcacgtgggcgtcatcctgcagagaggagccctggtgctgctgctgtgctgcctgccctgctgggccctcttcctgaacacccagcacatcctgctgctcttccggcaggaccctgatgtgtcccggctgacccaggactatgtgatgatcttcatccctggcctgcccgtcatcttcctgtacaacctgctggccaagtacctgcagaaccagaagatcacctggccccaggtgctgagcggcgtggtgggcaactgtgtgaatggagtggccaactatgccctggtgtctgtgctgaacctgggcgtgcggggcagcgcctatgccaacatcatcagccagtttgcccagaccgtcttcctgctgctgtacatcgtgctgaagaagctgcacctggagacctgggccggctggagcagccagtgcctgcaggactggggccccttcttcagcctggccgtgcccagcatgctgatgatctgtgtggagtggtgggcctatgaaattggcagcttcctgatgggcctgctgtctgtggtggacctgagcgcccaggccgtcatctatgaggtggccaccgtgacctacatgaggcacagccaccggctggcctatgctgcccacgtgacccgcatccccctgggcctgagcattggagtgtgtgtgcgggtgggcatggccctgggcgctgctgacacagtgcaggccaagaggtctgctgtgtctggagtgctgagcatcgtgggcatcagcctggtgctgggcaccctcatcagcatcctgaagaaccagctgggccacatcttcaccaatgatgaagatgtgattgccctggtgtcccaggtgctgcctgtgtacagcgtcttccacgtgtttgaggccatctgctgcgtgtatggaggagtgctgcggggcaccgggaagcaggcctttggagctgctgtgaatgccatcacctactacatcatcggcctgcccctgggcatcctgctgacctttgtggtgaggatgaggatcatgggcctgtggctgggcatgctggcctgtgtgttcctggccacagctgcctttgtggcctacacagcccggctggactggaagctggccgctgaggaggccaagaagcacagcggccggcagcagcagcagagagctgagagcacagccacccggcccggccctgagaaggctgtgctgagctctgtggccaccggcagcagccctggcatcaccctgaccacctacagccgctcagaatgtcatgtggacttcttccgcaccccagaggaggcccacgccctgagcgcccccaccagccggctgtctgtgaagcagctggtgatcagaagaggagctgccctgggcgccgccagcgccaccctgatggtgggcctgactgtgcgcatcctggccaccaggcactag

SEQ ID NO: 170929 - DNA, 1092 bp, Artificial Sequence
  Description of Artificial Sequence: Synthetic coding sequence
atggacagcctgcaggacacagtggccctggaccacggcggctgctgcccagccctgagccggctggtgccccggggctttggaacagagatgtggaccctgtttgccctgagcggccccctcttcctgttccaggtgctgaccttcatgatctacatcgtgtccaccgtcttctgtggccacctgggcaaggtggagctggcctctgtgaccctggccgtggcctttgtgaatgtgtgtggggtgtctgtgggcgtgggcctgagcagcgcctgtgacaccctgatgagccagagctttggcagccccaacaagaagcacgtgggcgtcatcctgcagagaggagccctggtgctgctgctgtgctgcctgccctgctgggccctcttcctgaacacccagcacatcctgctgctcttccggcaggaccctgatgtgtcccggctgacccaggactatgtgatgatcttcatccctggcctgcccgtcatcttcctgtacaacctgctggccaagtacctgcagaaccagaagatcacctggccccaggtgctgagcggcgtggtgggcaactgtgtgaatggagtggccaactatgccctggtgtctgtgctgaacctgggcgtgcggggcagcgcctatgccaacatcatcagccagtttgcccagaccgtcttcctgctgctgtacatcgtgctgaagaagctgcacctggagacctgggccggctggagcagccagtgcctgcaggactggggccccttcttcagcctggccgtgcccagcatgctgatgatctgtgtggagtggtgggcctatgaaattggcagcttcctgatgggcctgctgtctgtggtggacctgagcgcccaggccgtcatctatgaggtggccaccgtgacctacatgatccccctgggcctgagcattggagtgtgtgtgcgggtgggcatggccctgggcgctgctgacacagtgcaggccaagaggtctgctgtgtctggagtgctgagcatcgtgggcatcagcctggtgctgggcaccctcatcagcatcctgaagaaccagctgggccacatcttcaccaactag

SEQ ID NO: 170930 - DNA, 891 bp, Artificial Sequence
  Description of Artificial Sequence: Synthetic coding sequence
atgatctacatcgtgtccacagtgttctgtggccacctgggcaaggtggagctggcctctgtgaccctggccgtggcctttgtgaatgtgtgtggggtgtctgtgggcgtgggcctgagcagcgcctgtgacaccctgatgagccagagctttggcagccccaacaagaagcacgtgggcgtcatcctgcagagaggagccctggtgctgctgctgtgctgcctgccctgctgggccctcttcctgaacacccagcacatcctgctgctcttccggcaggaccctgatgtgtcccggctgacccaggactatgtgatgatcttcatccctggcctgcctgtgatcttcctgtacaacctgctggccaagtacctgcagaaccagaagatcacctggccccaggtgctgtctggagtggtgggcaactgtgtgaatggagtggccaactatgccctggtgtctgtgctgaacctgggcgtgcggggcagcgcctatgccaacatcatcagccagtttgcccagacagtgttcctgctgctgtacatcgtgctgaagaagctgcacctggagacctgggccggctggagcagccagtgcctgcaggactggggccccttcttcagcctggccgtgcccagcatgctgatgatctgtgtggagtggtgggcctatgagatcggcagcttcctgatgggcctgctgtctgtggtggacctgagcgcccaggccgtcatctatgaggtggccaccgtgacctacatgatccccctgggcctgagcattggagtgtgtgtgcgggtgggcatggccctgggcgctgctgacacagtgcaggccaagaggtctgctgtgtctggagtgctgagcatcgcccggagtgacccctggtag

SEQ ID NO: 170931 - DNA, 531 bp, Artificial Sequence
  Description of Artificial Sequence: Synthetic coding sequence
atgaaggccagcggcaccctgcgggagtacaaggtggtgggccgctgcctgcccacccccaagtgccacaccccacccctgtacaggatgaggatctttgcccccaaccacgtggtggccaagagccgcttctggtactttgtgtcccagctgaagaagatgaagaagagcagcggggagatcgtgtactgcggccaggtgtttgagaagagccccctgcgggtgaagaactttggcatctggctgcgctatgacagccgcagcggcacccacaacatgtaccgggagtacagagacctgaccacagctggagctgtgacccagtgctacagagacatgggcgcccggcaccgggcccgggcccacagcatccagatcatgaaggtggaggagattgctgccagcaagtgccggcggcctgctgtgaagcagttccatgacagcaagatcaagttccccctgccccaccgggtgctgcggcggcagcacaagccccgcttcaccaccaagaggcccaacaccttcttctag

SEQ ID NO: 170932 - DNA, 1995 bp, Artificial Sequence
  Description of Artificial Sequence: Synthetic coding sequence
atggacagcagcacctggagccccaagaccacagctgtgaccaggcctgtggagacccatgagctgatcagaaatgctgctgacatcagcatcatcgtcatctactttgtggtggtgatggctgtgggcctgtgggccatgttcagcaccaacagaggcaccgtgggcggcttcttcctggccggccgctccatggtgtggtggcccatcggggccagcctgtttgccagcaacatcggcagcggccactttgtgggcctggccggcaccggggccgccagcggcatcgccatcggcggctttgagtggaatgccctggtgctggtggtggtgctgggctggctgtttgtgcccatctacatcaaggccggcgtggtgaccatgcctgagtacctgaggaagagatttggaggccagaggatccaggtgtacctgagcctgctgagcctgctgctgtacatcttcaccaagatctctgctgacatcttcagcggggccatcttcatcaacctggccctgggcctgaacctgtacctggccatcttcctgctgctggccatcacagccctgtacaccatcaccggcggcctggccgctgtgatctacacagacaccctgcagaccgtcatcatgctggtgggcagcctcatcctgactggatttgccttccacgaggtgggcggctatgatgccttcatggagaagtacatgaaggccatccccaccatcgtgtctgatggcaacaccaccttccaggagaagtgctacacccccagggctgacagcttccacatcttccgggaccccctgactggagacctgccctggccaggcttcatcttcggcatgagcatcctgaccctgtggtactggtgcacagaccaggtgattgtgcagcgctgcctgagcgccaagaacatgagccacgtgaagggcggctgcatcctgtgtggctacctgaagctgatgcccatgttcatcatggtgatgcctggcatgatcagccgcatcctgtacacagagaagatcgcctgtgtggtgcccagtgaatgtgagaagtactgcggcaccaaggtgggctgcaccaacatcgcctaccccaccctggtggtggagctgatgcccaacggcctgcggggcctgatgctgtctgtgatgctggccagcctgatgagcagcctgaccagcatcttcaacagcgccagcaccctcttcaccatggacatctatgccaaggtgaggaagagggccagcgagaaggagctgatgattgctggccgcctcttcatcctggtgctgattggcatcagcatcgcctgggtgcccatcgtgcagagcgcccagagcggccagctgtttgactacatccagagcatcaccagctacctgggcccccccatcgctgctgtgttcctgctggccatcttctggaagagggtgaatgaacctggggccttctggggcctcatcctgggcctgctgattggcatcagcaggatgatcacagaatttgcctacggcaccggcagctgcatggagcccagcaactgccccaccatcatctgtggggtgcactacctgtactttgccatcatcctgtttgccatctccttcatcaccatcgtggtgatcagcctgctgaccaagcccatcccagatgtgcacctgtaccgcctgtgctggagcctgaggaacagcaaggaggagagaattgacctggatgctgaggaggagaacatccaggagggccccaaggagaccatcgagattgagacccaggtgcctgagaagaagaagggcatcttcagaagagcctatgacctcttctgtggcctggagcagcacggggcccccaagatgacagaggaggaggagaaggccatgaagatgaagatgacagacaccagcgagaagcccctgtggaggacagtgctgaatgtgaatggcatcatcctggtgacagtggccgtgttctgccacgcctactttgcctag

SEQ ID NO: 170933 - DNA, 1614 bp, Artificial Sequence
  Description of Artificial Sequence: Synthetic coding sequence
atgcctgagtacctgaggaagagatttggaggccagaggatccaggtgtacctgagcctgctgagcctgctgctgtacatcttcaccaagatctctgctgacatcttcagcggggccatcttcatcaacctggccctgggcctgaacctgtacctggccatcttcctgctgctggccatcacagccctgtacaccatcactggaggcctggccgccgtcatctacacagacaccctgcagaccgtcatcatgctggtgggcagcctcatcctgaccggctttgccttccacgaggtgggcggctatgatgccttcatggagaagtacatgaaggccatccccaccatcgtgtctgatggcaacaccaccttccaggagaagtgctacacccccagggctgacagcttccacatcttccgggaccccctgaccggggacctgccctggccaggcttcatcttcggcatgagcatcctgaccctgtggtactggtgcacagaccaggtgattgtgcagcgctgcctgagcgccaagaacatgagccacgtgaagggcggctgcatcctgtgtggctacctgaagctgatgcccatgttcatcatggtgatgcctggcatgatcagccgcatcctgtacacagagaagatcgcctgtgtggtgcccagtgaatgtgagaagtactgcggcaccaaggtgggctgcaccaacatcgcctaccccaccctggtggtggagctgatgcccaacggcctgcggggcctgatgctgtctgtgatgctggccagcctgatgagcagcctgaccagcatcttcaacagcgccagcaccctcttcaccatggacatctatgccaaggtgaggaagagggccagcgagaaggagctgatgattgctggccgcctcttcatcctggtgctgattggcatcagcatcgcctgggtgcccatcgtgcagagcgcccagagcggccagctgtttgactacatccagagcatcaccagctacctgggcccccccatcgctgctgtgttcctgctggccatcttctggaagagggtgaatgagcccggggccttctggggcctcatcctgggcctgctgattggcatcagcaggatgatcacagaatttgcctatggaacaggcagctgcatggagcccagcaactgccccaccatcatctgtggggtgcactacctgtactttgccatcatcctgtttgccatctccttcatcaccatcgtggtgatcagcctgctgaccaagcccatcccagatgtgcacctgtaccgcctgtgctggagcctgaggaacagcaaggaggagagaattgacctggatgctgaggaggagaacatccaggagggccccaaggagaccattgaaattgagacccaggtgcctgagaagaagaagggcatcttccggcgggcctatgacctcttctgtggcctggagcagcacggggcccccaagatgacagaggaggaggagaaggccatgaagatgaagatgacagacaccagcgagaagcccctgtggaggacagtgctgaatgtgaatggcatcatcctggtgacagtggccgtgttctgccacgcctactttgcctag

SEQ ID NO: 170934 - DNA, 1191 bp, Artificial Sequence
  Description of Artificial Sequence: Synthetic coding sequence
atggaggtgaagaactttgctgtgtgggactatgtggtgtttgctgccctcttcttcatcagcagcggcatcggggtcttctttgccatcaaggagaggaagaaggccaccagccgggagttcctggtgggcggccggcagatgagctttggacctgtgggcctgagcctgacagccagcttcatgtctgctgtgacagtgctgggcacccccagcgaggtgtacagatttggagccagcttcctggtgttcttcatcgcctacctgtttgtgatcctgctgaccagcgagctgttcctgcctgtgttctaccgcagcggcatcaccagcacctatgagtacctgcagctgcgcttcaacaagcctgtgcgctatgctgccaccgtcatctacatcgtgcagaccatcctgtacacaggagtggtggtgtatgccccagccctggccctgaaccaggtgacaggctttgacctgtggggctctgtgtttgccactggaattgtgtgcaccttctactgcaccctgggcggcctgaaggctgtggtgtggacagatgccttccagatggtggtgatgattgtgggcttcctgactgtgctgatccagggcagcacccatgctgggggcttccacaacgtgctggagcagagcaccaacggcagccggctgcacatctttgattttgatgtggaccccctgcggcggcacaccttctggaccatcaccgtgggcggcaccttcacctggctgggcatctatggagtgaaccagagcaccatccagcgctgcatcagctgcaagacagagaagcacgccaagctggccctgtacttcaacctgctgggcctgtggatcatcctggtgtgtgctgtgttttctggcctcatcatgtacagccacttcaaggactgtgacccctggaccagcggcatcatcagcgccccagaccagctgatgccctactttgtgatggagatctttgccaccatgcctggcctgcccggcctgtttgtggcctgtgccttcagcggcaccctgagcacagtggccagcagcatcaatgccctggccaccgtgacctttgaggactttgtgaagagctgcttcccccacctgagtgacaagctgagcacctggatcagcaagggcctgtgccgctacagctggtggaccttctacagcatctcctag

SEQ ID NO: 170935 - DNA, 1857 bp, Artificial Sequence
  Description of Artificial Sequence: Synthetic coding sequence
atggaggtgaagaactttgctgtgtgggactatgtggtgtttgctgccctcttcttcatcagcagcggcatcggggtcttctttgccatcaaggagaggaagaaggccaccagccgggagttcctggtgggcggccggcagatgagctttggacctgtgggcctgagcctgacagccagcttcatgtctgctgtgacagtgctgggcacccccagcgaggtgtacagatttggagccagcttcctggtgttcttcatcgcctacctgtttgtgatcctgctgaccagcgagctgttcctgcctgtgttctaccgcagcggcatcaccagcacctatgagtacctgcagctgcgcttcaacaagcctgtgcgctatgctgccaccgtcatctacatcgtgcagaccatcctgtacacaggagtggtggtgtatgccccagccctggccctgaaccaggtgacaggctttgacctgtggggctctgtgtttgccactggaattgtgtgcaccttctactgcaccctgggcggcctgaaggctgtggtgtggacagatgccttccagatggtggtgatgattgtgggcttcctgactgtgctgatccagggcagcacccatgctgggggcttccacaacgtgctggagcagagcaccaacggcagccggctgcacatctttgattttgatgtggaccccctgcggcggcacaccttctggaccatcaccgtgggcggcaccttcacctggctgggcatctatggagtgaaccagagcaccatccagcgctgcatcagctgcaagacagagaagcacgccaagctggccctgtacttcaacctgctgggcctgtggatcatcctggtgtgtgctgtgttttctggcctcatcatgtacagccacttcaaggactgtgacccctggaccagcggcatcatcagcgccccagaccagctgatgccctactttgtgatggagatctttgccaccatgcctggcctgcccggcctgtttgtggcctgtgccttcagcggcaccctgagcacagtggccagcagcatcaatgccctggccaccgtgacctttgaggactttgtgaagagctgcttcccccacctgagtgacaagctgagcacctggatcagcaagggcctgtgcctgctgtttggagtgatgtgcacctccatggctgtggccgcctctgtgatgggcggcgtggtgcaggccagcctgagcatccacggcatgtgtggcggccccatgctgggcctcttcagcctgggcatcgtgttcccctttgtgaactggaagggggccctgggcggcctgctgaccggcatcaccctgtccttctgggtggccatcggggccttcatctacccagccccagccagcaagacctggcccctgcccctgagcacagaccagtgcatcaagagcaatgtgacagccaccggcccccctgtgctgagcagcaggcctggcattgctgacacctggtacagcatctcctacctgtactacagcgctgtgggctgcctgggctgcatcgtggccggggtcatcatcagcctcatcaccggccggcagagaggagaggacatccagcccctgctgatccggcctgtgtgcaacctcttctgcttctggagcaagaagtacaagaccctgtgctggtgtggggtgcagcatgattctggaacagagcaggagaacctggagaatggcagcgccaggaagcagggcgctgagagcgtgctgcagaatggcctgcggcgggagagcctggtgcacgtgcccggctatgaccccaaggacaagagctacaacaacatggcctttgagaccacccacttctag

SEQ ID NO: 170936 - DNA, 834 bp, Artificial Sequence
  Description of Artificial Sequence: Synthetic coding sequence
atggtggtgatgattgtgggcttcctgactgtgctgatccagggcagcacccatgctgggggcttccacaacgtgctggagcagagcaccaacggcagccggctgcacatctttgattttgatgtggaccccctgcggcggcacaccttctggaccatcaccgtgggcggcaccttcacctggctgggcatctatggagtgaaccagagcaccatccagcgctgcatcagctgcaagacagagaagcacgccaagctggccctgtacttcaacctgctgggcctgtggatcatcctggtgtgtgctgtgttttctggcctcatcatgtacagccacttcaaggactgtgacccctggaccagcggcatcatcagcgccccagaccagctgatgccctactttgtgatggagatctttgccaccatgcctggcctgcccggcctgtttgtggcctgtgccttcagcggcaccctgagcacagtggccagcagcatcaatgccctggccaccgtgacctttgaggactttgtgaagagctgcttcccccacctgagtgacaagctgagcacctggatcagcaagggcctgtgccgcagcctcatctggagagatgtgtacctgtatggctgcggctgcatctgccacggccgctgctgtgccggcttcccccagcacagccgccacgtgtggaggaccaatgccggcctcatcctgcccggcaacagagtgcccttctgtgagctggagggctgcaccaggaggagcagctactggaaccacctggtgatcctgggcggccactggggcctgcacctgccctgcaccagcctgtag

SEQ ID NO: 170937 - DNA, 2019 bp, Artificial Sequence
  Description of Artificial Sequence: Synthetic coding sequence
atggaggagcacacagaagctggcagcgcccctgagatgggcgcccagaaggccctgattgacaacccagctgacatcctggtgattgctgcctacttcctgctggtgattggagtgggcctgtggagcatgtgcaggaccaacagaggaacagtgggcggctacttcctggccggccgctccatggtgtggtggcctgtgggcgccagcctgtttgccagcaacatcggcagcggccactttgtgggcctggccggcactggagctgccagcggcctggccgtggccggctttgagtggaatgccctgtttgtggtgctgctgctgggctggctgtttgcccctgtgtacctgacagctggggtcatcaccatgccccagtacctgaggaagagatttggaggccgccgcatccggctgtacctgtctgtgctgagcctcttcctgtacatcttcaccaagatctctgtggacatgttttctggagctgtgttcatccagcaggccctgggctggaacatctatgcctctgtgattgccctgctgggcatcaccatgatctacacagtgactggaggcctggccgccctgatgtacacagacacagtgcagaccttcgtcatcctgggcggggcctgcatcctgatgggctacgccttccacgaggtgggcggctacagcggcctgtttgacaagtacctgggcgccgccaccagcctgactgtgtctgaggaccctgctgtgggcaacatcagcagcttctgctaccggcccaggccagacagctaccacctgctgcggcaccctgtgactggagacctgccctggccagccctgctgctgggcctgaccatcgtgtctggctggtactggtgcagcgaccaggtgattgtgcagcgctgcctggccggcaagagcctgacccacatcaaggccggctgcatcctgtgtggctacctgaagctgacccccatgttcctgatggtgatgcctggcatgatcagccgcatcctgtacccagatgaggtggcctgtgtggtgcctgaggtgtgccggcgggtgtgtggcacagaggtgggctgcagcaacatcgcctacccccggctggtggtgaagctgatgcccaacggcctgcggggcctgatgctggccgtgatgctggccgccctgatgagcagcctggccagcatcttcaacagcagcagcaccctcttcaccatggacatctacacccggctgcggcccagggctggggaccgggagctgctgctggtgggccgcctgtgggtggtgttcatcgtggtggtgtctgtggcctggctgcctgtggtgcaggccgcccagggcggccagctgtttgactacatccaggccgtgtcctcctacctggcccctcctgtgtctgctgtgtttgtgctggccctgtttgtgccccgggtgaatgagcagggcgccttctggggcctcatcggcggcctgctgatgggcctggcccggctcatccctgagttctcctttggcagcggcagctgtgtgcagcccagcgcctgcccagccttcctgtgtggggtgcactacctgtactttgccatcgtgctcttcttctgcagcggcctgctgaccctgactgtgtccctgtgcacagcccccatccccaggaagcacctgcaccggctggtgttcagcctgcggcacagcaaggaggagcgggaggacctggatgctgatgagcagcagggcagcagcctgcctgtgcagaatggctgcccagagagcgccatggagatgaatgagccccaggccccagcccccagcctcttccggcagtgcctgctgtggttctgtggcatgagccggggcggcgtgggcagccccccacccctgacccaggaggaggccgctgctgctgcccggcggctggaggacatcagcgaggaccccagctgggcccgggtggtgaacctgaatgccctgctgatgatggctgtggccgtgttcctgtggggcttctacgcctag

SEQ ID NO: 170938 - DNA, 1377 bp, Artificial Sequence
  Description of Artificial Sequence: Synthetic coding sequence
atggaggagcacacagaagctggcagcgcccctgagatgggcgcccagaaggccctgattgacaacccagctgacatcctggtgattgctgcctacttcctgctggtgattggagtgggcctgtggagcatgtgcaggaccaacagaggaacagtgggcggctacttcctggccggccgctccatggtgtggtggcctgtgggcgccagcctgtttgccagcaacatcggcagcggccactttgtgggcctggccggcactggagctgccagcggcctggccgtggccggctttgagtggaatgccctgtttgtggtgctgctgctgggctggctgtttgcccctgtgtacctgacagctggggtcatcaccatgccccagtacctgaggaagagatttggaggccgccgcatccggctgtacctgtctgtgctgagcctcttcctgtacatcttcaccaagatctctgtggacatgttttctggagctgtgttcatccagcaggccctgggctggaacatctatgcctctgtgattgccctgctgggcatcaccatgatctacacagtgactggaggcctggccgccctgatgtacacagacacagtgcagaccttcgtcatcctgggcggggcctgcatcctgatgggctacgccttccacgaggtgggcggctacagcggcctgtttgacaagtacctgggcgccgccaccagcctgactgtgtctgaggaccctgctgtgggcaacatcagcagcttctgctaccggcccaggccagacagctaccacctgctgcggcaccctgtgactggagacctgccctggccagccctgctgctgggcctgaccatcgtgtctggctggtactggtgcagcgaccaggtgattgtgcagcgctgcctggccggcaagagcctgacccacatcaaggccggctgcatcctgtgtggctacctgaagctgacccccatgttcctgatggtgatgcctggcatgatcagccgcatcctgtacccagatgaggtggcctgtgtggtgcctgaggtgtgccggcgggtgtgtggcacagaggtgggctgcagcaacatcgcctacccccggctggtggtgaagctgatgcccaacggccgcctgctgggcacccaccggggccctgcagatggccctggcaccccagacagccgggtgctgctgcggctgggccagctgtgtgccgccctgggcgtgcccagcttccccctgcggcgggccctgcccctgctgcggcactgtgctgtgctgctgctgtggccaccccacccccacggcctgcctgtgcaccgggcccacccccagaaggcccctcctcctcctggcctgcagagccctgcctag

SEQ ID NO: 170939 - DNA, 2157 bp, Artificial Sequence
  Description of Artificial Sequence: Synthetic coding sequence
atgagagctgtgctggacacagctgacatcgccatcgtggccctgtacttcatcctggtgatgtgcatcggcttctttgccatgtggaagagcaacagaagcacagtgtctggctacttcctggccggccgctccatgacctgggtgaccatcggggccagcctgtttgtgagcaacatcggcagcgagcacttcatcggcctggccggcagcggggccgccagcggctttgctgtgggcgcctgggagttcaatgccctgctgctgctgcagctgctgggctgggtgttcatccccatctacatccgcagcggcgtgtacaccatgcctgagtacctgagcaagagatttggaggccaccgcatccaggtgtactttgctgccctgagcctcatcctgtacatcttcaccaagctgtctgtggacctgtacagcggggccctcttcatccaggagagcctgggctggaacctgtatgtgtctgtcatcctgctgattggcatgacagccctgctgactgtgactggaggcctggtggccgtcatctacacagacaccctgcaggccctgctgatgatcatcggggccctgaccctgatgatcatcagcatcatggagattggaggctttgaggaggtgaagaggcgctacatgctggccagcccagatgtgaccagcatcctgctgacctacaacctgagcaacaccaacagctgcaatgtgagccccaagaaggaggccctgaagatgctgaggaaccccacagatgaagatgtgccctggccaggcttcatcctgggccagaccccagcctctgtgtggtactggtgtgccgaccaggtgattgtgcagagggtgctggccgccaagaacatcgcccacgccaagggcagcaccctgatggccggcttcctgaagctgctgcccatgttcatcatcgtggtgcccggcatgatcagccgcatcctcttcacagatgacatcgcctgcatcaaccctgagcactgcatgctggtgtgtggcagccgggccggctgcagcaacatcgcctacccccggctggtgatgaagctggtgcctgtgggcctgcggggcctgatgatggctgtgatgattgctgccctgatgtctgacctggacagcatcttcaacagcgccagcaccatcttcaccctggatgtgtacaagctgatcaggaagagcgccagcagccgggagctgatgattgtgggccgcatctttgtggccttcatggtggtgatcagcatcgcctgggtgcccatcatcgtggagatgcagggcggccagatgtacctgtacatccaggaggtggccgactacctgaccccacctgtggccgccctcttcctgctggccatcttctggaagcgctgcaatgagcagggcgccttctacggcggcatggccggctttgtgctgggcgctgtgcggctcatcctggcctttgcctaccgggccccagaatgtgaccagcctgacaacagacctggcttcatcaaggacatccactacatgtatgtggccaccggcctcttctgggtgacaggcctcatcaccgtcatcgtgtccctgctgaccccaccacccaccaaggagcagatccgcaccaccaccttctggagcaagaagaacctggtggtgaaggagaactgcagccccaaggaggagccctaccagatgcaggagaagagcatcctgcgctgcagtgaaaataatgagaccatcaaccacatcatccccaacgggaagtctgaggacagcatcaagggcctgcagccagaagatgtgaacctgctggtgacctgccgggaggagggcaaccctgtggccagcctgggccacagcgaggccgagacccctgtggatgcctacagcaatggccaggccgccctgatgggagagaaggagaggaagaaggagacagatgatggcggccgctactggaagttcatcgactggttctgtggcttcaagagcaagagcctgagcaagaggagcctgcgggacctgatggaggaggaggccgtgtgcctgcagatgctggaggagacccggcaggtgaaggtgatcctgaacatcggcctgtttgctgtgtgcagcctgggcatcttcatgtttgtgtacttcagcctgtag

SEQ ID NO: 170940 - DNA, 504 bp, Artificial Sequence
  Description of Artificial Sequence: Synthetic coding sequence
atggaggccggcggcttcctggacagcctcatctacggggcctgtgtggtgttcaccctgggcatgttttctgctggcctgagtgacctgcggcacatgaggatgaccaggtctgtggacaacgtgcagttcctgcccttcctgaccacagaggtgaacaacctgggctggctgtcctatggagccctgaagggagatggcatcctgattgtggtgaacacagtgggcgccgccctgcagaccctgtacatcctggcctacctgcactactgccccaggaaggccaaggtgatccagaccaagagcacccagtgcctgagctaccccctgaccatcgccaccctgctgaccagcgcctcctggtgcctgtatggcttccggctgcgggacccctacatcatggtgagcaacttccctggcatcgtgaccagcttcatccgcttctggctgttctggaagtacccccaggagcaggacaggaactactggctgctgcagacctag

SEQ ID NO: 170941 - DNA, 501 bp, Artificial Sequence
  Description of Artificial Sequence: Synthetic coding sequence
atgaggggcctgcacccctggcacgtgctgcggcggcccctgggcccccaggcccacgccaatgaccctgaatgtggccagaggcctgtgcctgccctgagccaccacggcagccagagggtggtgctgctgcagacagccaccctgctgggcgtgctgctgctgggctacggctacttctggctgctggtgcccaaccctgaggcccggctgcagcagctgggcctcttctgcagcgtcttcaccatctccatgtacctgagccccctggccgacctggccaaggtgatccagaccaagagcacccagtgcctgagctaccccctgaccatcgccaccctgctgaccagcgcctcctggtgcctgtatggcttccggctgcgggacccctacatcatggtgagcaacttccctggcatcgtgaccagcttcatccgcttctggctgttctggaagtacccccaggagcaggacaggaactactggctgctgcagacctag

SEQ ID NO: 170942 - DNA, 666 bp, Artificial Sequence
  Description of Artificial Sequence: Synthetic coding sequence
atggaggccggcggcttcctggacagcctcatctacggggcctgtgtggtgttcaccctgggcatgttttctgctggcctgagtgacctgcggcacatgaggatgaccaggtctgtggacaacgtgcagttcctgcccttcctgaccacagaggtgaacaacctgggctggctgtcctatggagccctgaagggagatggcatcctgattgtggtgaacacagtgggcgccgccctgcagaccctgtacatcctggcctacctgcactactgccccaggaagagggtggtgctgctgcagacagccaccctgctgggcgtgctgctgctgggctacggctacttctggctgctggtgcccaaccctgaggcccggctgcagcagctgggcctcttctgcagcgtcttcaccatctccatgtacctgagccccctggccgacctggccaaggtgatccagaccaagagcacccagtgcctgagctaccccctgaccatcgccaccctgctgaccagcgcctcctggtgcctgtatggcttccggctgcgggacccctacatcatggtgagcaacttccctggcatcgtgaccagcttcatccgcttctggctgttctggaagtacccccaggagcaggacaggaactactggctgctgcagacctag

SEQ ID NO: 170943 - DNA, 471 bp, Artificial Sequence
  Description of Artificial Sequence: Synthetic coding sequence
atggaggagctgggcccccaggcccacgccaatgaccctgaatgtggccagaggcctgtgcctgccctgagccaccacggcagccagagggtggtgctgctgcagacagccaccctgctgggcgtgctgctgctgggctacggctacttctggctgctggtgcccaaccctgaggcccggctgcagcagctgggcctcttctgcagcgtcttcaccatctccatgtacctgagccccctggccgacctggccaaggtgatccagaccaagagcacccagtgcctgagctaccccctgaccatcgccaccctgctgaccagcgcctcctggtgcctgtatggcttccggctgcgggacccctacatcatggtgagcaacttccctggcatcgtgaccagcttcatccgcttctggctgttctggaagtacccccaggagcaggacaggaactactggctgctgcagacctag

SEQ ID NO: 170944 - DNA, 1929 bp, Artificial Sequence
  Description of Artificial Sequence: Synthetic coding sequence
atggacaagctgaagtgccccagcttcttcaagtgccgggagaaggagaaggtgtctgccagcagcgagaacttccacgtgggagaaaatgatgagaaccaggaccggggcaactggagcaagaagagtgactacctgctgtccatgattggctatgctgtgggcctgggcaatgtgtggaggttcccctacctgacctacagcaatggaggaggagccttcctgatcccctatgccatcatgctggccctggccggcctgcccctcttcttcctggagtgcagcctgggccagtttgccagcctgggccctgtgtctgtgtggaggatcctgcccctcttccagggcgtgggcatcaccatggtgctgatcagcatctttgtgaccatctactacaacgtcatcatcgcctacagcctgtactacatgtttgccagcttccagagcgagctgccctggaagaactgcagctcctggagcgacaagaactgcagccgcagccccatcgtgacccactgcaatgtgtccacagtgaacaagggcatccaggagatcatccagatgaacaagtcctgggtggacatcaacaacttcacctgcatcaatggcagcgagatctaccagcccggccagctgcccagcgagcagtactggaacaaggtggccctgcagaggagcagcggcatgaatgagaccggggtgattgtgtggtacctggccctgtgcctgctgctggcctggctgattgtgggcgccgccctcttcaagggcatcaagagcagcggcaaggtggtgtacttcaccgccctcttcccctacgtggtgctgctgatcctgctggtgcggggggccaccctggagggcgccagcaagggcatctcctactacatcggggcccagagcaacttcaccaagctgaaggaggccgaggtgtggaaggatgctgccacccagatcttctacagcctgtctgtggcctggggcggcctggtggccctgagcagctacaacaagttcaagaacaactgcttcagtgatgccatcgtggtgtgcctgaccaactgcctgacctctgtgtttgctggctttgccatcttcagcatcctgggccacatggcccacatcagcggcaaggaggtgtcccaggtggtgaagagcggctttgacctggccttcatcgcctacccagaggccctggcccagctgcccggcggccccttctggagcatcctcttcttcttcatgctgctgaccctgggcctggacagccagtttgccagcattgagaccatcaccaccaccatccaggacctcttccccaaggtgatgaagaagatgagggtgcccatcaccctgggctgctgcctggtgctcttcctgctgggcctggtgtgtgtgacccaggccggcatctactgggtgcacctgattgaccacttctgtgccggctggggcatcctgattgctgccatcctggagctggtgggcatcatctggatctatggaggcaaccgcttcatcgaggacacagagatgatgattggagccaagcgctggatcttctggctgtggtggagggcctgctggtttgtgatcacccccatcctgctgattgccatcttcatctggagcctggtgcagttccaccggcccaactatggagccatcccctacccagactggggcgtggccctgggctggtgcatgattgtgttctgcatcatctggatccccatcatggccatcatcaagatcatccaggccaagggcaacatcttccagaggctcatcagctgctgcaggcctgccagcaactggggcccctacctggagcagcacagaggagagcgctacaaggacatggtggaccccaagaaggaggccgaccacgagatccccaccgtgtctggcagcaggaagccagagtag

SEQ ID NO: 170945 - DNA, 1539 bp, Artificial Sequence
  Description of Artificial Sequence: Synthetic coding sequence
atgggcgtgcagtggtggagccacacccagggcgaggtggccgtgggcctgggcctgggggacagctacctgaccccctgcccctgccctggggtgggctatgctgtgatcctgattgccctgtatgtgggcttctactacaacgtcatcatcgcctggagcctgtactacctgttcagcagcttcaccctgaacctgccctggacagactgtggccacacctggaacagccccaactgcacagaccccaagctgctgaatggatctgtgctgggcaaccacaccaagtacagcaagtacaagttcaccccagctgctgagttctatgagcggggcgtgctgcacctgcacgagagcagcggcatccatgacatcggcctgccccagtggcagctgctgctgtgcctgatggtggtggtgattgtgctgtacttcagcctgtggaagggcgtgaagaccagcggcaaggtggtgtggatcacagccaccctgccctactttgtgctgtttgtgctgctggtgcatggagtgaccctgcccggggccagcaatggcatcaatgcctacctgcacatcgacttctaccgcctgaaggaggccaccgtgtggattgatgctgccacccagatcttcttcagcctgggcgccggcttcggcgtgctgattgcctttgccagctacaacaagtttgacaacaactgctacagagatgccctgctgaccagcagcatcaactgcatcaccagctttgtgtctggctttgccatcttcagcatcctgggctacatggcccacgagcacaaggtgaacattgaagatgtggccacagagggcgccggcctggtgttcatcctgtacccagaggccatcagcaccctgagcggcagcaccttctgggccgtggtgttctttgtgatgctgctggccctgggcctggacagctccatgggcggcatggaggccgtcatcaccggcctggctgatgacttccaggtgctgaagaggcacaggaagctgttcaccttcggcgtgaccttcagcaccttcctgctggccctcttctgcatcaccaagggcggcatctacgtgctgaccctgctggacacctttgctgctggcaccagcatcctgtttgctgtgctgatggaggccatcggcgtgtcctggttctatggagtggaccgcttcagcaatgacatccagcagatgatgggcttccggcccggcctgtactggaggctgtgctggaagtttgtgtccccagccttcctgctgtttgtggtggtggtgtccatcatcaacttcaagcccctgacctatgatgactacatcttccccccctgggccaactgggtgggctggggcatcgccctgagctccatggtgctggtgcccatctacgtgatctacaagttcctgagcacccagggcagcctgtgggagcggctggcctacggcatcaccccagaaaatgagcaccacctggtggcccagagggacatccggcagttccagctgcagcactggctggccatctag

SEQ ID NO: 170946 - DNA, 1845 bp, Artificial Sequence
  Description of Artificial Sequence: Synthetic coding sequence
atggatggcaaggtggccgtgcaggagtgtggccccccagctgtgtcctgggtgcctgaggagggggagaagctggaccaggaggatgaggaccaggtgaaggaccggggccagtggaccaacaagatggagtttgtgctgtctgtggccggggagatcatcggcctgggcaatgtgtggaggttcccctacctgtgctacaagaatggaggaggagccttcttcatcccctacttcatcttcttctttgtgtgtggcatccctgtgttcttcctggaggtggccctgggccagtacaccagccagggctctgtgacagcctggaggaagatctgccccctcttccagggcatcggcctggcctctgtggtgattgagagctacctgaatgtgtactacatcatcatcctggcctgggccctcttctacctgttcagcagcttcaccagcgagctgccctggaccacctgcaacaacttctggaacacagagcactgcacagacttcctgaaccacagcggggccggcaccgtgaccccatttgagaacttcaccagccctgtgatggagttctgggagcggcgggtgctgggcatcaccagcggcatccatgacctgggcagcctgcgctgggagctggccctgtgcctgctgctggcctgggtgatctgctacttctgcatctggaagggcgtgaagagcacaggcaaggtggtgtacttcaccgccaccttcccctacctgatgctggtgatcctgctgatccggggcgtgaccctgcccggggcctaccagggcatcatctactacctgaagccagacctcttccggctgaaggacccccaggtgtggatggatgctggcacccagatcttcttctcctttgccatctgccagggctgcctgacagccctgggcagctacaacaagtaccacaacaactgctacaaggactgcatcgccctgtgcttcctgaacagcgccaccagctttgtggccggctttgtggtgttcagcatcctgggcttcatgagccaggagcagggcgtgcccatcagcgaggtggccgagagcggccctggcctggccttcatcgccttccccaaggctgtgaccatgatgcccctgagccagctgtggagctgcctcttcttcatcatgctgatcttcctgggcctggacagccagtttgtgtgtgtggagtgcctggtgacagccagcattgacatgttcccccggcagctgaggaagagcggccggcgggagctgctgatcctgaccatcgctgtgatgtgctacctgattggcctcttcctggtgacagaaggaggcatgtacatcttccagctgtttgactactatgccagcagcggcatctgcctgctcttcctgagcctgtttgaggtggtgtgcatctcctgggtgtatggagctgaccgcttctatgacaacatcgaggacatgattggctaccggccctggcccctggtgaagatctcctggctgttcctgaccccaggcctgtgcctggccaccttcctgttcagcctgagcaagtacacccccctgaagtacaacaacgtgtatgtgtacccaccctggggctacagcatcggctggttcctggccctgagctccatggtgtgtgtgcccctgtttgtggtgatcaccctgctgaagacccggggccccttcaggaagaggctgcggcagctgatcaccccagacagcagcctgccccagcccaagcagcacccctgcctggatggcagcgctggcaggaactttggccccagccccacccgggagggcctgattgctggggagaaggagacccacctgtag

SEQ ID NO: 170947 - DNA, 1845 bp, Artificial Sequence; identical to SEQ ID NO: 170946
  Description of Artificial Sequence: Synthetic coding sequence

SEQ ID NO: 170948 - DNA, 1845 bp, Artificial Sequence; identical to SEQ ID NO: 170946
  Description of Artificial Sequence: Synthetic coding sequence

SEQ ID NO: 170949 - DNA, 1845 bp, Artificial Sequence; identical to SEQ ID NO: 170946
  Description of Artificial Sequence: Synthetic coding sequence

SEQ ID NO: 170950 - DNA, 1845 bp, Artificial Sequence; identical to SEQ ID NO: 170946
  Description of Artificial Sequence: Synthetic coding sequence

SEQ ID NO: 170951 - DNA, 441 bp, Artificial Sequence
  Description of Artificial Sequence: Synthetic coding sequence
atggatggcaaggtggccgtgcaggagtgtggccccccagctgtgtcctgggtgcctgaggagggggagaagctggaccaggaggatgaggaccaggtgaaggaccggggccagtggaccaacaagatggagtttgtgctgtctgtggccggggagatcatcggcctgggcaatgtgtggaggttcccctacctgtgctacaagaatggaggaggagccttcttcatcccctacttcatcttcttctttgtgtgtggcatccctgtgttcttcctggaggtggccctgggccagtacaccagccagggctctgtgacagcctggaggaagatctgccccctcttccagggcatcggcctggcctctgtggtgattgagagctacctgaatgtgtactacatcatcatcctggcctgggccctcttctacctgttctcctag

SEQ ID NO: 170952 - DNA, 1908 bp, Artificial Sequence
  Description of Artificial Sequence: Synthetic coding sequence
atggccaagaagtctgcagaaaatggcatctacagcgtgtctggagatgagaagaagggccccctgattgcccctggcccagatggagccccagccaagggagatggccctgtgggcctgggcaccccaggcggccgcctggccgtgcccccccgggagacctggacccggcagatggacttcatcatgagctgtgtgggctttgctgtgggcctgggcaatgtgtggaggttcccctacctgtgctacaagaatggaggcggcgtcttcctgatcccctacgtgctgattgccctggtgggcggcatccccatcttcttcctggagatcagcctgggccagttcatgaaggccggcagcatcaacgtgtggaacatctgccccctcttcaagggcctgggctacgcctccatggtgattgtgttctactgcaacacctactacatcatggtgctggcctggggcttctactacctggtgaagagcttcaccaccaccctgccctgggccacctgtggccacacctggaacaccccagactgtgtggagatcttcagacatgaggactgtgccaatgccagcctggccaacctgacctgtgaccagctggccgaccggcgcagccctgtgattgagttctgggagaacaaggtgctgcggctgagcggcggcctggaggtgcctggggccctgaactgggaggtgaccctgtgcctgctggcctgctgggtgctggtgtacttctgtgtgtggaagggcgtgaagagcacaggcaagatcgtgtacttcaccgccaccttcccctacgtggtgctggtggtgctgctggtgcggggcgtgctgctgcccggggccctggatggcatcatctactacctgaagccagactggagcaagctgggcagcccccaggtgtggattgatgctggcacccagatcttcttctcctatgccatcggcctgggcgccctgacagccctgggcagctacaaccgcttcaacaacaactgctacaaggatgccatcatcctggccctgatcaacagcggcaccagcttctttgctggctttgtggtgttcagcatcctgggcttcatggctgctgagcagggcgtgcacatcagcaaggtggccgagagcggccctggcctggccttcatcgcctaccccagggctgtgaccctgatgcctgtggcccccctgtgggccgccctcttcttcttcatgctgctgctgctgggcctggacagccagtttgtgggcgtggagggcttcatcaccggcctgctggacctgctgcctgccagctactacttccgcttccagcgggagatctctgtggccctgtgctgtgccctgtgctttgtgattgacctgtccatggtgacagatggcggcatgtatgtgttccagctgtttgactactacagcgccagcggcaccaccctgctgtggcaggccttctgggagtgtgtggtggtggcctgggtgtatggagctgaccgcttcatggatgacatcgcctgcatgattggctaccggccctgcccctggatgaagtggtgctggagcttcttcacccccctggtgtgcatgggcatcttcatcttcaacgtggtgtactatgagcccctggtgtacaacaacacctacgtgtacccctggtggggcgaggccatgggctgggcctttgccctgagctccatgctgtgtgtgcccctgcacctgctgggctgcctgctgcgggccaagggcaccatggccgagcgctggcagcacctgacccagcccatctggggcctgcaccacctggagtaccgggcccaggatgctgatgtgcggggcctgaccaccctgacccctgtgtctgagagcagcaaggtggtggtggtggagagcgtgatgtag

SEQ ID NO: 170953 - DNA, 2190 bp, Artificial Sequence
  Description of Artificial Sequence: Synthetic coding sequence
atgctgcccaccctgcagatccagggccctgctgcctttgcccctggggaccggggccctggccgccactgccccttccctgtgcccatcacccccactggagccctgctgcctgtgtctgacagctgtgacagcctggtggacctggtgtggcccagcgtgacctacctggccctgggcacccagagccgggtgtggccccaccccctgggcgcccctggccaggccggggagagccctgagcagaggcggcagtgcctggagctgtgggacatggccagcagcctgggggacaaggtgcccagggctgcctgtgggaagaggggccagacagtgtggcagctgcacctggcctgcctgtgcctggcccagttccacagccccccagcccagcccccacccctgagcagaagaggaggcggccctgaccctgaccccatcagccgcagcctgcccggcccccccaccccagccctgcccacccacagctacagcagccacagcccccgggccccccggctgctgagccccctgcggcgggccccccggggcagccctgccccccacagacatgccagcctgcagaccaatgaggccccccgggagctgccccactgcacctggccaggcctgcccggccgcagcctggcccccagcttcctgtggagggagccctggctgggcggccagtggggccccctgaacatcccagccaggaagggggacagaagacgctgggagtggggctgtgagggcggcggggccacagccagcgctgagcagcccggcccccagatcgtgtacttcaccgccaccttcccctacgtggtgctggtggtgctgctggtgcggggcgtgctgctgcccggggccctggatggcatcatctactacctgaagccagactggagcaagctgggcagcccccaggtgtggattgatgctggcacccagatcttcttctcctatgccatcggcctgggcgccctgacagccctgggcagctacaaccgcttcaacaacaactgctacaaggatgccatcatcctggccctgatcaacagcggcaccagcttctttgctggctttgtggtgttcagcatcctgggcttcatggctgctgagcagggcgtgcacatcagcaaggtggccgagagcggccctggcctggccttcatcgcctaccccagggctgtgaccctgatgcctgtggcccccctgtgggccgccctcttcttcttcatgctgctgctgctgggcctggacagccaggtgtgcatgggcctgtgggaccgggagcccggcggcggccggcgggagggctgccggcagggcaagggctggaggcgctgtggggcccggcctgagctgccctggccccagtttgtgggcgtggagggcttcatcaccggcctgctggacctgctgcctgccagctactacttccgcttccagcgggagatctctgtggccctgtgctgtgccctgtgcttcgtcatcgacctgtccatggtgacagatgtgtctggagtgggcggcctgcctgtgaccagcggcggccgcctgcccagcagcctgaccggcctgtgcccccagggcggcatgtatgtgttccagctgtttgactactacagcgccagcggcaccaccctgctgtggcaggccttctgggagtgtgtggtggtggcctgggtgtatggccgctcctggctgcgggccggcctgggagatggcggcggggagggccgcagccctgcctggccagccagccccagaggagctgaccgcttcatggatgacatcgcctgcatgattggctaccggccctgcccctggatgaagtggtgctggagcttcttcacccccctggtgtgcatgggcatcttcatcttcaacgtggtgtactatgagcccctggtgtacaacaacacctacgtgtacccctggtggggcgaggccatgggctgggcctttgccctgagctccatgctgtgtgtgcccctgcacctgctgggctgcctgctgcgggccaagggcaccatggccgagcgctggcagcacctgacccagcccatctggggcctgcaccacctggagtaccgggcccaggatgctgatgtgcggggcctgaccaccctgacccctgtgtctgagagcagcaaggtggtggtggtggagagcgtgatgtag

SEQ ID NO: 170954 - DNA, 471 bp, Artificial Sequence
  Description of Artificial Sequence: Synthetic coding sequence
ctgctgcacagccccacctggagctggagctgctgctggtgtgtggagtgctgctgcctggccccctggatggccagcttcaccatcagcagcctgaccggccagagctggggccccctgagccctggccagctgcagcccctgcagcagcagctgctgcagtgggaccagctgctgtgctggctgcggggcctgctgcaccctggcctgcacggctgcagagctggccgggcccacctgcagggcggccgggtgcgggagatctctgtggccctgtgctgtgccctgtgcttcgtcatcgacctgtccatggtgacagatggcggcatgtatgtgttccagctgtttgactactacagcgccagcggcaccaccctgctgtggcaggccttctgggagtgtgtggtggtggcctgggtgtatggagctgaccgcttcatggatgacatcgcctgcatgattggctactag

SEQ ID NO: 170955 - DNA, 339 bp, Artificial Sequence
  Description of Artificial Sequence: Synthetic coding sequence
tgattcagacatgaggactgtgccaatgccagcctggccaacctgacctgtgaccagctggccgacagaagaagccctgtgattgagttctgggagaacaaggtgctgcggctgagcggcggcctggaggtgcctggggccctgaactgggaggtgaccctgtgcctgctggcctgctgggtgctggtgtacttctgtgtgtggaagggcgtgaagagcacaggcaaggtgcccctggaggcctgcagcggggagggcggcagcgccctgggcgccggctgcctgtgccaggcccacctgtggcagcgggaggtgacccggcagagcctggccctgtag

SEQ ID NO: 170956 - DNA, 1563 bp, Artificial Sequence
  Description of Artificial Sequence: Synthetic coding sequence
atgaaggccggcagcatcaacgtgtggaacatctgccccctcttcaagggcctgggctacgcctccatggtgattgtgttctactgcaacacctactacatcatggtgctggcctggggcttctactacctggtgaagagcttcaccaccaccctgccctgggccacctgtggccacacctggaacaccccagactgtgtggagatcttcagacatgaggactgtgccaatgccagcctggccaacctgacctgtgaccagctggccgacagaagaagccctgtgattgagttctgggagaacaaggtgctgcggctgagcggcggcctggaggtgcctggggccctgaactgggaggtgaccctgtgcctgctggcctgctgggtgctggtgtacttctgtgtgtggaagggcgtgaagagcacaggcaagatcgtgtacttcaccgccaccttcccctacgtggtgctggtggtgctgctggtgcggggcgtgctgctgcccggggccctggatggcatcatctactacctgaagccagactggagcaagctgggcagcccccaggtgtggattgatgctggcacccagatcttcttctcctatgccatcggcctgggcgccctgacagccctgggcagctacaaccgcttcaacaacaactgctacaaggatgccatcatcctggccctgatcaacagcggcaccagcttctttgctggctttgtggtgttcagcatcctgggcttcatggctgctgagcagggcgtgcacatcagcaaggtggccgagagcggccctggcctggccttcatcgcctaccccagggctgtgaccctgatgcctgtggcccccctgtgggccgccctcttcttcttcatgctgctgctgctgggcctggacagccagtttgtgggcgtggagggcttcatcaccggcctgctggacctgctgcctgccagctactacttccgcttccagcgggagatctctgtggccctgtgctgtgccctgtgcttcgtcatcgacctgtccatggtgacagatggcggcatgtatgtgttccagctgtttgactactacagcgccagcggcaccaccctgctgtggcaggccttctgggagtgtgtggtggtggcctgggtgtatggagctgaccgcttcatggatgacatcgcctgcatgattggctaccggccctgcccctggatgaagtggtgctggagcttcttcacccccctggtgtgcatgggcatcttcatcttcaacgtggtgtactatgagcccctggtgtacaacaacacctacgtgtacccctggtggggcgaggccatgggctgggcctttgccctgagctccatgctgtgtgtgcccctgcacctgctgggctgcctgctgcgggccaagggcaccatggccgagcgctggcagcacctgacccagcccatctggggcctgcaccacctggagtaccgggcccaggatgctgatgtgcggggcctgaccaccctgacccctgtgtctgagagcagcaaggtggtggtggtggagagcgtgatgtag

SEQ ID NO: 170957 - DNA, 525 bp, Artificial Sequence
  Description of Artificial Sequence: Synthetic coding sequence
tgaattgatgctggcacccagatcttcttctcctatgccatcggcctgggcgccctgacagccctgggcagctacaaccgcttcaacaacaactgctacaacggcaccagcttctttgctggctttgtggtgttcagcatcctgggcttcatggctgctgagcagggcgtgcacatcagcaaggtggccgagagcggccctggcctggccttcatcgcctaccccagggctgtgaccctgatgcctgtggcccccctgtgggccgccctcttcttcttcatgctgctgctgctgggcctggacagccagtttgtgggcgtggagggcttcatcaccggcctgctggacctgctgcctgccagctactacttccgcttccagcgggagatctctgtggccctgtgctgtgccctgtgcttcgtcatcgacctgtccatggtgacagatggcggcatgtatgtgttccagctgtttgactactacagcgccagcggcaccaccctgctgtggcaggccttctggtag

SEQ ID NO: 170958 - DNA, 270 bp, Artificial Sequence
  Description of Artificial Sequence: Synthetic coding sequence
ggccgccaccaccctggcagccaccagcagtgggaccagctgctgtgctggctgcggggcctgctgcaccctggcctgcacggctgcagagctggccgggcccacctgcagggcggccgggtgcgggccggccctggcctgcaccggctgcctgctggctgccacgcagatgccagcggccccaccctgggctgccctgtgctgctgcatgctgtggccgcctggagccggcagcccggggtggagggcttcatcaccggcctgctgtag

SEQ ID NO: 170959 - DNA, 1863 bp, Artificial Sequence
  Description of Artificial Sequence: Synthetic coding sequence
atgagcaagagcaaatgttctgtgggcctgatgagctctgtggtggccccagccaaggagcccaatgctgtgggccccaaggaggtggagctgatcctggtgaaggagcagaatggagtgcagctgaccagcagcaccctgaccaacccccggcagagccctgtggaggcccaggaccgggagacctggggcaagaagattgacttcctgctgagcgtcatcggctttgctgtggacctggccaacgtgtggaggttcccctacctgtgctacaagaatggaggaggagccttcctggtgccctacctgctcttcatggtgattgctggcatgcccctcttctacatggagctggccctgggccagttcaaccgggagggcgctgctggggtgtggaagatctgccccatcctgaagggcgtgggcttcaccgtcatcctgatcagcctgtatgtgggcttcttctacaacgtcatcatcgcctgggccctgcactacctgttcagcagcttcaccacagagctgccctggatccactgcaacaacagctggaacagccccaactgcagtgatgcccaccctggggacagcagcggggacagcagcggcctgaatgacaccttcggcaccaccccagctgctgagtactttgagcggggcgtgctgcacctgcaccagagccacggcattgatgacctgggccccccacgctggcagctgacagcctgcctggtgctggtgattgtgctgctgtacttcagcctgtggaagggcgtgaagaccagcggcaaggtggtgtggatcacagccaccatgccctacgtggtgctgacagccctgctgctgcggggcgtgaccctgcccggggccattgatggcatccgggcctacctgtctgtggacttctaccgcctgtgtgaggcctctgtgtggattgatgctgccacccaggtgtgcttcagcctgggcgtgggcttcggcgtgctgattgccttcagcagctacaacaagttcaccaacaactgctacagagatgccatcgtgaccaccagcatcaacagcctgaccagcttcagcagcggctttgtggtgttctccttcctgggctacatggcccagaagcacagcgtgcccatcggagatgtggccaaggatggccctggcctcatcttcatcatctacccagaggccatcgccaccctgcccctgagcagcgcctgggccgtggtgttcttcatcatgctgctgaccctgggcatcgacagcgccatgggcggcatggagagcgtcatcaccggcctgattgatgagttccagctgctgcaccgccaccgggagctgttcaccctcttcatcgtgctggccaccttcctgctgagcctcttctgtgtgaccaacggcggcatctacgtgttcaccctgctggaccactttgctgctggcaccagcatcctgtttggagtgctgattgaggccatcggcgtggcctggttctatggagtgggccagttcagtgatgacatccagcagatgacaggccagaggcccagcctgtactggaggctgtgctggaagctggtgagcccctgcttcctgctgtttgtggtggtggtgtccatcgtgaccttccggcccccccactacggggcctacatcttcccagactgggccaatgccctgggctgggtgattgccaccagctccatggccatggtgcccatctatgctgcctacaagttctgcagcctgcccggcagcttccgggagaagctggcctatgccatcgcccctgagaaggaccgggagctggtggacagaggagaggtgcggcagttcaccctgcggcactggctgaaggtgtag

SEQ ID NO: 170960 - DNA, 1863 bp, Artificial Sequence; identical to SEQ ID NO: 170959
  Description of Artificial Sequence: Synthetic coding sequence

SEQ ID NO: 170961 - DNA, 1800 bp, Artificial Sequence
  Description of Artificial Sequence: Synthetic coding sequence
atggccaccaacggcagcaaggtggctgatggccagatcagcacagaggtgtctgaggcccctgtggccaatgacaagcccaagaccctggtggtgaaggtgcagaagaaggctgctgacctgcctgaccgggacacctggaagggccgctttgacttcctgatgagctgtgtgggctacgccatcggcctgggcaatgtgtggaggttcccctacctgtgtgggaagaatggaggaggagccttcctgatcccctacttcctgaccctcatctttgctggggtgcccctcttcctgctggagtgcagcctgggccagtacaccagcatcggcggcctgggcgtgtggaagctggcccccatgtttaaaggagtgggcctggccgctgctgtgctgtccttctggctgaacatctactacatcgtcatcatctcctgggccatctactacctgtacaacagcttcaccaccaccctgccctggaagcagtgtgacaacccctggaacacagaccgctgcttcagcaactacagcatggtgaacaccaccaacatgaccagcgctgtggtggagttctgggagaggaacatgcaccagatgacagatggcctggacaagccaggccagatccgctggcccctggccatcaccctggccatcgcctggatcctggtgtacttctgcatctggaagggcgtgggctggacaggcaaggtggtgtacttcagcgccacctacccctacatcatgctgatcatcctcttcttccggggcgtgaccctgcccggggccaaggagggcatcctcttctacatcacccccaacttcaggaagctgagtgacagcgaggtgtggctggatgctgccacccagatcttcttctcctatggcctgggcctgggcagcctcatcgccctgggcagctacaacagcttccacaacaacgtgtacagagacagcatcatcgtgtgctgcatcaacagctgcacctccatgtttgctggcttcgtcatcttcagcatcgtgggcttcatggcccacgtgaccaagaggagcattgctgatgtggccgccagcggccctggcctggccttcctggcctacccagaggccgtgacccagctgcccatcagccccctgtgggccatcctcttcttctccatgctgctgatgctgggcatcgacagccagttctgcaccgtggagggcttcatcacagccctggtggatgagtacccccggctgctgaggaacagaagagagctgttcatcgctgctgtgtgcatcatctcctacctgattggcctgagcaacatcacccagggcggcatctacgtgttcaagctgtttgactactacagcgccagcggcatgagcctgctcttcctggtgttctttgaatgtgtgtccatctcctggttctatggagtgaaccgcttctatgacaacatccaggagatggtgggcagccggccctgcatctggtggaagctgtgctggagcttcttcacccccatcatcgtggccggggtcttcatcttctctgctgtgcagatgacccccctgaccatgggcaactacgtgttccccaagtggggccagggcgtgggctggctgatggccctgagctccatggtgctgatccctggctacatggcctacatgttcctgaccctgaagggcagcctgaagcagaggatccaggtgatggtgcagcccagtgaagatattgtgcggccagaaaatggacctgagcagccccaggccggcagcagcaccagcaaggaggcctacatctag

SEQ ID NO: 170962 - DNA, 120 bp, Artificial Sequence
  Description of Artificial Sequence: Synthetic coding sequence
atggccaccaacggcagcaaggtggctgatggccagatcagcacagaggtgtctgaggcccctgtggccaatgacaagcccaagaccctggtggtgaaggtgcagaagaaggccgcctag

SEQ ID NO: 170963 - DNA, 1266 bp, Artificial Sequence
  Description of Artificial Sequence: Synthetic coding sequence
atggtgaacaccaccaacatgaccagcgctgtggtggagttctgggagaggaacatgcaccagatgacagatggcctggacaagccaggccagatccgctggcccctggccatcaccctggccatcgcctggatcctggtgtacttctgcatctggaagggcgtgggctggacaggcaaggtggtgtacttcagcgccacctacccctacatcatgctgatcatcctcttcttccggggcgtgaccctgcccggggccaaggagggcatcctcttctacatcacccccaacttcaggaagctgagtgacagcgaggtgtggctggatgctgccacccagatcttcttctcctatggcctgggcctgggcagcctcatcgccctgggcagctacaacagcttccacaacaacgtgtacagagacagcatcatcgtgtgctgcatcaacagctgcacctccatgtttgctggcttcgtcatcttcagcatcgtgggcttcatggcccacgtgaccaagaggagcattgctgatgtggccgccagcggccctggcctggccttcctggcctacccagaggccgtgacccagctgcccatcagccccctgtgggccatcctcttcttctccatgctgctgatgctgggcatcgacagccagttctgcaccgtggagggcttcatcacagccctggtggatgagtacccccggctgctgaggaacagaagagagctgttcatcgctgctgtgtgcatcatctcctacctgattggcctgagcaacatcacccagggcggcatctacgtgttcaagctgtttgactactacagcgccagcggcatgagcctgctcttcctggtgttctttgaatgtgtgtccatctcctggttctatggagtgaaccgcttctatgacaacatccaggagatggtgggcagccggccctgcatctggtggaagctgtgctggagcttcttcacccccatcatcgtggccggggtcttcatcttctctgctgtgcagatgacccccctgaccatgggcaactacgtgttccccaagtggggccagggcgtgggctggctgatggccctgagctccatggtgctgatccctggctacatggcctacatgttcctgaccctgaagggcagcctgaagcagaggatccaggtgatggtgcagcccagtgaagatattgtgcggccagaaaatggacctgagcagccccaggccggcagcagcaccagcaaggaggcctacatctag

SEQ ID NO: 170964 - DNA, 1899 bp, Artificial Sequence
  Description of Artificial Sequence: Synthetic coding sequence
atgacagctgagaaggccctgcccctgggcaatggcaaggctgctgaggaggcccgggagagcgaggcccctgggggcggctgcagcagcggcggggccgccccagcccggcacccccgggtgaagagggacaaggctgtgcatgagcggggccactggaacaacaaggtggagtttgtgctgtctgtggccggggagatcatcggcctgggcaatgtgtggaggttcccctacctgtgctacaagaatggaggaggagccttcctgatcccctacgtggtgttcttcatctgctgcggcatccctgtgttcttcctggagacagccctgggccagttcaccagcgagggcggcatcacctgctggaggaaggtgtgccccctgtttgagggcatcggctacgccacccaggtgattgaggcccacctgaatgtgtactacatcatcatcctggcctgggccatcttctacctgagcaactgcttcaccacagagctgccctgggccacctgtggccacgagtggaacacagagaactgtgtggagttccagaagctgaatgtgagcaactacagccacgtgtccctgcagaatgccaccagccctgtgatggagttctgggagcaccgggtgctggccatcagtgatggcatcgagcacatcggcaacctgcgctgggagctggccctgtgcctgctggccgcctggaccatctgctacttctgcatctggaagggcaccaagagcacaggcaaggtggtgtatgtgacagccaccttcccctacatcatgctgctgatcctgctgatccggggcgtgaccctgcccggggccagcgagggcatcaagttctacctgtacccagacctgagccggctgagtgacccccaggtgtgggtggatgctggcacccagatcttcttctcctatgccatctgcctgggctgcctgacagccctgggcagctacaacaactacaacaacaactgctacagagactgcatcatgctgtgctgcctgaacagcggcaccagctttgtggccggctttgccatcttctctgtgctgggcttcatggcctatgagcagggcgtgcccatcgccgaggtggccgagagcggccctggcctggccttcatcgcctaccccaaggctgtgaccatgatgcccctgagccccctgtgggccaccctcttcttcatgatgctgatcttcctgggcctggacagccagtttgtgtgtgtggagagcctggtgacagctgtggtggacatgtaccccaaggtgttcagaagaggctacagaagagagctgctgatcctggccctgagcgtcatctcctacttcctgggcctggtgatgctgacagagggcggcatgtacatcttccagctgtttgacagctatgctgccagcggcatgtgcctgctgtttgtggccatctttgagtgcatctgcatcggctgggtgtatggcagcaaccgcttctatgacaacatcgaggacatgattggctaccggccccccagcctcatcaagtggtgctggatgatcatgaccccaggcatctgtgccggcatcttcatcttcttcctgatcaagtacaagcccctgaagtacaacaacatctacacctacccagcctggggctatggaattggctggctgatggccctgagctccatgctgtgcatccccctgtggatctgcatcaccgtgtggaagacagagggcaccctgcctgagaagctgcagaagctgaccacccccagcacagacctgaagatgaggggcaagctgggcgtgagccccaggatggtgacagtgaatgactgtgatgccaagctgaagagtgatggcaccatcgccgccatcacagagaaggagacccacttctag

SEQ ID NO: 170965 - DNA, 627 bp, Artificial Sequence
  Description of Artificial Sequence: Synthetic coding sequence
atgacagctgagaaggccctgcccctgggcaatggcaaggctgctgaggaggcccgggagagcgaggcccctgggggcggctgcagcagcggcggggccgccccagcccggcacccccgggtgaagagggacaaggctgtgcatgagcggggccactggaacaacaaggtggagtttgtgctgtctgtggccggggagatcatcggcctgggcaatgtgtggaggttcccctacctgtgctacaagaatggaggaggagccttcctgatcccctacgtggtgttcttcatctgctgcggcatccctgtgttcttcctggagacagccctgggccagttcaccagcgagggcggcatcacctgctggaggaaggtgtgccccctgtttgagggcatcggctacgccacccaggtgattgaggcccacctgaatgtgtactacatcatcatcctggcctgggccatcttctacctgagcaactgcttcaccacagagctgccctgggccacctgtggccacgagtggaacacagagaactgtgtggagttccagaagctgaatgtgagcaactacagccacgtgtccctgcagaatgccaccagccctgtgatggagttctgggagtag

SEQ ID NO: 170966 - DNA, 2394 bp, Artificial Sequence
  Description of Artificial Sequence: Synthetic coding sequence
atggactgcagcgcccccaaggagatgaacaagctgcctgccaacagccctgaggccgctgctgcccagggccacccagatggcccctgtgcccccaggaccagccctgagcaggagctgcctgctgctgctgcccctcctccaccccgggtgcccaggtctgccagcactggagcccagaccttccagagcgcagatgcccgggcctgtgaggccgagaggcctggggtgggcagctgcaagctgagcagcccccgggcccaggccgccagcgctgccctgcgggacctgcgggaggcccagggcgcccaggccagccccccacctggcagcagcggccctggaaatgccctgcactgcaagatccccttcctgcggggcccagaaggagatgccaacgtgtctgtgggcaagggcaccctggagaggaacaacacccctgtggtgggctgggtgaacatgagccagagcacagtggtgctggccacagatggcatcacctctgtgctgcccggctctgtggccaccgtggccacccaggaggatgagcagggagatgagaacaaggcccggggcaactggagcagcaagctggacttcatcctgtccatggtgggctatgctgtgggcctgggcaatgtgtggaggttcccctacctggccttccagaatggaggaggagccttcctgatcccctacctgatgatgctggccctggccggcctgcccatcttcttcctggaggtgtccctgggccagtttgccagccagggccctgtgtctgtgtggaaggccatcccagccctgcagggctgcggcatcgccatgctgatcatctctgtgctgattgccatctactacaacgtcatcatctgctacaccctcttctacctgtttgccagctttgtgtctgtgctgccctggggcagctgcaacaacccctggaacaccccagagtgcaaggacaagaccaagctgctgctggacagctgtgtgatcagtgaccaccccaagatccagatcaagaacagcaccttctgcatgacagcctacccaaatgtgaccatggtgaacttcaccagccaggccaacaagacctttgtgtctggcagcgaggagtacttcaagtactttgtgctgaagatctctgctggcatcgagtacccaggagagatccgctggcccctggccctgtgcctcttcctggcctgggtgattgtgtatgccagcctggccaagggcatcaagaccagcggcaaggtggtgtacttcaccgccaccttcccctacgtggtgctggtgatcctgctgatccggggcgtgaccctgcccggggccggggccggcatctggtacttcatcacccccaagtgggagaagctgacagatgccaccgtgtggaaggatgctgccacccagatcttcttcagcctgtctgctgcctggggcggcctcatcaccctgagcagctacaacaagttccacaacaactgctacagagacaccctcatcgtgacctgcaccaacagcgccaccagcatctttgctggcttcgtcatcttcagcgtcatcggcttcatggccaatgaaaggaaggtgaacattgaaaatgtggccgaccagggccctggcatcgcctttgtggtgtacccagaggccctgacccggctgcccctgagccccttctgggccatcatcttcttcctgatgctgctgaccctgggcctggacaccatgtttgccaccatcgagaccatcgtgaccagcatcagtgatgagttccccaagtacctgcggacccacaagcctgtgttcaccctgggctgctgcatctgcttcttcatcatgggcttccccatgatcacccagggcggcatctacatgttccagctggtggacacctacgccgccagctatgccctggtgatcatcgccatctttgagctggtgggcatctcctatgtgtatggcctgcagcgcttctgtgaagatattgagatgatgattggcttccagcccaacatcttctggaaggtgtgctgggcctttgtgacccccaccatcctgaccttcatcctgtgcttctccttctaccagtgggagcccatgacctacggcagctaccgctaccccaactggagcatggtgctgggctggctgatgctggcctgcagcgtcatctggatccccatcatgtttgtgatcaagatgcacctggcccctggccgcttcatcgagcggctgaagctggtgtgcagcccccagcctgactggggccccttcctggcccagcacagaggagagcgctacaagaacatgattgaccccctgggcaccagcagcctgggcctgaagctgcctgtgaaggacctggagctgggcacccagtgctag

SEQ ID NO: 170967 - DNA, 1959 bp, Artificial Sequence
  Description of Artificial Sequence: Synthetic coding sequence
atgtctggaggagacacccgggccgccatcgcccggcccaggatggctgctgcccacggccctgtggcccccagcagccctgagcagaatggagctgtgcccagcgaggccaccaagagggaccagaacctgaagaggggcaactggggcaaccagattgaatttgtgctgacctctgtgggctatgctgtgggcctgggcaatgtgtggaggttcccctacctgtgctacagaaatggaggaggagccttcatgttcccctacttcatcatgctgatcttctgtggcatccccctcttcttcatggagctgagctttggccagtttgccagccagggctgcctgggcgtgtggaggatcagccccatgtttaaaggagtgggctacggcatgatggtggtgtccacctacatcggcatctactacaacgtggtgatctgcatcgccttctactacttcttcagctccatgacccacgtgctgccctgggcctactgcaacaacccctggaacacccatgactgtgccggcgtgctggatgccagcaacctgaccaacggcagcaggcctgctgccctgcccagcaacctgagccacctgctgaaccacagcctgcagaggaccagccccagcgaggagtactggaggctgtatgtgctgaagctgagtgatgacatcggcaactttggagaggtgcggctgcccctgctgggctgcctgggcgtgtcctggctggtggtgttcctgtgcctgatccggggcgtgaagagcagcggcaaggtggtgtacttcaccgccaccttcccctacgtggtgctgaccatcctgtttgtgcggggcgtgaccctggagggcgcctttgatggcatcatgtactacctgaccccccagtgggacaagatcctggaggccaaggtgtggggagatgctgccagccagatcttctacagcctgggctgtgcctggggcggcctcatcaccatggccagctacaacaagttccacaacaactgctacagagacagcgtcatcatcagcatcaccaactgtgccacctctgtgtatgccggcttcgtcatcttcagcatcctgggcttcatggccaaccacctgggcgtggatgtgtcccgggtggccgaccacggccctggcctggcctttgtggcctacccagaggccctgaccctgctgcccatcagccccctgtggagcctgctcttcttcttcatgctgatcctgctgggcctgggcacccagttctgcctgctggagaccctggtgacagccatcgtggatgaggtgggcaatgagtggatcctgcagaagaagacctacgtgaccctgggcgtggccgtggccggcttcctgctgggcatccccctgaccagccaggccggcatctactggctgctgctgatggacaactatgctgccagcttcagcctggtggtgatcagctgcatcatgtgtgtggccatcatgtacatctacggccacaggaactacttccaggacatccagatgatgctgggcttccccccacccctcttcttccagatctgctggaggtttgtgtccccagccatcatcttcttcatcctggtgttcaccgtcatccagtaccagcccatcacctacaaccactaccagtacccaggctgggccgtggccatcggcttcctgatggccctgagctctgtgctgtgcatccccctgtatgccatgttccggctgtgcaggacagatggagacaccctgctgcagaggctgaagaatgccaccaagcccagccgggactggggccctgccctgctggagcacaggacaggccgctatgcccccaccatcgcccccagcccagaagatggctttgaggtgcagcccctgcacccagacaaggcccagatccccatcgtgggcagcaatggcagcagccggctgcaggacagccgcatctag

SEQ ID NO: 170968 - DNA, 2121 bp, Artificial Sequence
  Description of Artificial Sequence: Synthetic coding sequence
atgtctggaggagacacccgggccgccatcgcccggcccaggatggctgctgcccacggccctgtggcccccagcagccctgagcaggtgaccctgctgcctgtgcagaggagcttcttcctgccccccttcagcggggccacccccagcaccagcctggccgagagcgtgctgaaggtgtggcacggggcctacaacagcggcctgctgccccagctgatggcccagcacagcctggccatggcccagaatggagctgtgcccagcgaggccaccaagagggaccagaacctgaagaggggcaactggggcaaccagattgaatttgtgctgacctctgtgggctatgctgtgggcctgggcaatgtgtggaggttcccctacctgtgctacagaaatggaggaggagccttcatgttcccctacttcatcatgctgatcttctgtggcatccccctcttcttcatggagctgagctttggccagtttgccagccagggctgcctgggcgtgtggaggatcagccccatgtttaaaggagtgggctacggcatgatggtggtgtccacctacatcggcatctactacaacgtggtgatctgcatcgccttctactacttcttcagctccatgacccacgtgctgccctgggcctactgcaacaacccctggaacacccatgactgtgccggcgtgctggatgccagcaacctgaccaacggcagcaggcctgctgccctgcccagcaacctgagccacctgctgaaccacagcctgcagaggaccagccccagcgaggagtactggaggctgtatgtgctgaagctgagtgatgacatcggcaactttggagaggtgcggctgcccctgctgggctgcctgggcgtgtcctggctggtggtgttcctgtgcctgatccggggcgtgaagagcagcggcaaggtggtgtacttcaccgccaccttcccctacgtggtgctgaccatcctgtttgtgcggggcgtgaccctggagggcgcctttgatggcatcatgtactacctgaccccccagtgggacaagatcctggaggccaaggtgtggggagatgctgccagccagatcttctacagcctgggctgtgcctggggcggcctcatcaccatggccagctacaacaagttccacaacaactgctacagagacagcgtcatcatcagcatcaccaactgtgccacctctgtgtatgccggcttcgtcatcttcagcatcctgggcttcatggccaaccacctgggcgtggatgtgtcccgggtggccgaccacggccctggcctggcctttgtggcctacccagaggccctgaccctgctgcccatcagccccctgtggagcctgctcttcttcttcatgctgatcctgctgggcctgggcacccagttctgcctgctggagaccctggtgacagccatcgtggatgaggtgggcaatgagtggatcctgcagaagaagacctacgtgaccctgggcgtggccgtggccggcttcctgctgggcatccccctgaccagccaggccggcatctactggctgctgctgatggacaactatgctgccagcttcagcctggtggtgatcagctgcatcatgtgtgtggccatcatgtacatctacggccacaggaactacttccaggacatccagatgatgctgggcttccccccacccctcttcttccagatctgctggaggtttgtgtccccagccatcatcttcttcatcctggtgttcaccgtcatccagtaccagcccatcacctacaaccactaccagtacccaggctgggccgtggccatcggcttcctgatggccctgagctctgtgctgtgcatccccctgtatgccatgttccggctgtgcaggacagatggagacaccctgctgcagaggctgaagaatgccaccaagcccagccgggactggggccctgccctgctggagcacaggacaggccgctatgcccccaccatcgcccccagcccagaagatggctttgaggtgcagcccctgcacccagacaaggcccagatccccatcgtgggcagcaatggcagcagccggctgcaggacagccgcatctag

SEQ ID NO: 170969 - DNA, 1725 bp, Artificial Sequence
  Description of Artificial Sequence: Synthetic coding sequence
atgttcccctacttcatcatgctgatcttctgtggcatccccctcttcttcatggagctgagctttggccagtttgccagccagggctgcctgggcgtgtggaggatcagccccatgtttaaaggagtgggctacggcatgatggtggtgtccacctacatcggcatctactacaacgtggtgatctgcatcgccttctactacttcttcagctccatgacccacgtgctgccctgggcctactgcaacaacccctggaacacccatgactgtgccggcgtgctggatgccagcaacctgaccaacggcagcaggcctgctgccctgcccagcaacctgagccacctgctgaaccacagcctgcagaggaccagccccagcgaggagtactggaggctgtatgtgctgaagctgagtgatgacatcggcaactttggagaggtgcggctgcccctgctgggctgcctgggcgtgtcctggctggtggtgttcctgtgcctgatccggggcgtgaagagcagcggcaaggtggtgtacttcaccgccaccttcccctacgtggtgctgaccatcctgtttgtgcggggcgtgaccctggagggcgcctttgatggcatcatgtactacctgaccccccagtgggacaagatcctggaggccaaggtgtggggagatgctgccagccagatcttctacagcctgggctgtgcctggggcggcctcatcaccatggccagctacaacaagttccacaacaactgctacagagacagcgtcatcatcagcatcaccaactgtgccacctctgtgtatgccggcttcgtcatcttcagcatcctgggcttcatggccaaccacctgggcgtggatgtgtcccgggtggccgaccacggccctggcctggcctttgtggcctacccagaggccctgaccctgctgcccatcagccccctgtggagcctgctcttcttcttcatgctgatcctgctgggcctgggcacccagttctgcctgctggagaccctggtgacagccatcgtggatgaggtgggcaatgagtggatcctgcagaagaagacctacgtgaccctgggcgtggccgtggccggcttcctgctgggcatccccctgaccagccaggccggcatctactggctgctgctgatggacaactatgctgccagcttcagcctggtggtgatcagctgcatcatgtgtgtggccatcatgtacatctacggccacaggaactacttccaggacatccagatgatgctgggcttccccccacccctcttcttccagatctgctggaggtttgtgtccccagccatcatcttcctgcaggcccaggtgcaccggcggctgccccagaaccccctgcactttgccagcctgcctgagagaaatgtgctgctgcaccagctgccccagagaggaggagtgcctgagcatgacccccccaccccacccagccctgcccggacctacggcccccaggtgcgggtgcgggaggtgccccgggcccggcggcagaggagccccaacccagcccccctgtgggccccacccagccccaagccccacccctgcagcgctgctggccccctgggctgggactgccccttcaggaactgccagagcctggccctgagcagcgcccggctgctggccgacagtgatgctgggggccctgagacccggcagtgggagcccggcccctag

SEQ ID NO: 170970 - DNA, 1902 bp, Artificial Sequence
  Description of Artificial Sequence: Synthetic coding sequence
atggtgggcaagggggccaagggcatgctgaatggagctgtgcccagcgaggccaccaagagggaccagaacctgaagaggggcaactggggcaaccagatcgagtttgtgctgacctctgtgggctatgctgtgggcctgggcaatgtgtggaggttcccctacctgtgctacagaaatggaggaggagccttcatgttcccctacttcatcatgctgatcttctgtggcatccccctcttcttcatggagctgagctttggccagtttgccagccagggctgcctgggcgtgtggaggatcagccccatgttcaagggcgtgggctacggcatgatggtggtgtccacctacatcggcatctactacaacgtggtgatctgcatcgccttctactacttcttcagctccatgacccacgtgctgccctgggcctactgcaacaacccctggaacacccatgactgtgccggcgtgctggatgccagcaacctgaccaacggcagcaggcctgctgccctgcccagcaacctgagccacctgctgaaccacagcctgcagaggaccagccccagcgaggagtactggaggctgtatgtgctgaagctgagtgatgacatcggcaactttggagaggtgcggctgcccctgctgggctgcctgggcgtgtcctggctggtggtgttcctgtgcctgatccggggcgtgaagagcagcggcaaggtggtgtacttcaccgccaccttcccctacgtggtgctgaccatcctgtttgtgcggggcgtgaccctggagggcgcctttgatggcatcatgtactacctgaccccccagtgggacaagatcctggaggccaaggtgtggggagatgctgccagccagatcttctacagcctgggctgtgcctggggcggcctcatcaccatggccagctacaacaagttccacaacaactgctacagagattctgtcatcatcagcatcaccaactgtgccacctctgtgtatgccggctttgtgatcttcagcatcctgggcttcatggccaaccacctgggcgtggatgtgtcccgggtggccgaccacggccctggcctggcctttgtggcctacccagaggccctgaccctgctgcccatcagccccctgtggagcctgctcttcttcttcatgctgatcctgctgggcctgggcacccagttctgcctgctggagaccctggtgacagccatcgtggatgaggtgggcaatgagtggatcctgcagaagaagacctacgtgaccctgggcgtggccgtggccggcttcctgctgggcatccccctgaccagccaggccggcatctactggctgctgctgatggacaactatgctgccagcttcagcctggtggtgatcagctgcatcatgtgtgtggccatcatgtacatctacggccacaggaactacttccaggacatccagatgatgctgggcttccccccacccctcttcttccagatctgctggaggtttgtgtccccagccatcatcttcttcatcctggtgttcaccgtcatccagtaccagcccatcacctacaaccactaccagtacccaggctgggccgtggccatcggcttcctgatggccctgagctctgtgctgtgcatccccctgtatgccatgttccggctgtgcaggacagatggagacaccctgctgcagaggctgaagaatgccaccaagcccagccgggactggggccctgccctgctggagcacaggacaggccgctatgcccccaccatcgcccccagcccagaagatggctttgaggtgcagcccctgcacccagacaaggcccagatccccatcgtgggcagcaatggcagcagccggctgcaggacagccgcatctag

SEQ ID NO: 170971 - DNA, 1569 bp, Artificial Sequence
  Description of Artificial Sequence: Synthetic coding sequence
atgatggtggtgtccacctacatcggcatctactacaacgtggtgatctgcatcgccttctactacttcttcagctccatgacccacgtgctgccctgggcctactgcaacaacccctggaacacccatgactgtgccggcgtgctggatgccagcaacctgaccaacggcagcaggcctgctgccctgcccagcaacctgagccacctgctgaaccacagcctgcagaggaccagccccagcgaggagtactggaggctgtatgtgctgaagctgagtgatgacatcggcaactttggagaggtgcggctgcccctgctgggctgcctgggcgtgtcctggctggtggtgttcctgtgcctgatccggggcgtgaagagcagcggcaaggtggtgtacttcaccgccaccttcccctacgtggtgctgaccatcctgtttgtgcggggcgtgaccctggagggcgcctttgatggcatcatgtactacctgaccccccagtgggacaagatcctggaggccaaggtgtggggagatgctgccagccagatcttctacagcctgggctgtgcctggggcggcctcatcaccatggccagctacaacaagttccacaacaactgctacagagacagcgtcatcatcagcatcaccaactgtgccacctctgtgtatgccggcttcgtcatcttcagcatcctgggcttcatggccaaccacctgggcgtggatgtgtcccgggtggccgaccacggccctggcctggcctttgtggcctacccagaggccctgaccctgctgcccatcagccccctgtggagcctgctcttcttcttcatgctgatcctgctgggcctgggcacccagttctgcctgctggagaccctggtgacagccatcgtggatgaggtgggcaatgagtggatcctgcagaagaagacctacgtgaccctgggcgtggccgtggccggcttcctgctgggcatccccctgaccagccaggccggcatctactggctgctgctgatggacaactatgctgccagcttcagcctggtggtgatcagctgcatcatgtgtgtggccatcatgtacatctacggccacaggaactacttccaggacatccagatgatgctgggcttccccccacccctcttcttccagatctgctggaggtttgtgtccccagccatcatcttcttcatcctggtgttcaccgtcatccagtaccagcccatcacctacaaccactaccagtacccaggctgggccgtggccatcggcttcctgatggccctgagctctgtgctgtgcatccccctgtatgccatgttccggctgtgcaggacagatggagacaccctgctgcagaggctgaagaatgccaccaagcccagccgggactggggccctgccctgctggagcacaggacaggccgctatgcccccaccatcgcccccagcccagaagatggctttgaggtgcagcccctgcacccagacaaggcccagatccccatcgtgggcagcaatggcagcagccggctgcaggacagccgcatctag

SEQ ID NO: 170972 - DNA, 405 bp, Artificial Sequence
  Description of Artificial Sequence: Synthetic coding sequence
atgtctggaggagacacccgggccgccatcgcccggcccaggatggctgctgcccacggccctgtggcccccagcagccctgagcagaatggagctgtgcccagcgaggccaccaagagggaccagaacctgaagaggggcaactggggcaaccagattgaatttgtgctgacctctgtgggctatgctgtgggcctgggcaatgtgtggaggttcccctacctgtgctacagaaatggaggaggagccttcatgttcccctacttcatcatgctgatcttctgtggcatccccctcttcttcatggagctgagctttggccagtttgccagccagggctgcctgggcgtgtggaggatcagccccatgtttaaaggagtgggctacggcatgatggtggtgtag

SEQ ID NO: 170973 - DNA, 1161 bp, Artificial Sequence
  Description of Artificial Sequence: Synthetic coding sequence
atgttcccctacttcatcatgctgatcttctgtggcatccccctcttcttcatggagctgagctttggccagtttgccagccagggctgcctgggcgtgtggaggatcagccccatgtttaaaggagtgggctacggcatgatggtggtgtccacctacatcggcatctactacaacgtggtgatctgcatcgccttctactacttcttcagctccatgacccacgtgctgccctgggcctactgcaacaacccctggaacacccatgactgtgccggcgtgctggatgccagcaacctgaccaacggcagcaggcctgctgccctgcccagcaacctgagccacctgctgaaccacagcctgcagaggaccagccccagcgaggagtactggaggctgtatgtgctgaagctgagtgatgacatcggcaactttggagaggtgcggctgcccctgctgggctgcctgggcgtgtcctggctggtggtgttcctgtgcctgatccggggcgtgaagagcagcggcaaggtggtgtacttcaccgccaccttcccctacgtggtgctgaccatcctgtttgtgcggggcgtgaccctggagggcgcctttgatggcatcatgtactacctgaccccccagtgggacaagatcctggaggccaaggtgtggggagatgctgccagccagatcttctacagcctgggctgtgcctggggcggcctcatcaccatggccagctacaacaagttccacaacaactgctacagagacagcgtcatcatcagcatcaccaactgtgccacctctgtgtatgccggcttcgtcatcttcagcatcctgggcttcatggccaaccacctgggcgtggatgtgtcccgggtggccgaccacggccctggcctggcctttgtggcctacccagaggccctgaccctgctgcccatcagccccctgtggagcctgctcttcttcttcatgctgatcctgctgggcctgggcacccagttctgcctgctggagaccctggtgacagccatcgtggatgaggtgggcaatgagtggatcctgcagaagaagacctacgtgaccctgggcgtggccgtggccggcttcctgctgggcatccccctgaccagccaggccagcatcggctgctgctag

SEQ ID NO: 170974 - DNA, 1050 bp, Artificial Sequence
  Description of Artificial Sequence: Synthetic coding sequence
atgggagacatgggagacccccccaagaagaagaggctcatcagcctgtgtgtgggctgcggcaaccagatccatgaccagtacatcctgcgggtgtccccagacctggagtggcacgccgcctgcctgaagtgtgccgagtgcaaccagtacctggatgagagctgcacctgctttgtgagagatggcaagacctactgcaagagggactacatccggctgtatggcatcaagtgtgccaagtgcagcatcggcttcagcaagaatgactttgtgatgagggcccggagcaaggtgtaccacatcgagtgcttccgctgtgtggcctgcagccggcagctgatccctggagatgaatttgccctgcgggaggatggcctcttctgcagagctgaccatgatgtggtggagcgggccagcctgggcgctggggaccccctgagccccctgcacccagcccggcccctgcagatggctgctgagcccatcagcgcccggcagcctgccctgcggccccacgtgcacaagcagcctgagaagaccaccagggtgaggacagtgctgaatgagaagcagctgcacaccctgcggacctgctatgctgccaaccccaggccagatgccctgatgaaggagcagctggtggagatgacaggcctgagccccagggtcatccgggtgtggttccagaacaagcgctgcaaggacaagaagaggagcatcatgatgaagcagctgcagcagcagcagcccaatgacaagaccaacatccagggcatgacaggcacccccatggtggccgccagccctgagagacatgatggcggcctgcaggccaaccctgtggaggtgcagagctaccagcccccctggaaggtgctgagtgactttgccctgcagagcgacatcgaccagcctgccttccagcagctggtgaacttcagcgagggcggccctggcagcaacagcacaggcagcgaggtggcctccatgagcagccagctgcctgacacccccaacagcatggtggccagccccatcgaggcctag

SEQ ID NO: 170975 - DNA, 2283 bp, Artificial Sequence
  Description of Artificial Sequence: Synthetic coding sequence
atgctgagtgatgaccacgtgaatgagatcatcatccaggtggagaatgtgtcctctggagtgcagagccaccccagcagcaaccagatcttccaggagaaggtgctgctggacagcagcatcaacatggtgctgagcatcagtgacattgatgtgattgacagccagacagtgtccaagagaaatgaccagaagggcaaccaggtgctgcgcttcagcaccagcctgaatgaatccatgagccagaccctgcacagcctggagtgcatgggcatcgacaccccaggcagcagccatgaaacagtgcagggccagaagctgattgccagcctcatccccatgaccagccgggaccgcatcaaggccatccggaaccagcccaggaccatggaggagaagaggaacctgaggaagatcgtggacaaggagaagagcaagcagacccaccgcatcctgcagctgaactgctgcatccagtgcctgaacagcatcagccgggcctacagaagaagcaagaacagcctgtctgagatcctgaacagcatcagcctgtggcagaagaccctgaagatcatcggcggcaagtttggcacctctgtgctgagctacttcaacttcctgcgctggctgctgaagttcaacatcttctccttcatcctgaacttctccttcatcatcatcccccagttcaccgtggccaagaagaacaccctgcagttcaccggcctggagttcttcaccggggtgggctacttccgggacacagtgatgtactacggcttctacaccaacagcaccatccagcacggcaacagcggggccagctacaacatgcagctggcctacatcttcaccatcggggcctgcctgaccacctgcttcttcagcctgctcttctccatggccaagtacttcaggaacaacttcatcaacccccacatctacagcggcggcatcaccaagctgatcttctgctgggacttcaccgtgacccatgagaaggctgtgaagctgaagcagaagaacctgagcacagagatccgggagaacctgtctgagctgcggcaggagaacagcaagctgaccttcaaccagctgctgacccgcttcagcgcctacatggtggcctgggtggtgtccactggagtggccatcgcctgctgtgccgctgtgtactacctggccgagtacaacctggagttcctgaagacccacagcaaccctggagctgtgctgctgctgccctttgtggtgtcctgcatcaacctggccgtgccctgcatctacagcatgttccggctggtggagagatatgagatgcccaggcatgaggtgtatgtgctgctgatccggaacatcttcctgaagatcagcatcatcggcatcctgtgctactactggctgaacacagtggccctgagcggggaggagtgctgggagaccctgattggccaggacatctaccgcctgctgctgatggactttgtgttcagcctggtgaacagcttcctgggggagttcctgcggcgcatcatcggcatgcagctgatcaccagcctgggcctgcaggagtttgatattgccagaaatgtgctggagctgatctatgcccagaccctggtgtggattggcatcttcttctgccccctgctgcccttcatccagatgatcatgctgttcatcatgttctacagcaagaacatcagcctgatgatgaacttccagccccccagcaaggcctggagggccagccagatgatgaccttcttcatcttcctgctcttcttccccagcttcaccggggtgctgtgcaccctggccatcaccatctggaggctgaagcccagcgctgactgtggccccttccggggcctgcccctcttcatccacagcatctacagctggattgacaccctgagcaccaggcctggctacctgtgggtggtgtggatctacagaaacctgattggctctgtgcacttcttcttcatcctgaccctcatcgtgctgatcatcacctacctgtactggcagatcacagagggcaggaagatcatgatccggctgctgcacgagcagatcatcaatgaaggcaaggacaagatgttcctgattgagaagctgatcaagctgcaggacatggagaagaaggccaaccccagcagcctggtgctggagcggcgggaggtggagcagcagggcttcctgcacctgggggagcatgatggcagcctggacctgcggagccgccgctctgtgcaggagggcaacccccgggcctag

SEQ ID NO: 170976 - DNA, 1854 bp, Artificial Sequence
  Description of Artificial Sequence: Synthetic coding sequence
atgctgctggccaggatgaacccccaggtgcagccagaaaataatggagctgacaccggccctgagcagcccctgcgggccaggaagacagctgagctgctggtggtgaaggagagaaatggagtgcagtgcctgctggcccccagagatggagatgcccagccccgggagacctggggcaagaagattgacttcctgctgtctgtggtgggctttgctgtggacctggccaacgtgtggaggttcccctacctgtgctacaagaatggaggaggagccttcctgatcccctacaccctcttcctgatcatcgccggcatgcccctcttctacatggagctggccctgggccagtacaaccgggagggcgccgccaccgtgtggaagatctgccccttcttcaagggcgtgggctacgccgtcatcctgattgccctgtatgtgggcttctactacaacgtcatcatcgcctggagcctgtactacctgttcagcagcttcaccctgaacctgccctggacagactgtggccacacctggaacagccccaactgcacagaccccaagctgctgaatggatctgtgctgggcaaccacaccaagtacagcaagtacaagttcaccccagctgctgagttctatgaaagaggagtgctgcacctgcacgagagcagcggcatccatgacatcggcctgccccagtggcagctgctgctgtgcctgatggtggtggtgattgtgctgtacttcagcctgtggaagggcgtgaagaccagcggcaaggtggtgtggatcacagccaccctgccctactttgtgctgtttgtgctgctggtgcacggcgtgaccctgcccggggccagcaatggcatcaatgcctacctgcacatcgacttctaccgcctgaaggaggccaccgtgtggattgatgctgccacccagatcttcttcagcctgggcgccggctttggagtgctgattgcctttgccagctacaacaagtttgacaacaactgctacagagatgccctgctgaccagcagcatcaactgcatcaccagctttgtgtctggctttgccatcttcagcatcctgggctacatggcccacgagcacaaggtgaacattgaagatgtggccacagaaggagctggcctggtgttcatcctgtacccagaggccatcagcaccctgagcggcagcaccttctgggccgtggtgttctttgtgatgctgctggccctgggcctggacagctccatgggcggcatggaggccgtcatcaccggcctggctgatgacttccaggtgctgaagaggcacaggaagctgttcacctttggagtgaccttcagcaccttcctgctggccctcttctgcatcaccaagggcggcatctacgtgctgaccctgctggacacctttgctgctggcaccagcatcctgtttgctgtgctgatggaggccatcggcgtgtcctggttctacggcgtggaccgcttcagcaatgacatccagcagatgatgggcttccggcccggcctgtactggaggctgtgctggaagtttgtgtccccagccttcctgctgtttgtggtggtggtgtccatcatcaacttcaagcccctgacctatgatgactacatcttccccccctgggccaactgggtgggctggggcatcgccctgagctccatggtgctggtgcccatctacgtgatctacaagttcctgagcacccagggcagcctgtgggagcggctggcctacggcatcaccccagaaaatgagcaccacctggtggcccagagggacatccggcagttccagctgcagcactggctggccatctag

SEQ ID NO: 170977 - DNA, 1854 bp, Artificial Sequence; identical to SEQ ID NO: 170976
  Description of Artificial Sequence: Synthetic coding sequence

SEQ ID NO: 170978 - DNA, 996 bp, Artificial Sequence
  Description of Artificial Sequence: Synthetic coding sequence
atggtggtggtgattgtgctgtacttcagcctgtggaagggcgtgaagaccagcggcaaggtgtggattgatgctgccacccagatcttcttcagcctgggcgccggctttggagtgctgattgcctttgccagctacaacaagtttgacaacaactgctacagagatgccctgctgaccagcagcatcaactgcatcaccagctttgtgtctggctttgccatcttcagcatcctgggctacatggcccacgagcacaaggtgaacattgaagatgtggccacagaaggagctggcctggtgttcatcctgtacccagaggccatcagcaccctgagcggcagcaccttctgggccgtggtgttctttgtgatgctgctggccctgggcctggacagctccatgggcggcatggaggccgtcatcaccggcctggctgatgacttccaggtgctgaagaggcacaggaagctgttcacctttggagtgaccttcagcaccttcctgctggccctcttctgcatcaccaagggcggcatctacgtgctgaccctgctggacacctttgctgctggcaccagcatcctgtttgctgtgctgatggaggccatcggcgtgtcctggttctacggcgtggaccgcttcagcaatgacatccagcagatgatgggcttccggcccggcctgtactggaggctgtgctggaagtttgtgtccccagccttcctgctgtttgtggtggtggtgtccatcatcaacttcaagcccctgacctatgatgactacatcttccccccctgggccaactgggtgggctggggcatcgccctgagctccatggtgctggtgcccatctacgtgatctacaagttcctgagcacccagggcagcctgtgggagcggctggcctacggcatcaccccagaaaatgagcaccacctggtggcccagagggacatccggcagttccagctgcagcactggctggccatctag

SEQ ID NO: 170979 - DNA, 1893 bp, Artificial Sequence
  Description of Artificial Sequence: Synthetic coding sequence
atggagaccacccccctgaacagccagaagcagctgagcgcctgtgaagatggagaggactgccaggagaatggagtgctgcagaaggtggtgcccacccctggggacaaggtggagagcggccagatcagcaatggctacagcgctgtgcccagccctggagctggagatgacaccaggcacagcatcccagccaccaccaccaccctggtggccgagctgcaccagggcgagcgggagacctggggcaagaaggtggacttcctgctgtctgtgattggctatgctgtggacctgggcaatgtgtggaggttcccctacatctgctaccagaatggaggaggagccttcctgctgccctacaccatcatggccatctttggaggcatccccctcttctacatggagctggccctgggccagtaccacagaaatggctgcatcagcatctggaggaagatctgccccatcttcaagggcatcggctacgccatctgcatcatcgccttctacatcgccagctactacaacaccatcatggcctgggccctgtactacctgatcagcagcttcacagaccagctgccctggaccagctgcaagaacagctggaacacaggcaactgcaccaactacttcagcgaggacaacatcacctggaccctgcacagcaccagccctgctgaggagttctacaccaggcatgtgctgcagatccacaggagcaagggcctgcaggacctgggcggcatctcctggcagctggccctgtgcatcatgctgatcttcaccgtcatctacttcagcatctggaagggcgtgaagaccagcggcaaggtggtgtgggtgacagccaccttcccctacatcatcctgtctgtgctgctggtgcggggggccaccctgcccggggcctggaggggcgtgctcttctacctgaagcccaactggcagaagctgctggagactggagtgtggattgatgctgctgcccagatcttcttcagcctgggccctggctttggagtgctgctggcctttgccagctacaacaagttcaacaacaactgctaccaggatgccctggtgacctctgtggtgaactgcatgaccagctttgtgtctggctttgtgatcttcaccgtgctgggctacatggccgagatgagaaatgaagatgtgtctgaggtggccaaggatgctggccccagcctgctcttcatcacctatgcagaggccatcgccaacatgcctgccagcaccttctttgccatcatcttcttcctgatgctgatcaccctgggcctggacagcacctttgctggcctggagggcgtcatcacagctgtgctggatgagttcccccacgtgtgggccaagagaagagaaagatttgtgctggccgtggtgatcacctgcttcttcggcagcctggtgaccctgacctttggaggagcctacgtggtgaagctgctggaggagtatgccactggacctgctgtgctgactgtggccctgattgaagctgtggccgtgtcctggttctacggcatcacccagttctgcagagatgtgaaggagatgctgggcttcagccctggctggttctggaggatctgctgggtggccatcagccccctcttcctgctcttcatcatctgcagcttcctgatgagccccccccagctgcggctcttccagtacaactacccctactggagcatcatcctgggctactgcatcggcaccagcagcttcatctgcatccccacctacatcgcctaccgcctcatcatcaccccaggcaccttcaaggagcgcatcatcaagagcatcaccccagagacccccacagagatcccctgtggggacatccggctgaatgctgtgtag

SEQ ID NO: 170980 - DNA, 2019 bp, Artificial Sequence
  Description of Artificial Sequence: Synthetic coding sequence
atgagccagagcagaagagtgaacccagatgaccgggagctgggcggggacccccagatccaggccccccgggaccagctgggcagcctggctgatggccaccagtgccacctgctgaccagcaggatggagaccacccccctgaacagccagaagcagctgagcgcctgtgaagatggagaggactgccaggagaatggagtgctgcagaaggtggtgcccacccctggggacaaggtggagagcggccagatcagcaatggctacagcgctgtgcccagccctggagctggagatgacaccaggcacagcatcccagccaccaccaccaccctggtggccgagctgcaccagggcgagcgggagacctggggcaagaaggtggacttcctgctgtctgtgattggctatgctgtggacctgggcaatgtgtggaggttcccctacatctgctaccagaatggaggaggagccttcctgctgccctacaccatcatggccatctttggaggcatccccctcttctacatggagctggccctgggccagtaccacagaaatggctgcatcagcatctggaggaagatctgccccatcttcaagggcatcggctacgccatctgcatcatcgccttctacatcgccagctactacaacaccatcatggcctgggccctgtactacctgatcagcagcttcacagaccagctgccctggaccagctgcaagaacagctggaacacaggcaactgcaccaactacttcagcgaggacaacatcacctggaccctgcacagcaccagccctgctgaggagttctacaccaggcatgtgctgcagatccacaggagcaagggcctgcaggacctgggcggcatctcctggcagctggccctgtgcatcatgctgatcttcaccgtcatctacttcagcatctggaagggcgtgaagaccagcggcaaggtggtgtgggtgacagccaccttcccctacatcatcctgtctgtgctgctggtgcggggggccaccctgcccggggcctggaggggcgtgctcttctacctgaagcccaactggcagaagctgctggagactggagtgtggattgatgctgctgcccagatcttcttcagcctgggccctggctttggagtgctgctggcctttgccagctacaacaagttcaacaacaactgctaccaggatgccctggtgacctctgtggtgaactgcatgaccagctttgtgtctggctttgtgatcttcaccgtgctgggctacatggccgagatgagaaatgaagatgtgtctgaggtggccaaggatgctggccccagcctgctcttcatcacctatgcagaggccatcgccaacatgcctgccagcaccttctttgccatcatcttcttcctgatgctgatcaccctgggcctggacagcacctttgctggcctggagggcgtcatcacagctgtgctggatgagttcccccacgtgtgggccaagagaagagaaagatttgtgctggccgtggtgatcacctgcttcttcggcagcctggtgaccctgacctttggaggagcctacgtggtgaagctgctggaggagtatgccactggacctgctgtgctgactgtggccctgattgaagctgtggccgtgtcctggttctacggcatcacccagttctgcagagatgtgaaggagatgctgggcttcagccctggctggttctggaggatctgctgggtggccatcagccccctcttcctgctcttcatcatctgcagcttcctgatgagccccccccagctgcggctcttccagtacaactacccctactggagcatcatcctgggctactgcatcggcaccagcagcttcatctgcatccccacctacatcgcctaccgcctcatcatcaccccaggcaccttcaaggagcgcatcatcaagagcatcaccccagagacccccacagagatcccctgtggggacatccggctgaatgctgtgtag

SEQ ID NO: 170981 - DNA, 1893 bp, Artificial Sequence; identical to SEQ ID NO: 170979
  Description of Artificial Sequence: Synthetic coding sequence

SEQ ID NO: 170982 - DNA, 1863 bp, Artificial Sequence
  Description of Artificial Sequence: Synthetic coding sequence
atggccaccaaggagaagctgcagtgcctgaaggacttccacaaggacatcctgaagcccagccctgggaagagccctggcaccaggccagaagatgaggccgagggcaagccaccccagcgggagaagtggagcagcaagattgactttgtgctgtctgtggccggcggctttgtgggcctgggcaatgtgtggaggttcccctacctgtgctacaagaatggaggaggagccttcctgatcccctacttcatcttcctgtttggcagcggcctgcctgtgttcttcctggagatcatcatcggccagtacaccagcgagggcggcatcacctgctgggagaagatctgccccctcttctctggaattggctacgcctctgtggtgattgtgtccctgctgaatgtgtactacatcgtcatcctggcctgggccacctactacctgttccagagcttccagaaggagctgccctgggcccactgcaaccacagctggaacaccccccactgcatggaggacaccatgaggaagaacaagtctgtgtggatcaccatcagcagcaccaacttcaccagccctgtgattgagttctgggagagaaatgtgctgagcctgagccctggcatcgaccaccctggcagcctgaagtgggacctggccctgtgcctgctgctggtgtggctggtgtgcttcttctgcatctggaagggcgtgcgcagcacaggcaaggtggtgtacttcaccgccaccttcccctttgccatgctgctggtgctgctggtgcggggcctgaccctgcccggggccggggccggcatcaagttctacctgtacccagacatcacccggctggaggacccccaggtgtggattgatgctggcacccagatcttcttctcctatgccatctgcctgggcgccatgaccagcctgggcagctacaacaagtacaagtacaacagctacagagactgcatgctgctgggctgcctgaacagcggcaccagctttgtgtctggctttgccatcttcagcatcctgggcttcatggcccaggagcagggcgtggacattgctgatgtggccgagagcggccctggcctggccttcatcgcctaccccaaggctgtgaccatgatgcccctgcccaccttctggagcatcctcttcttcatcatgctgctgctgctgggcctggacagccagtttgtggaggtggagggccagatcaccagcctggtggacctgtaccccagcttcctgaggaagggctacagaagagagatcttcatcgcctttgtgtgcagcatctcctacctgctgggcctgaccatggtgacagagggcggcatgtatgtgttccagctgtttgactactatgctgccagcggcgtgtgcctgctgtgggtggccttctttgaatgttttgtgattgcctggatctatggaggagacaacctgtatgatggcatcgaggacatgattggctaccggcccggcccctggatgaagtacagctgggccgtcatcacccctgtgctgtgtgtgggctgcttcatcttcagcctggtgaagtatgtgcccctgacctacaacaagacctacgtgtaccccaactgggccatcggcctgggctggagcctggccctgagctccatgctgtgtgtgcccctggtgattgtcatccggctgtgccagacagagggccccttcctggtgcgggtgaagtacctgctgaccccccgggagcccaaccgctgggccgtggagcgggagggcgccaccccctacaacagcaggacagtgatgaatggagccctggtgaagcccacccacatcatcgtggagaccatgatgtag

SEQ ID NO: 170983 - DNA, 603 bp, Artificial Sequence
  Description of Artificial Sequence: Synthetic coding sequence
atggccaccaaggagaagctgcagtgcctgaaggacttccacaaggacatcctgaagcccagccctgggaagagccctggcaccaggccagaagatgaggccgagggcaagccaccccagcgggagaagtggagcagcaagattgactttgtgctgtctgtggccggcggctttgtgggcctgggcaatgtgtggaggttcccctacctgtgctacaagaatggaggaggagccttcctgatcccctacttcatcttcctgtttggcagcggcctgcctgtgttcttcctggagatcatcatcggccagtacaccagcgagggcggcatcacctgctgggagaagatctgccccctcttctctggaattggctacgcctctgtggtgattgtgtccctgctgaatgtgtactacatcgtcatcctggcctgggccacctactacctgttccagagcttccagaaggagctgccctgggcccactgcaaccacagctggaacaccccccactgcatggaggacaccatgaggaagaacaagtctgtgtggatcaccatcagcagcaccaacttcaccagccctgtgattgagttctgggagtag

SEQ ID NO: 170984 - DNA, 1080 bp, Artificial Sequence
  Description of Artificial Sequence: Synthetic coding sequence
atggccaccaaggagaagctgcagtgcctgaaggacttccacaaggacatcctgaagcccagccctgggaagagccctggcaccaggccagaagatgaggccgagggcaagccaccccagcgggagaagtggagcagcaagattgactttgtgctgtctgtggccggcggctttgtgggcctgggcaatgtgtggaggttcccctacctgtgctacaagaatggaggaggagccttcctgatcccctacttcatcttcctgtttggcagcggcctgcctgtgttcttcctggagatcatcatcggccagtacaccagcgagggcggcatcacctgctgggagaagatctgccccctcttctctggaattggctacgcctctgtggtgattgtgtccctgctgaatgtgtactacatcgtcatcctggcctgggccacctactacctgttccagagcttccagaaggagctgccctgggcccactgcaaccacagctggaacaccccccactgcatggaggacaccatgaggaagaacaagtctgtgtggatcaccatcagcagcaccaacttcaccagccctgtgattgagttctgggagagaaatgtgctgagcctgagccctggcatcgaccaccctggcagcctgaagtgggacctggccctgtgcctgctgctggtgtggctggtgtgcttcttctgcatctggaagggcgtgcgcagcacaggcaaggtggtgtacttcaccgccaccttcccctttgccatgctgctggtgctgctggtgcggggcctgaccctgcccggggccggggccggcatcaagttctacctgtacccagacatcacccggctggaggacccccaggtgtggattgatgctggcacccagatcttcttctcctatgccatctgcctgggcgccatgaccagcctgggcagctacaacaagtacaagtacaacagctaccgctcctggccaggcctgcactgcctgcccaagagctgtgacaatgatgctgctgcccacatcctggtgcacagcttcttctactatgccagcctggcctggacaggatag

SEQ ID NO: 170985 - DNA, 330 bp, Artificial Sequence
  Description of Artificial Sequence: Synthetic coding sequence
atggccaccaaggagaagctgcagtgcctgaaggacttccacaaggacatcctgaagcccagccctgggaagagccctggcaccaggccagaagatgaggccgagggcaagccaccccagcgggagaagtggagcagcaagattgactttgtgctgtctgtggccggcggctttgtgggcctgggcaatgtgtggaggttcccctacctgtgctacaagaatggaggaggagccttcctgatcccctacttcatcttcctgtttggcagcggcctgcctgtgttcttcctggagatcatcatcggccagtacaccagcgagggcggctag

SEQ ID NO: 170986 - DNA, 1863 bp, Artificial Sequence; identical to SEQ ID NO: 170982
  Description of Artificial Sequence: Synthetic coding sequence

SEQ ID NO: 170987 - DNA, 1080 bp, Artificial Sequence; identical to SEQ ID NO: 170984
  Description of Artificial Sequence: Synthetic coding sequence

SEQ ID NO: 170988 - DNA, 1905 bp, Artificial Sequence
  Description of Artificial Sequence: Synthetic coding sequence
atggtgcggctggtgctgcccaaccctggcctggatgcccgcatccccagcctggccgagctggagaccatcgagcaggaggaggccagcagccggcccaagtgggacaacaaggcccagtacatgctgacctgcctgggcttctgtgtgggcctgggcaatgtgtggaggttcccctacctgtgccagagccatggaggaggagccttcatgatccccttcctgatcctgctggtgctggagggcatccccctgctgtacctggagtttgccatcggccagaggctgcggcggggcagcctgggcgtgtggagcagcatccacccagccctgaagggcctgggcctggcctccatgctgaccagcttcatggtgggcctgtactacaacaccatcatctcctggatcatgtggtacctgttcaacagcttccaggagcccctgccctggagcgactgccccctgaatgaaaaccagacaggctacgtggatgaatgtgcccggagcagccctgtggactacttctggtaccgggagaccctgaacatcagcaccagcatcagtgacagcggcagcatccagtggtggatgctgctgtgcctggcctgtgcctggagcgtgctgtacatgtgcaccatccggggcatcgagaccaccgggaaggctgtgtacatcaccagcaccctgccctacgtggtgctgaccatcttcctgatccggggcctgaccctgaagggggccaccaatggaattgtgttcctgttcacccccaacgtgacagagctggcccagcctgacacctggctggatgctggggcccaggtgttcttctccttcagcctggcctttggaggcctcatctccttcagcagctacaacagcgtgcacaacaactgtgagaaggacagcgtgattgtgtccatcatcaatggcttcacctctgtgtatgtggccatcgtggtgtacagcgtgattggcttccgggccacccagagatatgatgactgcttcagcaccaacatcctgaccctcatcaatggatttgacctgcctgagggcaatgtgacccaggagaactttgtggacatgcagcagcgctgcaatgccagtgaccctgctgcctatgcccagctggtgttccagacctgtgacatcaatgccttcctgtctgaggccgtggagggcaccggcctggccttcatcgtgttcacagaggccatcaccaagatgcccctgagccccctgtggagcgtgctcttcttcatcatgctgttctgcctgggcctgagctccatgtttggaaacatggagggcgtggtggtgcccctgcaggacctgcgggtcatcccccccaagtggcccaaggaggtgctgaccggcctcatctgcctgggcaccttcctgattggcttcatcttcaccctgaacagcggccagtactggctgagcctgctggacagctatgccggcagcatccccctgctgatcatcgccttctgtgagatgttttctgtggtgtatgtgtatggagtggaccgcttcaacaaggacatcgagttcatgattggccacaagcccaacatcttctggcaggtgacctggagggtggtgagccccctgctgatgctgatcatcttcctgttcttctttgtggtggaggtgtcccaggagctgacctacagcatctgggaccccggctatgaggagttccccaagagccagaagatctcctaccccaactgggtgtatgtggtggtggtgattgtggccggcgtgcccagcctgaccatccctggctacgccatctacaagctgatccggaaccactgccagaagccaggggaccaccagggcctggtgtccaccctgagcacagcctccatgaatggagacctgaagtactag

SEQ ID NO: 170989 - DNA, 1668 bp, Artificial Sequence
  Description of Artificial Sequence: Synthetic coding sequence
atggagaaggcccggcccctgtgggccaacagcctgcagtttgtgtttgcctgcatctcctatgctgtgggcctgggcaatgtgtggaggttcccctacctgtgccagatgtatggaggcggcagcttcctggtgccctacatcatcatgctgattgtggagggcatgcccctgctgtacctggagctggccgtgggccagaggatgaggcagggcagcatcggggcctggaggaccatcagcccctacctgtctggagtgggcgtggcctctgtggtggtgtccttcttcctgtccatgtactacaacgtcatcaatgcctgggccttctggtacctgttccacagcttccaggaccccctgccctggagcgtgtgccccctgaatggaaaccacacaggctatgatgaggagtgtgagaaggccagcagcacccagtacttctggtacaggaagaccctgaacatcagccccagcctgcaggagaatggaggagtgcagtgggagcccgccctgtgcctgctgctggcctggctggtggtgtacctgtgcatcctgcggggcacagagagcacaggcaagattgagcagctggccaaccccaaggcctggatcaatgctgccacccagatcttcttcagcctgggcctgggcttcggcagcctgattgcctttgccagctacaatgagcccagcaacaactgccagaagcacgccatcatcgtgtccctcatcaacagcttcaccagcatctttgccagcatcgtgaccttcagcatctacggcttcaaggccaccttcaactatgagaactgcctgaagaaggtgtccctgctgctgaccaacacctttgacctggaggatggcttcctgacagccagcaacctggagcaggtgaagggctacctggccagcgcctaccccagcaagtacagcgagatgttcccccagatcaagaactgcagcctggagagcgagctggacacagctgtgcagggcaccggcctggccttcatcgtgtacacagaggccatcaagaacatggaggtgtcccagctgtggagcgtgctgtacttcttcatgctgctgatgctgggcatcggctccatgctgggcaacacagctgccatcctgacccccctgacagacagcaagatcatcagcagccacctgcccaaggaggccatcagcggcctggtgtgcctggtgaactgtgccatcggcatggtgttcaccatggaggccggcaactactggtttgacatcttcaatgactatgctgccaccctgagcctgctgctgattgtgctggtggagaccatcgctgtgtgctacgtgtatggcctgcggagatttgaaagtgacctgaaggccatgacaggccgggctgtgtcctggtactggaaggtgatgtgggccggcgtgagccccctgctgattgtgtccctgtttgtgttctacctgagtgactacatcctgaccggcaccctgaagtaccaggcctgggatgccagccagggccagctggtgaccaaggactacccagcctatgccctggccgtcatcggcctgctggtggccagcagcaccatgtgcatccccctggccgccctgggcacctttgtgcagaggcggctgaagagaggagatgctgaccctgtggcctag

SEQ ID NO: 170990 - DNA, 1779 bp, Artificial Sequence
  Description of Artificial Sequence: Synthetic coding sequence
atggagaaggcccggcccctgtgggccaacagcctgcagtttgtgtttgcctgcatctcctatgctgtgggcctgggcaatgtgtggaggttcccctacctgtgccagatgtatggaggcggcagcttcctggtgccctacatcatcatgctgattgtggagggcatgcccctgctgtacctggagctggccgtgggccagaggatgaggcagggcagcatcggggcctggaggaccatcagcccctacctgtctggagtgggcgtggcctctgtggtggtgtccttcttcctgtccatgtactacaacgtcatcaatgcctgggccttctggtacctgttccacagcttccaggaccccctgccctggagcgtgtgccccctgaatggaaaccacacaggctatgatgaggagtgtgagaaggccagcagcacccagtacttctggtacaggaagaccctgaacatcagccccagcctgcaggagaatggaggagtgcagtgggagcccgccctgtgcctgctgctggcctggctggtggtgtacctgtgcatcctgcggggcacagagagcacaggcaaggtggtgtacttcaccgccagcctgccctactgtgtgctgatcatctacctgatccggggcctgaccctgcacggggccaccaacggcctgatgtacatgttcacccccaagattgagcagctggccaaccccaaggcctggatcaatgctgccacccagatcttcttcagcctgggcctgggcttcggcagcctcatcgcctttgccagctacaatgagcccagcaacaactgccagaagcacgccatcatcgtgtccctcatcaacagcttcaccagcatctttgccagcatcgtgaccttcagcatctacggcttcaaggccaccttcaactatgagaactgcctgaagaaggtgtccctgctgctgaccaacacctttgacctggaggatggcttcctgacagccagcaacctggagcaggtgaagggctacctggccagcgcctaccccagcaagtacagcgagatgttcccccagatcaagaactgcagcctggagagcgagctggacacagctgtgcagggcaccggcctggccttcatcgtgtacacagaggccatcaagaacatggaggtgtcccagctgtggagcgtgctgtacttcttcatgctgctgatgctgggcatcggctccatgctgggcaacacagctgccatcctgacccccctgacagacagcaagatcatcagcagccacctgcccaaggaggccatcagcggcctggtgtgcctggtgaactgtgccatcggcatggtgttcaccatggaggccggcaactactggtttgacatcttcaatgactatgctgccaccctgagcctgctgctgattgtgctggtggagaccatcgctgtgtgctacgtgtatggcctgcggagatttgaaagtgacctgaaggccatgacaggccgggctgtgtcctggtactggaaggtgatgtgggccggcgtgagccccctgctgattgtgtccctgtttgtgttctacctgagtgactacatcctgaccggcaccctgaagtaccaggcctgggatgccagccagggccagctggtgaccaaggactacccagcctatgccctggccgtgattggcctgctggtggccagcagcaccatgtgcatccccctggccgccctgggcacctttgtgcagaggcggctgaagagaggagatgctgaccctgtggcctag

SEQ ID NO: 170991 - DNA, 1644 bp, Artificial Sequence
  Description of Artificial Sequence: Synthetic coding sequence
atggagaaggcccggcccctgtgggccaacagcctgcagtttgtgtttgcctgcatctcctatgctgtgggcctgggcaatgtgtggaggttcccctacctgtgccagatgtatggaggcggcagcttcctggtgccctacatcatcatgctgattgtggagggcatgcccctgctgtacctggagctggccgtgggccagaggatgaggcagggcagcatcggggcctggaggaccatcagcccctacctgtctggagtgggcgtggcctctgtggtggtgtccttcttcctgtccatgtactacaacgtcatcaatgcctgggccttctggtacctgttccacagcttccaggaccccctgccctggagcgtgtgccccctgaatggaaaccacacaggctatgatgaggagtgtgagaaggccagcagcacccagtacttctggtacaggaagaccctgaacatcagccccagcctgcaggagaatggaggagtgcagtgggagcccgccctgtgcctgctgctggcctggctggtggtgtacctgtgcatcctgcggggcacagagagcacaggcaaggtggtgtacttcaccgccagcctgccctactgtgtgctgatcatctacctgatccggggcctgaccctgcacggggccaccaacggcctgatgtacatgttcacccccaagattgagcagctggccaaccccaaggcctggatcaatgctgccacccagatcttcttcagcctgggcctgggcttcggcagcctcatcgcctttgccagctacaatgagcccagcaacaactgccagaagcacgccatcatcgtgtccctcatcaacagcttcaccagcatctttgccagcatcgtgaccttcagcatctacggcttcaaggccaccttcaactatgagaactgcctgaagaaggtgtccctgctgctgaccaacacctttgacctggaggatggcttcctgacagccagcaacctggagcaggtgaagggctacctggccagcgcctaccccagcaagtacagcgagatgttcccccagatcaagaactgcagcctggagagcgagctggacacagctgtgcagggcaccggcctggccttcatcgtgtacacagaggccatcaagaacatggaggtgtcccagctgtggagcgtgctgtacttcttcatgctgctgatgctgggcatcggctccatgctgggcaacacagctgccatcctgacccccctgacagacagcaagatcatcagcagccacctgcccaaggaggccatcagcggcctggtgtgcctggtgaactgtgccatcggcatggtgttcaccatggaggccggcaactactggtttgacatcttcaatgactatgctgccaccctgagcctgctgctgattgtgctggtggagaccatcgctgtgtgctacgtgtatggcctgcggagatttgaaagtgacctgaaggccatgacaggccgggctgtgtcctggtactggaaggtgatgtgggccggcgtgagccccctgctgattgtgtccctgtttgtgttctacctgagtgactacatcctgaccggcaccctgaagtaccaggcctgggatgccagccaggatgacaagctgtag

SEQ ID NO: 170992 - DNA, 1194 bp, Artificial Sequence
  Description of Artificial Sequence: Synthetic coding sequence
atggcccacgcccctgagccagaccctgctgcctgtgacctgggagatgagcggcccaagtgggacaacaaggcccagtacctgctgagctgcaccggctttgctgtgggcctgggcaacatctggaggttcccctacctgtgccagacctatggaggaggagccttcctgatcccctacgtgattgccctggtgtttgagggcatccccatcttccacgtggagctggccatcggccagaggctgaggaagggctctgtgggcgtgtggacagccatcagcccctacctgagcggcgtgggcctgggctgtgtgaccctgtccttcctgatcagcctgtactacaacaccatcgtggcctgggtgctgtggtacctgctgaacagcttccagcaccccctgccctggagcagctgccccccagacctgaacagaacaggctttgtggaggagtgccagggcagcagcgctgtgtcctacttctggtaccggcagaccctgaacatcacagctgacatcaatgacagcggcagcatccagtggtggctgctgatctgcctggccgcctcctgggccgtggtgtacatgtgtgtgatccggggcatcgagaccaccgggaaggtgatctacttcaccgccctcttcccctacctggtgctgaccatcttcctgatccggggcctgaccctgcccggggccaccaagggcctcatctacctgttcacccccaacaacccccgggtgtggctggatgctgccacccagatcttcttcagcctgagcctggccttcggcggccacatcgcctttgccagctacaacagccccagaaatgactgccagaaggatgctgtggtgattgccctggtgaacaggatgaccagcctgtatgccagcattgctgtgttttctgtgctgggcgccagcggccctggcctggcctttgtggtgttcacagaaacagacctgcacatgcctggggcccctgtgtgggccatgctgttcttcggcatgctgttcaccctgggcctgagcaccatgtttggcaccgtggaggccgtcatcacccccctgctggacagcggcaactactggctggagatctttgacaactttgctgccagccccaacctgctgatgctggccttcctggaggtggtgggcgtggtgtatgtgtatggcatgaagaggtag

SEQ ID NO: 170993 - DNA, 1887 bp, Artificial Sequence
  Description of Artificial Sequence: Synthetic coding sequence
atggcccacgcccctgagccagaccctgctgcctgtgacctgggagatgagcggcccaagtgggacaacaaggcccagtacctgctgagctgcaccggctttgctgtgggcctgggcaacatctggaggttcccctacctgtgccagacctatggaggaggagccttcctgatcccctacgtgattgccctggtgtttgagggcatccccatcttccacgtggagctggccatcggccagaggctgaggaagggctctgtgggcgtgtggacagccatcagcccctacctgagcggcgtgggcctgggctgtgtgaccctgtccttcctgatcagcctgtactacaacaccatcgtggcctgggtgctgtggtacctgctgaacagcttccagcaccccctgccctggagcagctgccccccagacctgaacagaacaggctttgtggaggagtgccagggcagcagcgctgtgtcctacttctggtaccggcagaccctgaacatcacagctgacatcaatgacagcggcagcatccagtggtggctgctgatctgcctggccgcctcctgggccgtggtgtacatgtgtgtgatccggggcatcgagaccaccgggaaggtgatctacttcaccgccctcttcccctacctggtgctgaccatcttcctgatccggggcctgaccctgcccggggccaccaagggcctcatctacctgttcacccccaacatgcacatcctgcagaacccccgggtgtggctggatgctgccacccagatcttcttcagcctgagcctggcctttggaggccacatcgcctttgccagctacaacagccccagaaatgactgccagaaggatgctgtggtgattgccctggtgaacaggatgaccagcctgtatgccagcattgctgtgttttctgtgctgggcttcaaggccaccaatgactatgagcactgcctggacaggaacatcctgagcctcatcaatgactttgacttccctgagcagagcatcagcagagatgactacccagctgtgctgatgcacctgaatgccacctggcccaagagggtggcccagctgcccctgaaggcctgcctgctggaggacttcctggacaagagcgccagcggccctggcctggcctttgtggtgttcacagaaacagacctgcacatgcctggggcccctgtgtgggccatgctgttcttcggcatgctgttcaccctgggcctgagcaccatgtttggaacagtggaggccgtcatcacccccctgctggatgtgggcgtgctgccccgctgggtgcccaaggaggccctgaccggcctggtgtgcctggtgtgcttcctgagcgccacctgcttcaccctgcagagcggcaactactggctggagatctttgacaactttgctgccagccccaacctgctgatgctggccttcctggaggtggtgggcgtggtgtatgtgtatggcatgaagcgcttctgtgatgacatcgcctggatgacaggccggcggcccagcccctactggaggctgacctggagggtggtgagccccctgctgctgaccatctttgtggcctacatcatcctgctcttctggaagcccctgcgctacaaggcctggaaccccaagtatgagctgttccccagccggcaggagaagctgtacccaggctgggcccgggccgcctgtgtgctgctgagcctgctgcctgtgctgtgggtgcctgtggccgccctggcccagctgctgaccaggagaagaaggacctggagggacagagatgcccggccagacacagacatgaggccagacacagacaccaggccagacacagacatgaggccagacacagacatgaggtag

SEQ ID NO: 170994 - DNA, 1548 bp, Artificial Sequence
  Description of Artificial Sequence: Synthetic coding sequence
atggaggcccgggagcccggccggcccacccccacctaccacctggtgcccaacaccagccagagccaggtggaggaggatgtgagcagccccccccagaggagcagcgagaccatgcagctgaagaaggagatcagcctgctgaatggagtgtccctggtggtgggcaacatgattggcagcggcatctttgtgagccccaagggcgtgctggtgcacacagccagctatggcatgagcctcatcgtgtgggccatcggcggcctcttctctgtggtgggcgccctgtgctacgccgagctgggcaccaccatcaccaagagcggggccagctatgcctacatcctggaggcctttggaggcttcatcgccttcatccggctgtgggtgtccctgctggtggtggagcccaccggccaggccatcatcgccatcacctttgccaactacatcatccagcccagcttccccagctgtgaccccccctacctggcctgccgcctgctggccgccgcctgcatctgcctgctgacctttgtgaactgtgcctacgtgaagtggggcaccagggtgcaggacaccttcacctacgccaaggtggtggccctgattgccatcatcgtgatgggcctggtgaagctgtgccagggccacagcgagcacttccaggatgcctttgagggcagctcctgggacatgggcaacctgagcctggccctgtacagcgccctcttctcctacagcggctgggacaccctgaactttgtgacagaggagatcaagaaccctgagaggaacctgcccctggccatcggcatctccatgcccatcgtgaccctcatctacatcctgaccaacgtggcctactacacagtgctgaacatcagtgatgtgctgagcagtgatgctgtggccgtgacctttgctgaccagaccttcggcatgttctcctggaccatccccatcgctgtggccctgagctgctttggaggcctgaatgccagcatctttgccagcagccgcctcttctttgtgggcagccgggagggccacctgcctgacctgctgtccatgatccacatcgagcgcttcacccccatcccagccctgctcttcaactgcaccatggccctgatctacctgattgtggaggatgtgttccagctgatcaactacttctccttctcctactggttctttgtgggcctgtctgtggtgggccagctgtacctgcgctggaaggagcccaagaggccccggcccctgaagctgtctgtgttcttccccatcgtgttctgcatctgcagcgtcttcctggtgattgtgcccctcttcacagacaccatcaacagcctgattggaattggaattgccctgagcggcgtgcccttctacttcatgggcgtgtacctgcctgagagcagaagacccctcttcatcagaaatgtgctggccgccatcacccggggcacccagcagctgtgcttctgtgtgctgacagagctggatgtggccgaggagaagaaggatgagaggaagacagactag

SEQ ID NO: 170995 - DNA, 1524 bp, Artificial Sequence
  Description of Artificial Sequence: Synthetic coding sequence
atggccggggccggccccaagaggcgggccctggccgccccagctgctgaggagaaggaggaggcccgggagaagatgctggccgccaagtctgcagatggcagcgccccagctggggagggggagggcgtgaccctgcagaggaacatcaccctgctgaatggagtggccatcatcgtgggcaccatcatcggcagcggcatctttgtgacccccactggagtgctgaaggaggccggcagccctggcctggccctggtggtgtgggccgcctgtggggtcttcagcatcgtgggcgccctgtgctacgccgagctgggcaccaccatcagcaagtctggaggagactatgcctacatgctggaggtgtatggcagcctgcctgccttcctgaagctgtggattgagctgctgatcatccggcccagcagccagtacatcgtggccctggtgtttgccacctacctgctgaagcccctcttccccacctgccctgtgcctgaggaggccgccaagctggtggcctgcctgtgtgtgctgctgctgacagctgtgaactgctacagcgtgaaggccgccaccagggtgcaggatgcctttgctgctgccaagctgctggccctggccctgatcatcctgctgggctttgtgcagattggaaaaggagatgtgagcaacctggaccccaacttctcctttgagggcaccaagctggatgtgggcaacatcgtgctggccctgtacagcggcctgtttgcctacggcggctggaactacctgaactttgtgacagaggagatgatcaacccctacagaaacctgcccctggccatcatcatcagcctgcccatcgtgaccctggtgtatgtgctgaccaacctggcctacttcaccaccctgagcacagagcagatgctgagcagcgaggccgtggccgtggactttggaaactaccacctgggcgtgatgtcctggatcatccctgtgtttgtgggcctgagctgcttcggctctgtgaatggcagcctcttcaccagcagccgcctcttctttgtgggcagccgggagggccacctgcccagcatcctgtccatgatccacccccagctgctgacccctgtgcccagcctggtgttcacctgtgtgatgaccctgctgtatgccttcagcaaggacatcttcagcgtcatcaacttcttctccttcttcaactggctgtgtgtggccctggccatcatcggcatgatctggctgcggcacaggaagccagagctggagcggcccatcaaggtgaacctggccctgcccgtcttcttcatcctggcctgcctcttcctgattgctgtgtccttctggaagacccctgtggagtgtggcatcggcttcaccatcatcctgagcggcctgcctgtgtacttcttcggcgtgtggtggaagaacaagcccaagtggctgctgcagggcatcttcagcaccaccgtgctgtgccagaagctgatgcaggtggtgccccaggagacctag

SEQ ID NO: 170996 - DNA, 846 bp, Artificial Sequence
  Description of Artificial Sequence: Synthetic coding sequence
atgagccacggcacctactatgaatgtgagccccggggcggccagcagcccctggagttcagcggcggccgggccggccctggagagctgggggacatgtgtgagcacgaggccagcattgacctgagcgcctacatcgagagcggggaggagcagctgctgagtgacctgtttgctgtgaagccagcccctgaggcccggggcctgaagggccctggcaccccagccttcccccactacctgcccccagacccccggccctttgcctacccaccccacacctttggaccagacaggaaggccctgggccctggcatctacagcagccctggcagctatgaccccagggctgtggccgtgaaggaggagccccggggccctgagggcagccgggccgccagccggggcagctacaaccccctgcagtaccaggtggcccactgcggccagacagccatgcacctgccccccaccctggccgcccctggccagcccctgcgggtgctgaaggcccccctggccacagctgccccaccctgcagccccctgctgaaggcccccagccctgctggccccctgcacaagggcaagaaggctgtgaacaaggacagcctggagtaccgcctgcggcgggagaggaacaacattgctgtgaggaagagccgggacaaggccaagaggcgcatcctggagacccagcagaaggtgctggagtacatggccgagaatgaaaggctgcggagccgggtggagcagctgacccaggagctggacaccctgaggaacctcttccggcagatccctgaggccgccaacctgatcaagggcgtgggcggctgcagctag

SEQ ID NO: 170997 - DNA, 1608 bp, Artificial Sequence
  Description of Artificial Sequence: Synthetic coding sequence
atggaggagggcgcccggcacaggaacaacacagagaagaagcaccctgggggcggggagagtgatgccagccctgaggccggcagcggcggcggcggcgtggccctgaagaaggagatcggcctggtgtctgcctgtggcatcatcgtgggcaacatcatcggcagcggcatctttgtgagccccaagggcgtgctggagaatgccggctctgtgggcctggccctgattgtgtggatcgtgacaggcttcatcaccgtggtgggcgccctgtgctacgccgagctgggcgtgaccatccccaagtctggaggagactacagctatgtgaaggacatctttggaggcctggccggcttcctgcggctgtggattgctgtgctggtgatctaccccaccaaccaggccgtcatcgccctgaccttcagcaactacgtgctgcagcccctcttccccacctgcttccccccagagagcggcctgcggctgctggccgccatctgcctgctgctgctgacctgggtgaactgcagctctgtgcgctgggccaccagggtgcaggacatcttcaccgctgggaagctgctggccctggccctgatcatcatcatgggcatcgtgcagatctgcaagggggagtacttctggctggagcccaagaatgcctttgagaacttccaggagccagacatcggcctggtggccctggccttcctgcagggcagctttgcctatggaggctggaacttcctgaactacgtgacagaggagctggtggacccctacaagaacctgccccgggccatcttcatcagcatccccctggtgacctttgtgtatgtgtttgccaacgtggcctacgtgacagccatgagcccccaggagctgctggccagcaatgctgtggccgtgaccttcggggagaagctgctgggcgtgatggcctggatcatgcccatctctgtggccctgagcacctttggaggagtgaatggcagcctcttcaccagcagccgcctcttctttgctggggcccgggagggccacctgcccagcgtgctggccatgatccacgtgaagcgctgcacccccatcccagccctgctcttcacctgcatcagcaccctgctgatgctggtgaccagtgacatgtacaccctcatcaactacgtgggcttcatcaactacctgttctatggagtgacagtggccggccagatcgtgctgcgctggaagaagccagacatcccccggcccatcaagatcaacctgctcttccccatcatctacctgctcttctgggccttcctgctggtgttcagcctgtggagcgagcctgtggtgtgtggcatcggcctggccatcatgctgactggagtgcctgtgtacttcctgggcgtgtactggcagcacaagcccaagtgcttcagtgacttcatcgagctgctgaccctggtgtcccagaagatgtgtgtggtggtgtacccagaggtggagcggggcagcggcacagaggaggccaatgaagacatggaggagcagcagcagcccatgtaccagcccacccccaccaaggacaaggatgtggccggccagccccagccctag

SEQ ID NO: 170998 - DNA, 633 bp, Artificial Sequence
  Description of Artificial Sequence: Synthetic coding sequence
atgggcatcgtgcagatctgcaagggggagtacttctggctggagcccaagaatgcctttgagaacttccaggagccagacatcggcctggtggccctggccttcctgcagggcagctttgcctacggcggctggaacttcctgaactacgtgacagaggagctggtggacccctacaagaacctgccccgggccatcttcatcagcatccccctggtgacctttgtgtatgtgtttgccaacgtggcctacgtgacagccatgagcccccaggagctgctggccagcaatgctgtggccgtgacctttggagagaagctgctgggcgtgatggcctggatcatgcccatctctgtggccctgagcaccttcggcggcgtgaatggcagcctgcacctgctgtctgctgtgctgcgctggagcccccggggcccccccagccagtgtgtgggccatgacccccgggaggccctgcaccccaaccccagccctgccctgcacatgcacctgcacccagcagatgctggccaccagagacatgtgcacacccaccagctgtgtggcctgcaccagctgcccctgctgtggggccacggctgctggacagacagccccagcctggaggaggcctag

SEQ ID NO: 170999 - DNA, 693 bp, Artificial Sequence
  Description of Artificial Sequence: Synthetic coding sequence
tgatgcctgcaggagcacagccagcccagccagctgctgtgcaccctgctgctgtgctggtgtgtgctgggccgggagcggcccttcaggaaggcccagagcaccagcagccccctggagggcgtgccccgcttcctgaagaggctgctgctgacctgggtgaactgcagctctgtgcgctgggccaccagggtgcaggacatcttcaccgctgggaagctgctggccctggccctgatcatcatcatgggcatcgtgcagatctgcaagggggagtacttctggctggagcccaagaatgcctttgagaacttccaggagccagacatcggcctggtggccctggccttcctgcagggcagctttgcctacggcggctggaacttcctgaactacgtgacagaggagctggtggacccctacaagctgttctttgctggggcccgggagggccacctgcccagcgtgctggccatgattcatgtgaagcgctgcacccccatcccagccctgctcttcacctgcatcagcaccctgctgatgctggtgaccagtgacatgtacaccctcatcaactacgtgggcttcatcaactacctgttctacggcgtgacagtggccggccagatcgtgctgcgctggaagaagccagacatcccccggcccatcaagcccctgccctaccagggctag

SEQ ID NO: 171000 - DNA, 936 bp, Artificial Sequence
  Description of Artificial Sequence: Synthetic coding sequence
atgggccagctgttccagtgtgctgtgggccaccctggcagccgccacctgcacagctgggaggcccctggcctgggccctgactaccaccacggggactgcacagacatgcagaggaacctgccccgggccatcttcatcagcatccccctggtgacctttgtgtatgtgtttgccaacgtggcctacgtgacagccatgagcccccaggagctgctggccagcaatgctgtggccgtgaccttcggggagaagctgctgggcgtgatggcctggatcatgcccatctctgtggccctgagcacctttggaggagtgaatggcagcctcttcaccagcagccgcctcttctttgctggggcccgggagggccacctgcccagcgtgctggccatgatccacgtgaagcgctgcacccccatcccagccctgctcttcacctgcatcagcaccctgctgatgctggtgaccagtgacatgtacaccctcatcaactacgtgggcttcatcaactacctgttctatggagtgacagtggccggccagatcgtgctgcgctggaagaagccagacatcccccggcccatcaagatcaacctgctcttccccatcatctacctgctcttctgggccttcctgctggtgttcagcctgtggagcgagcctgtggtgtgtggcatcggcctggccatcatgctgactggagtgcctgtgtacttcctgggcgtgtactggcagcacaagcccaagtgcttcagtgacttcatcgagctgctgaccctggtgtcccagaagatgtgtgtggtggtgtacccagaggtggagcggggcagcggcacagaggaggccaatgaagacatggaggagcagcagcagcccatgtaccagcccacccccaccaaggacaaggatgtggccggccagccccagccctag

SEQ ID NO: 171001 - DNA, 999 bp, Artificial Sequence
  Description of Artificial Sequence: Synthetic coding sequence
atgggcatcgtgcagatctgcaagggggagtacttctggctggagcccaagaatgcctttgagaacttccaggagccagacatcggcctggtggccctggccttcctgcagggcagctttgcctacggcggctggaacttcctgaactacgtgacagaggagctggtggacccctacaagaacctgccccgggccatcttcatcagcatccccctggtgacctttgtgtatgtgtttgccaacgtggcctacgtgacagccatgagcccccaggagctgctggccagcaatgctgtggccgtgacctttggagagaagctgctgggcgtgatggcctggatcatgcccatctctgtggccctgagcaccttcggcggcgtgaatggcagcctcttcaccagcagccgcctcttctttgctggggcccgggagggccacctgcccagcgtgctggccatgattcatgtgaagcgctgcacccccatcccagccctgctcttcacctgcatcagcaccctgctgatgctggtgaccagtgacatgtacaccctcatcaactacgtgggcttcatcaactacctgttctacggcgtgacagtggccggccagatcgtgctgcgctggaagaagccagacatcccccggcccatcaagatcaacctgctcttccccatcatctacctgctcttctgggccttcctgctggtgttcagcctgtggagcgagcctgtggtgtgtggcatcggcctggccatcatgctgactggagtgcctgtgtacttcctgggcgtgtactggcagcacaagcccaagtgcttcagtgacttcatcgagctgctgaccctggtgtcccagaagatgtgtgtggtggtgtacccagaggtggagcggggcagcggcacagaggaggccaatgaagacatggaggagcagcagcagcccatgtaccagcccacccccaccaaggacaaggatgtggccggccagccccagccctag

SEQ ID NO: 171002 - DNA, 285 bp, Artificial Sequence
  Description of Artificial Sequence: Synthetic coding sequence
atggaggagggcgcccggcacaggaacaacacagagaagaagcaccctgggggcggggagagtgatgccagccctgaggccggcagcggcggcggcggcgtggccctgaagaaggagatcggcctggtgtctgcctgtggcatcatcgtgggcaacatcatcggcagcggcatctttgtgagccccaagggcgtgctggagaatgccggctctgtgggcctggccctgattgtgtggatcgtgacaggcttcatcaccgtggtgggcgccctgtgctacgcctag

SEQ ID NO: 171003 - DNA, 237 bp, Artificial Sequence
  Description of Artificial Sequence: Synthetic coding sequence
atggaggagggcgcccggcacaggaacaacacagagaagaagcaccctgggggcggggagagtgatgccagccctgaggccggcagcggcggcggcggcgtggccctgaagaaggagatcggcctggtgtctgcctgtggcatcatcgtgggcaacatcatcggcagcggcatctttgtgagccccaagggcgtgctggagaatgccggctctgtgggcctggccctgattgtgtag

SEQ ID NO: 171004 - DNA, 1293 bp, Artificial Sequence
  Description of Artificial Sequence: Synthetic coding sequence
atgggccagtatggccaggagctgtcctggaagtgcctggtgaaggctgtgtgcctgcaggagcacagccagcccagccagctgctgtgcaccctgctgctgtgctggtgtgtgctgggccgggagcggcccttcaggaaggcccagagcaccagcagccccctggagggcgtgccccgcttcctgaagaggctgctgctgacctgggtgaactgcagctctgtgcgctgggccaccagggtgcaggacatcttcaccgctgggaagctgctggccctggccctgatcatcatcatgggcatcgtgcagatctgcaagggggagtacttctggctggagcccaagaatgcctttgagaacttccaggagccagacatcggcctggtggccctggccttcctgcagggcagctttgcctacggcggctggaacttcctgaactacgtgacagaggagctggtggacccctacaagaacctgccccgggccatcttcatcagcatccccctggtgacctttgtgtatgtgtttgccaacgtggcctacgtgacagccatgagcccccaggagctgctggccagcaatgctgtggccgtgacctttggagagaagctgctgggcgtgatggcctggatcatgcccatctctgtggccctgagcaccttcggcggcgtgaatggcagcctcttcaccagcagccgcctcttctttgctggggcccgggagggccacctgcccagcgtgctggccatgattcatgtgaagcgctgcacccccatcccagccctgctcttcacctgcatcagcaccctgctgatgctggtgaccagtgacatgtacaccctcatcaactacgtgggcttcatcaactacctgttctacggcgtgacagtggccggccagatcgtgctgcgctggaagaagccagacatcccccggcccatcaagatcaacctgctcttccccatcatctacctgctcttctgggccttcctgctggtgttcagcctgtggagcgagcctgtggtgtgtggcatcggcctggccatcatgctgactggagtgcctgtgtacttcctgggcgtgtactggcagcacaagcccaagtgcttcagtgacttcatcgagctgctgaccctggtgtcccagaagatgtgtgtggtggtgtacccagaggtggagcggggcagcggcacagaggaggccaatgaagacatggaggagcagcagcagcccatgtaccagcccacccccaccaaggacaaggatgtggccggccagccccagccctag

SEQ ID NO: 171005 - DNA, 1968 bp, Artificial Sequence
  Description of Artificial Sequence: Synthetic coding sequence
atggtgctgtacaccacccccttccccaacagctgcctgagcgccctgcactgtgtgtcctgggccctgatcttcccctgctactggctggtggaccggctggccgccagcttcatccccaccacctatgagaagaggcagagagcagatgacccctgctgcctgcagctgctgtgcacagccctcttcacccccatctacctggccctgctggtggccagcctgccctttgccttcctgggcttcctgttctggagccccctgcagagcgcccggcggccctacatctacagccggctggaggacaagggcctggccggcggggccgccctgctgtctgagtggaagggcaccggccctgggaagagcttctgctttgccacagccaacgtgtgcctgctgcctgacagcctggcccgggtgaacaacctcttcaacacccaggcccgggccaaggagatcggccagaggatcagaaatggagctgcccggccccagatcaagatctacatcgacagccccaccaacaccagcatctctgctgccagcttcagcagcctggtgagcccccagggcggagatggagtggcccgggctgtgcccggcagcatcaagaggacagcctctgtggagtacaagggagatggcggccgccaccctggagatgaggccgccaacggccctgccagcggggaccctgtggacagcagcagcccagaagatgcctgcatcgtgagaattggaggagaggagggcggccggcccccagaggctgatgatcctgtgcctgggggccaggccagaaatggagctgggggcggcccccggggccagacccccaaccacaaccagcaggatggagacagcggcagcctgggcagccccagcgccagccgggagagcctggtgaagggccgggccggccctgacaccagcgccagcggggagcccggggccaacagcaagctgctgtacaaggcctctgtggtgaagaaggccgccgccaggagaagaagacacccagatgaggcctttgaccacgaggtgtctgccttcttccctgccaacctggacttcctgtgcctgcaggaggtgtttgacaagagagctgccaccaagctgaaggagcagctgcacggctactttgagtacatcctgtatgatgtgggcgtgtatggctgccagggctgctgcagcttcaagtgcctgaacagcggcctgctgtttgccagccgctaccccatcatggatgtggcctaccactgctaccccaacaagtgcaatgatgatgccctggccagcaaaggagccctcttcctgaaggtgcaggtgggcagcaccccccaggaccagagaattgtgggctacatcgcctgcacccacctgcacgccccccaggaggacagcgccatccgctgtggccagctggacctgctgcaggactggctggccgacttcaggaagagcaccagcagcagcagcgctgccaaccctgaggagctggtggcctttgatgtggtgtgtggggacttcaactttgacaactgcagcagtgatgacaagctggagcagcagcacagcctcttcacccactacagagacccctgccgcctgggccctggagaggagaagccctgggccatcggcaccctgctggacaccaacggcctgtatgatgaagatgtgtgcaccccagacaacctgcagaaggtgctggagagcgaggagggccggcgggagtacctggccttccccaccagcaagagcagcggccagaagggcaggaaggagctgctgaagggaaatggaagaagaattgactacatgctgcacgccgaggagggcctgtgcccagactggaaggccgaggtggaggagttctccttcatcacccagctgagcggcctgacagaccacctgcctgtggccatgaggctgatggtgagcagcggggaggaggaggcctag

SEQ ID NO: 171006 - DNA, 690 bp, Artificial Sequence
  Description of Artificial Sequence: Synthetic coding sequence
atggaggcccgggagcccggccggcccacccccacctaccacctggtgcccaacaccagccagagccaggtggaggaggatgtgagcagccccccccagaggagcagcgagaccatgcagctgaagaaggagatcagcctgctgaatggagtgtccctggtggtgggcaacatgattggcagcggcatctttgtgagccccaagggcgtgctggtgcacacagccagctatggcatgagcctcatcgtgtgggccatcggcggcctcttctctgtggtgggcgccctgtgctacgccgagctgggcaccaccatcaccaagagcggggccagctatgcctacatcctggaggcctttggaggcttcatcgccttcatccggctgtgggtgtccctgctggtggtggagcccaccggccaggccatcatcgccatcacctttgccaactacatcatccagcccagcttccccagctgtgaccccccctacctggcctgccgcctgctggccgccgcctgcatctgcctgctgacctttgtgaactgtgcctacgtgaagtggggcaccagggtgcaggacaccttcacctacgccaaggtggtggccctgattgccatcatcgtgatgggcctggtgaagctgtgccaggagatctgcccctggcccctgggcttcctgtgccagctgtag

SEQ ID NO: 171007 - DNA, 1536 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctggccttcatccggctgtggaccagcctgctgatcatcgagcccaccagccaggccatcatcgccatcacctttgccaactacatggtgcagcccctcttccccagctgctttgccccctatgctgccagccggctgctggccgccgcctgcatctgcctgctgaccttcatcaactgtgcctacgtgaagtggggcaccctggtgcaggacatcttcacctacgccaaggtgctggccctgattgctgtgattgtggccggcatcgtgcggctgggccagggcgccagcacccactttgaaaattcctttgagggcagcagctttgctgtgggggacatcgccctggccctgtacagcgccctcttctcctacagcggctgggacaccctgaactacgtgacagaggagatcaagaaccctgagaggaacctgcccctgagcatcggcatctccatgcccatcgtgaccatcatctacatcctgaccaacgtggcctactacacagtgctggacatgagggacatcctggccagtgatgctgtggccgtgacctttgctgaccagatcttcggcatcttcaactggatcatccccctgtctgtggccctgagctgctttggaggcctgaatgccagcatcgtggccgccagccgcctcttctttgtgggcagccgggagggccacctgcctgatgccatctgcatgatccacgtggagcgcttcacccctgtgcccagcctgctcttcaacggcatcatggccctgatctacctgtgtgtggaggacatcttccagctgatcaactactacagcttctcctactggttctttgtgggcctgagcatcgtgggccagctgtacctgcgctggaaggagccagaccggccccggcccctgaagctgtctgtgttcttccccatcgtgttctgcctgtgcaccatcttcctggtggccgtgcccctgtacagcgacaccatcaacagcctgattggaattgccatcgccctgagcggcctgcccttctacttcctgatcatccgggtgcctgagcacaagaggcccctgtacctgcggagaattgtgggcagcgccacccgctacctgcaggtgctgtgcatgtctgtggccgctgagatggacctggaggatggaggagagatgcccaagcagagggaccccaagagcaactag

SEQ ID NO: 171008 - DNA, 1536 bp, Artificial Sequence; identical to SEQ ID NO: 171007
  Description of Artificial Sequence: Synthetic coding sequence

SEQ ID NO: 171009 - DNA, 1536 bp, Artificial Sequence; identical to SEQ ID NO: 171007
  Description of Artificial Sequence: Synthetic coding sequence

SEQ ID NO: 171010 - DNA, 1536 bp, Artificial Sequence; identical to SEQ ID NO: 171007
  Description of Artificial Sequence: Synthetic coding sequence

SEQ ID NO: 171011 - DNA, 1455 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatctacagcgccagctttggcctgagcctggtgatctgggccgtgggcggcctcttctctgtgtttggagccctgtgctacgccgagctgggcaccaccatcaagaagagcggggccagctatgcctacatcctggaggccttcggcggcttcctggccttcatccggctgtggaccagcctgctgatcatcgagcccaccagccaggccatcatcgccatcacctttgccaactacatggtgcagcccctcttccccagctgctttgccccctatgctgccagccggctgctggccgccgcctgcatctgcctgctgaccttcatcaactgtgcctacgtgaagtggggcaccctggtgcaggacatcttcacctacgccaaggtgctggccctgattgctgtgattgtggccggcatcgtgcggctgggccagggcgccagcacccactttgagaacagctttgagggcagcagctttgctgtgggggacatcgccctggccctgtacagcgccctcttctcctacagcggctgggacaccctgaactacgtgacagaggagatcaagaaccctgagaggaacctgcccctgagcatcggcatctccatgcccatcgtgaccatcatctacatcctgaccaacgtggcctactacacagtgctggacatgagggacatcctggccagtgatgctgtggccgtgacctttgctgaccagatcttcggcatcttcaactggatcatccccctgtctgtggccctgagctgcttcggcggcctgaatgccagcatcgtggccgccagccgcctcttctttgtgggcagccgggagggccacctgcctgatgccatctgcatgattcatgtggagcgcttcacccctgtgcccagcctgctcttcaacggcatcatggccctgatctacctgtgtgtggaggacatcttccagctgatcaactactacagcttctcctactggttctttgtgggcctgagcatcgtgggccagctgtacctgcgctggaaggagccagaccggccccggcccctgaagctgagcgtcttcttccccatcgtgttctgcctgtgcaccatcttcctggtggccgtgcccctgtacagcgacaccatcaacagcctcatcggcatcgccatcgccctgagcggcctgcccttctacttcctgatcatccgggtgcctgagcacaagaggcccctgtacctgcggcgcatcgtgggcagcgccacccgctacctgcaggtgctgtgcatgtctgtggccgctgagatggacctggaggatggaggagagatgcccaagcagagggaccccaagagcaactag

SEQ ID NO: 171012 - DNA, 426 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctggccttcatccggctgtggaccagcctgctgatcatcgagcccaccagccaggccatcatcgccatcacctttgccaactag

SEQ ID NO: 171013 - DNA, 135 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgctag

SEQ ID NO: 171014 - DNA, 495 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctggccttcatccggctgtggaccagcctgctgatcatcgagcccaccagccaggccatcatcgccatcacctttgccaactacatggtgcagcccctcttccccagctgctttgccccctatgctgccagccggctgctggccgccgcctag

SEQ ID NO: 171015 - DNA, 369 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctggccttcatccggctgtggacctag

SEQ ID NO: 171016 - DNA, 1536 bp, Artificial Sequence; identical to SEQ ID NO: 171007
  Description of Artificial Sequence: Synthetic coding sequence

SEQ ID NO: 171017 - DNA, 348 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctgtag

SEQ ID NO: 171018 - DNA, 93 bp, Artificial Sequence
  Description of Artificial Sequence: Synthetic coding sequence
atggtggacagcacagaatatgaggtggccagccagcctgaggtggagaccagccccctgggagatggagccagccctggccctgagcagtag

SEQ ID NO: 171019 - DNA, 933 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctggccttcatccggctgtggaccagcctgctgatcatcgagcccaccagccaggccatcatcgccatcacctttgccaactacatggtgcagcccctcttccccagctgctttgccccctatgctgccagccggctgctggccgccgcctgcatctgcctgctgaccttcatcaactgtgcctacgtgaagtggggcaccctggtgcaggacatcttcacctacgccaaggtgctggccctgattgctgtgattgtggccggcatcgtgcggctgggccagggcgccagcacccactttgaaaattcctttgagggcagcagctttgctgtgggggacatcgccctggccctgtacagcgccctcttctcctacagcggctgggacaccctgaactacgtgacagaggagatcaagaaccctgagaggaacctgcccctgagcatcggcatctccatgcccatcgtgaccatcatctacatcctgaccaacgtggcctactacacagtgctggacatgagggacatcctggccagtgatgctgtggccgtggccttcctgtgtggcctgaagaggcggcccagcccctag

SEQ ID NO: 171020 - DNA, 321 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctactag

SEQ ID NO: 171021 - DNA, 351 bp, Artificial Sequence
  Description of Artificial Sequence: Synthetic coding sequence
atggtggacagcacagaatatgaggtggccagccagcctgaggtggagaccagccccctgggagatggagccagccctggccctgagcaggtgaagctgaagaaggagatcagcctgctgaatggagtgtgcctgattgtgggcaacatgattggcagcggcatctttgtgagccccaagggcgtgctgatctacagcgccagctttggcctgagcctggtgatctgggccgtgggcggcctcttctctgtgtttggagccctgtgctacgccgagctgggcaccaccatcaagaagagcggggccagctatgcctacatcctggaggcctttggaggcttcctggcctag

SEQ ID NO: 171022 - DNA, 1890 bp, Artificial Sequence
  Description of Artificial Sequence: Synthetic coding sequence
atgggctgcaaggtgctgctgaacatcggccagcagatgctgcggaggaaggtggtggactgcagccgggaggagacccggctgagccgctgcctgaacacctttgacctggtggccctgggcgtgggcagcaccctgggcgctggggtgtatgtgctggccggggctgtggcccgggagaatgccggccctgccatcgtcatctccttcctgattgctgccctggcctctgtgctggccggcctgtgctacggggagtttggagcccgggtgcccaagacaggcagcgcctacctgtacagctatgtgacagtgggggagctgtgggccttcatcaccggctggaacctgatcctgagctacatcatcggcaccagctctgtggcccgggcctggagcgccacctttgatgagctgattggccggcccatcggggagttcagcaggacccacatgaccctgaatgcccctggggtgctggccgagaacccagacatctttgctgtgatcatcatcctgatcctgaccggcctgctgaccctgggcgtgaaggagagcgccatggtgaacaagatcttcacctgcatcaacgtgctggtgctgggcttcatcatggtgtctggctttgtgaagggctctgtgaagaactggcagctgacagaggaggactttggaaacaccagcggccgcctgtgcctgaacaatgacaccaaggagggcaagccaggagtgggcggcttcatgcccttcggcttctctggagtgctgtctggagctgccacctgcttctacgcctttgtgggctttgactgcatcgccaccactggagaggaggtgaagaacccccagaaggccatccctgtgggcatcgtggccagcctgctgatctgcttcatcgcctactttggagtgtctgctgccctgaccctgatgatgccctacttctgcctggacaacaacagccccctgcctgatgccttcaagcacgtgggctgggagggcgccaagtatgctgtggccgtgggcagcctgtgtgccctgagcgccagcctgctgggctccatgttccccatgcccagggtcatctatgccatggctgaagatggcctgctcttcaagttcctggccaacgtgaatgacaggaccaagacccccatcatcgccaccctggccagcggggctgtggccgctgtgatggccttcctgtttgacctgaaggacctggtggacctgatgagcatcggcaccctgctggcctacagcctggtggccgcctgtgtgctggtgctgcgctaccagcctgagcagcccaacctggtgtaccagatggccagcaccagtgatgagctggaccctgctgaccagaatgagctggccagcaccaatgacagccagctgggcttcctgcctgaggccgagatgttcagcctgaagaccatcctgagccccaagaacatggagcccagcaagatcagcggcctgattgtgaacatcagcaccagcctgattgctgtgctgatcatcaccttctgcatcgtgacagtgctgggccgggaggccctgaccaagggggccctgtgggccgtgttcctgctggccggcagcgccctgctgtgtgctgtggtgactggagtcatctggaggcagcctgagagcaagaccaagctgtccttcaaggtgcccttcctgcctgtgctgcccatcctgagcatctttgtgaatgtgtacctgatgatgcagctggaccagggcacctgggtgcgctttgctgtgtggatgctgattggcttcatcatctacttcggctacggcctgtggcacagcgaggaggccagcctggatgctgaccaggcccggaccccagatggcaacctggaccagtgcaagtag

SEQ ID NO: 171023 - DNA, 366 bp, Artificial Sequence
  Description of Artificial Sequence: Synthetic coding sequence
atgggctgcaaggtgctgctgaacatcggccagcagatgctgcggaggaaggtggtggactgcagccgggaggagacccggctgagccgctgcctgaacacctttgacctggtggccctgggcgtgggcagcaccctgggcgctggggtgtatgtgctggccggggctgtggcccgggagaatgccggccctgccatcgtcatctccttcctgattgctgccctggcctctgtgctggccggcctgtgctacggggagtttggagcccgggtgcccaagacaggcagcgcctacctgtacagctatgtgacagtgggggagctgtgggccttcatcaccggctggaacctgatcctgagctactag

SEQ ID NO: 171024 - DNA, 2097 bp, Artificial Sequence
  Description of Artificial Sequence: Synthetic coding sequence
atgaagattgagaccagcggctacaacagcgacaagctgatctgccggggcttcatcggcaccccagcccctcctgtgtgtgacagcaagttcctgctgagccccagcagtgatgtgaggatgatcccctgccgggccgccctgacctttgcccgctgcctgatccggaggaagatcgtgaccctggacagcctggaggacaccaagctgtgccgctgcctgagcaccatggacctgattgccctgggcgtgggcagcaccctgggcgctggggtgtatgtgctggccggggaggtggccaaggctgacagcggccccagcatcgtggtgtccttcctgattgctgccctggcctctgtgatggccggcctgtgctacgccgagtttggagcccgggtgcccaagacaggcagcgcctacctgtacacctacgtgacagtgggggagctgtgggccttcatcaccggctggaacctgatcctgtcctatgtgattggcaccagctctgtggcccgggcctggagcggcacctttgatgagctgctgagcaagcagatcggccagttcctgcggacctacttcaggatgaactacacaggcctggccgagtacccagacttctttgctgtgtgcctgatcctgctgctggccggcctgctgagctttggagtgaaggagagcgcctgggtgaacaaggtgttcaccgctgtgaacatcctggtgctgctgtttgtgatggtggccggctttgtgaagggaaatgtggccaactggaagatcagcgaggagttcctgaagaacatcagcgccagcgcccgggagcccccatctgaaaatggcaccagcatctacggggccggcggcttcatgccctacggcttcaccggcaccctggccggggccgccacctgcttctacgcctttgtgggctttgactgcatcgccaccactggagaggaggtgaggaacccccagaaggccatccccatcggcatcgtgaccagcctgctggtgtgcttcatggcctactttggagtgtctgctgccctgaccctgatgatgccctactacctgctggatgagaagagccccctgcctgtggcctttgaatatgtgggctggggccctgccaagtatgtggtggccgccggcagcctgtgtgccctgagcaccagcctgctgggcagcatcttccccatgcccagggtcatctatgccatggctgaagatggcctgctcttcaagtgcctggcccagatcaacagcaagaccaagacccccatcatcgccaccctgagcagcggggctgtggccgccctgatggccttcctgtttgacctgaaggccctggtggacatgatgagcatcggcaccctgatggcctacagcctggtggccgcctgtgtgctgatcctgcgctaccagcccggcctgtcctatgaccagcccaagtgcagccctgagaaggatggcctgggcagcagcccccgggtgaccagcaagtctgagagccaggtgaccatgctgcagaggcagggcttctccatgaggaccctcttctgccccagcctgctgcccacccagcagagcgccagcctggtgtccttcctggtgggcttcctggccttcctggtgctgggcctgtctgtgctgaccacctacggcgtgcacgccatcacccggctggaggcctggagcctggccctgctggccctcttcctggtgctgtttgtggccatcgtgctgaccatctggaggcagccccagaaccagcagaaggtggccttcatggtgcccttcctgcccttcctgcctgccttcagcatcctggtgaacatctacctgatggtgcagctgtctgctgacacctgggtgcgcttcagcatctggatggccatcggcttcctgatctacttctcctatggcatccgccacagcctggagggccacctgagagatgagaacaatgaggaggatgcctacccagacaacgtgcatgctgctgctgaggagaagagcgccatccaggccaatgaccaccaccccaggaacctgagcagccccttcatcttccacgagaagaccagcgagttctag

SEQ ID NO: 171025 - DNA, 2094 bp, Artificial Sequence
  Description of Artificial Sequence: Synthetic coding sequence
atgaagattgagaccagcggctacaacagcgacaagctgatctgccggggcttcatcggcaccccagcccctcctgtgtgtgacagcaagttcctgctgagccccagcagtgatgtgaggatgatcccctgccgggccgccctgacctttgcccgctgcctgatccggaggaagatcgtgaccctggacagcctggaggacaccaagctgtgccgctgcctgagcaccatggacctgattgccctgggcgtgggcagcaccctgggcgctggggtgtatgtgctggccggggaggtggccaaggctgacagcggccccagcatcgtggtgtccttcctgattgctgccctggcctctgtgatggccggcctgtgctacgccgagtttggagcccgggtgcccaagacaggcagcgcctacctgtacacctacgtgacagtgggggagctgtgggccttcatcaccggctggaacctgatcctgtcctatgtgattggcaccagctctgtggcccgggcctggagcggcacctttgatgagctgctgagcaagcagatcggccagttcctgcggacctacttcaggatgaactacacaggcctggccgagtacccagacttctttgctgtgtgcctgatcctgctgctggccggcctgctgagctttggagtgaaggagagcgcctgggtgaacaaggtgttcaccgctgtgaacatcctggtgctgctgtttgtgatggtggccggctttgtgaagggaaatgtggccaactggaagatcagcgaggagttcctgaagaacatcagcgccagcgcccgggagcccccatctgaaaatggcaccagcatctacggggccggcggcttcatgccctacggcttcaccggcaccctggccggggccgccacctgcttctacgcctttgtgggctttgactgcatcgccaccactggagaggaggtgaggaacccccagaaggccatccccatcggcatcgtgaccagcctgctggtgtgcttcatggcctactttggagtgtctgctgccctgaccctgatgatgccctactacctgctggatgagaagagccccctgcctgtggcctttgaatatgtgggctggggccctgccaagtatgtggtggccgccggcagcctgtgtgccctgagcaccagcctgctgggctccatgttccccctgccccgcatcctgtttgccatggccagagatggcctgctcttccgcttcctggcccgggtgtccaagaggcagagccctgtggccgccaccctgacagctggggtcatcagcgccctgatggccttcctgtttgacctgaaggccctggtggacatgatgagcatcggcaccctgatggcctacagcctggtggccgcctgtgtgctgatcctgcgctaccagcccggcctgtcctatgaccagcccaagtgcagccctgagaaggatggcctgggcagcagcccccgggtgaccagcaagtctgagagccaggtgaccatgctgcagaggcagggcttctccatgaggaccctcttctgccccagcctgctgcccacccagcagagcgccagcctggtgtccttcctggtgggcttcctggccttcctggtgctgggcctgtctgtgctgaccacctatggagtgcacgccatcacccggctggaggcctggagcctggccctgctggccctcttcctggtgctgtttgtggccatcgtgctgaccatctggaggcagccccagaaccagcagaaggtggccttcatggtgcccttcctgcccttcctgcctgccttcagcatcctggtgaacatctacctgatggtgcagctgtctgctgacacctgggtgcgcttcagcatctggatggccatcggcttcctgatctacttctcctatggcatccgccacagcctggagggccacctgagagatgaaaataatgaagaagatgcctacccagacaacgtgcacgccgctgctgaggagaagagcgccatccaggccaatgaccaccaccccaggaacctgagcagccccttcatcttccacgagaagaccagcgagttctag

SEQ ID NO: 171026 - DNA, 2094 bp, Artificial Sequence; identical to SEQ ID NO: 171025
  Description of Artificial Sequence: Synthetic coding sequence

SEQ ID NO: 171027 - DNA, 1977 bp, Artificial Sequence
  Description of Artificial Sequence: Synthetic coding sequence
atgatcccctgccgggccgccctgacctttgcccgctgcctgatccggaggaagatcgtgaccctggacagcctggaggacaccaagctgtgccgctgcctgagcaccatggacctgattgccctgggcgtgggcagcaccctgggcgctggggtgtatgtgctggccggggaggtggccaaggctgacagcggccccagcatcgtggtgtccttcctgattgctgccctggcctctgtgatggccggcctgtgctacgccgagtttggagcccgggtgcccaagacaggcagcgcctacctgtacacctacgtgacagtgggggagctgtgggccttcatcaccggctggaacctgatcctgtcctatgtgattggcaccagctctgtggcccgggcctggagcggcacctttgatgagctgctgagcaagcagatcggccagttcctgcggacctacttcaggatgaactacacaggcctggccgagtacccagacttctttgctgtgtgcctgatcctgctgctggccggcctgctgagctttggagtgaaggagagcgcctgggtgaacaaggtgttcaccgctgtgaacatcctggtgctgctgtttgtgatggtggccggctttgtgaagggaaatgtggccaactggaagatcagcgaggagttcctgaagaacatcagcgccagcgcccgggagcccccatctgaaaatggcaccagcatctacggggccggcggcttcatgccctacggcttcaccggcaccctggccggggccgccacctgcttctacgcctttgtgggctttgactgcatcgccaccactggagaggaggtgaggaacccccagaaggccatccccatcggcatcgtgaccagcctgctggtgtgcttcatggcctactttggagtgtctgctgccctgaccctgatgatgccctactacctgctggatgagaagagccccctgcctgtggcctttgaatatgtgggctggggccctgccaagtatgtggtggccgccggcagcctgtgtgccctgagcaccagcctgctgggcagcatcttccccatgcccagggtcatctatgccatggctgaagatggcctgctcttcaagtgcctggcccagatcaacagcaagaccaagacccccatcatcgccaccctgagcagcggggctgtggccgccctgatggccttcctgtttgacctgaaggccctggtggacatgatgagcatcggcaccctgatggcctacagcctggtggccgcctgtgtgctgatcctgcgctaccagcccggcctgtcctatgaccagcccaagtgcagccctgagaaggatggcctgggcagcagcccccgggtgaccagcaagtctgagagccaggtgaccatgctgcagaggcagggcttctccatgaggaccctcttctgccccagcctgctgcccacccagcagagcgccagcctggtgtccttcctggtgggcttcctggccttcctggtgctgggcctgtctgtgctgaccacctacggcgtgcacgccatcacccggctggaggcctggagcctggccctgctggccctcttcctggtgctgtttgtggccatcgtgctgaccatctggaggcagccccagaaccagcagaaggtggccttcatggtgcccttcctgcccttcctgcctgccttcagcatcctggtgaacatctacctgatggtgcagctgtctgctgacacctgggtgcgcttcagcatctggatggccatcggcttcctgatctacttctcctatggcatccgccacagcctggagggccacctgagagatgagaacaatgaggaggatgcctacccagacaacgtgcatgctgctgctgaggagaagagcgccatccaggccaatgaccaccaccccaggaacctgagcagccccttcatcttccacgagaagaccagcgagttctag

SEQ ID NO: 171028 - DNA, 1977 bp, Artificial Sequence; identical to SEQ ID NO: 171027
  Description of Artificial Sequence: Synthetic coding sequence

SEQ ID NO: 171029 - DNA, 1464 bp, Artificial Sequence
  Description of Artificial Sequence: Synthetic coding sequence
atgggagacaccggcctgaggaagagaagagaagatgagaagagcatccagagccaggagcccaagaccaccagcctgcagaaggagctgggcctcatcagcggcatcagcatcatcgtgggcaccatcatcggcagcggcatctttgtgagccccaagtctgtgctgagcaacacagaagctgtgggcccctgcctgatcatctgggccgcctgtggggtgctggccaccctgggcgccctgtgctttgctgagctgggcaccatgatcaccaagtctggaggagagtacccctacctgatggaggcctacggccccatcccagcctacctgttctcctgggccagcctcatcgtcatcaagcccaccagctttgccatcatctgcctgtccttctctgaatatgtgtgtgcccccttctacgtgggctgcaagccaccccagatcgtggtgaagtgcctggccgctgctgccatcctcttcatcagcacagtgaacagcctgtctgtgcggctgggcagctatgtgcagaacatcttcaccgctgccaagctggtgattgtggccatcatcatcatcagcggcctggtgctgctggcccagggcaacaccaagaactttgacaacagctttgaaggagcccagctgtctgtgggcgccatcagcctggccttctacaacggcctgtgggcctatgatggctggaaccagctgaactacatcacagaggagctgaggaacccctacagaaacctgcccctggccatcatcatcggcatccccctggtgacagcctgctacatcctgatgaatgtgtcctacttcaccgtgatgacagccacagagctgctgcagagccaggccgtggccgtgacctttggagacagagtgctgtacccagcctcctggatcgtgcccctgtttgtggccttcagcaccatcggggccgccaacggcacctgcttcaccgctggccgcctcatctacgtggccggccgggagggccacatgctgaaggtgctgagctacatctctgtgcggcggctgaccccagccccagccatcatcttctacggcatcatcgccaccatctacatcatccctggggacatcaacagcctggtgaactacttctcctttgctgcctggctgttctacggcctgaccatcctgggcctcatcgtgatgaggttcaccaggaaggagctggagcggcccatcaaggtgcctgtggtgattcctgtgctgatgaccctcatctctgtgttcctggtgctggcccccatcatcagcaagcccacctgggagtacctgtactgtgtgctcttcatcctgagcggcctgctcttctacttcctgtttgtgcactacaagtttggctgggcccagaagatcagcaagcccatcaccatgcacctgcagatgctgatggaggtggtgcccccagaggaggaccctgagtag

SEQ ID NO: 171030 - DNA, 1464 bp, Artificial Sequence; identical to SEQ ID NO: 171029
  Description of Artificial Sequence: Synthetic coding sequence

SEQ ID NO: 171031 - DNA, 1908 bp, Artificial Sequence
  Description of Artificial Sequence: Synthetic coding sequence
atggcccggggcctgcccaccatcgccagcctggcccggctgtgccagaagctgaaccggctgaagcccctggaggacagcaccatggagaccagcctgcggcgctgcctgagcaccctggacctgaccctgctgggcgtgggcggcatggtgggcagcggcctgtatgtgctgactggagctgtggccaaggaggtggccggccctgctgtgctgctgagctttggagtggccgctgtggccagcctgctggccgccctgtgctacgccgagtttggagcccgggtgcccaggactggaagtgcctacctgttcacctacgtgtccatgggagagctgtgggccttcctgattggctggaatgtgctgctggagtacatcatcggcggcgctgctgtggcccgggcctggagcggctacctggacagcatgttcagccacagcatccggaacttcacagagacccacgtgggctcctggcaggtgcccctgctgggccactacccagacttcctggccgccggcatcatcctgctggccagcgcctttgtgtcctgtggggcccgggtgtcctcctggctgaaccacaccttcagcgccatcagcctgctggtgatcctcttcatcgtcatcctgggcttcatcctggcccagccccacaactggagcgcagatgaaggaggctttgcccccttcggcttctctggagtgatggccggcacagccagctgcttctacgcctttgtgggctttgatgtgattgctgccagcagcgaggaggcccagaaccccaggagatctgtgcccctggccatcgccatcagcctggccatcgccgccggggcctacatcctggtgtccacagtgctgaccctgatggtgccctggcacagcctggaccctgattctgccctggctgatgccttctaccagaggggctaccgctgggccggcttcatcgtggccgccggcagcatctgtgccatgaacacagtgctgctgagcctgctcttcagcctgcccagaattgtgtatgccatggctgctgatggcctcttcttccaggtgtttgcccacgtgcaccccaggacccaggtgcctgtggccggcaccctggccttcggcctgctgacagccttcctggccctgctgctggacctggagagcctggtgcagttcctgagcctgggcaccctgctggcctacacctttgtggccaccagcatcatcgtgctgcgcttccagaagagcagcccccccagcagccctggccctgccagccctggccccctgaccaagcagcagagcagcttcagtgaccacctgcagctggtgggcaccgtgcacgcctctgtgcctgagcctggagagctgaagccagccctgcggccctacctgggcttcctggatggctacagccctggagctgtggtgacctgggccctgggcgtgatgctggccagcgccatcaccatcggctgtgtgctggtgtttggaaacagcaccctgcacctgccccactggggctacatcctgctgctgctgctgacctctgtgatgttcctgctgagcctgctggtgctgggcgcccaccagcagcagtacagagaagatctcttccagatccccatggtgcccctcatcccagccctgagcatcgtgctgaacatctgcctgatgctgaagctgagctacctgacctgggtgcgcttcagcatctggctgctgatgggcctggccgtgtacttcggctacggcatccgccacagcaaggagaaccagcgggagctgcccggcctgaacagcacccactacgtggtgttcccccggggcagcctggaggagaccgtgcaggccatgcagccccccagccaggccccagcccaggaccccggccacatggagtag

SEQ ID NO: 171032 - DNA, 1908 bp, Artificial Sequence; identical to SEQ ID NO: 171031
  Description of Artificial Sequence: Synthetic coding sequence

SEQ ID NO: 171033 - DNA, 249 bp, Artificial Sequence
  Description of Artificial Sequence: Synthetic coding sequence
atggcccggggcctgcccaccatcgccagcctggcccggctgtgccagaagctgaaccggctgaagcccctggaggacagcaccatggagaccagcctgcggcgctgcctgagcaccctggacctgaccctgctgggcgtgggcggcatggtgggcagcggcctgtatgtgctgactggagctgtggccaaggaggtggccggccctgctgtgctgctgagctttggagtggccgctgtggccagctag

SEQ ID NO: 171034 - DNA, 2922 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgaccctgatggccctgggcagcagcgcccctgagatcctgctgagcgtcatcgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctaccgggccggcaagcagaggggcatgatcatcgagcacgagggggaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgactggagctggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatcagaagaggaggagacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaagaagatgagaacttcctggtgcacctgagcaatgtgaaggtgagcagcgaggcctctgaagatggcatcctggaggccaaccacgtgtccaccctggcctgcctgggcagccccagcacagccaccgtgaccatctttgatgatgaccatgctggcatcttcacctttgaggagcctgtgacccacgtgtctgagagcatcggcatcatggaggtgaaggtgctgcggaccagcggggcccggggaaatgtgattgtgccctacaagaccatcgagggcacagcccggggcggcggggaggactttgaggacacctgtggggagctggagttccagaatgatgagatcgtgaagaccatctctgtgaaggtgattgatgatgaggagtatgagaagaacaagaccttcttcctggagatcggggagccccggctggtggagatgtctgagaagaaggccctgctgctgaatgagctgggcggcttcaccatcaccgggaagtacctgtttggccagcctgtgttcaggaaggtgcacgcccgggagcaccccatcctgagcaccgtcatcaccatcgcagatgaatatgatgacaagcagcccctgaccagcaaggaggaggaggagaggagaattgctgagatgggccggcccatcctgggggagcacaccaagctggaggtgatcatcgaggagagctatgagttcaagagcacagtggacaagctgatcaagaagaccaacctggccctggtggtgggcaccaacagctggagggagcagttcatcgaggccatcaccgtgtctgctggggaggatgatgatgatgatgaatgtggggaggagaagctgcccagctgctttgattatgtgatgcacttcctgaccgtcttctggaaggtgctgtttgcctttgtgcccccaacagagtactggaatggctgggcctgcttcatcgtgtccatcctgatgattggcctgctgacagccttcatcggggacctggccagccacttcggctgcaccatcggcctgaaggacagcgtgacagctgtggtgtttgtggccctgggcacctctgtgcctgacacctttgccagcaaggtggccgccacccaggaccagtatgcagatgccagcattggaaatgtgacaggcagcaatgctgtgaatgtgttcctgggcatcggcgtggcctggagcattgctgccatctaccacgccgccaacggggagcagttcaaggtgtccccaggcaccctggccttctctgtgaccctcttcaccatctttgccttcatcaacgtgggcgtgctgctgtacagaagaagacctgagattggaggagagctgggcggccccaggacagccaagctgctgaccagctgcctgtttgtgctgctgtggctgctgtacatcttcttcagcagcctggaggcctactgccacatcaagggcttctag

SEQ ID NO: 171035 - DNA, 2922 bp, Artificial Sequence; identical to SEQ ID NO: 171034
  Description of Artificial Sequence: Synthetic coding sequence

SEQ ID NO: 171036 - DNA, 2814 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgaccctgatggccctgggcagcagcgcccctgagatcctgctgagcgtcatcgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctaccgggccggcaagcagaggggcatgatcatcgagcacgagggggaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgactggagctggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatcagaagaggaggagacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaagaagatgagaacttcctggtgcacctgagcaatgtgaaggtgagcagcgaggcctctgaagatggcatcctggaggccaaccacgtgtccaccctggcctgcctgggcagccccagcacagccaccgtgaccatctttgatgatgaccatgctggcatcttcacctttgaggagcctgtgacccacgtgtctgagagcatcggcatcatggaggtgaaggtgctgcggaccagcggggcccggggaaatgtgattgtgccctacaagaccatcgagggcacagcccggggcggcggggaggactttgaggacacctgtggggagctggagttccagaatgatgagatcgtgaagatcatcaccatccgcatctttgaccgggaggagtatgagaaggaatgttccttcagcctggtgctggaggagcccaagtggatcagaagaggcatgaagggcggcttcaccatcacagatgaatatgatgacaagcagcccctgaccagcaaggaggaggaggagaggagaattgctgagatgggccggcccatcctgggggagcacaccaagctggaggtgatcatcgaggagagctatgagttcaagagcacagtggacaagctgatcaagaagaccaacctggccctggtggtgggcaccaacagctggagggagcagttcatcgaggccatcaccgtgtctgctggggaggatgatgatgatgatgaatgtggggaggagaagctgcccagctgctttgattatgtgatgcacttcctgaccgtcttctggaaggtgctgtttgcctttgtgcccccaacagagtactggaatggctgggcctgcttcatcgtgtccatcctgatgattggcctgctgacagccttcatcggggacctggccagccacttcggctgcaccatcggcctgaaggacagcgtgacagctgtggtgtttgtggccctgggcacctctgtgcctgacacctttgccagcaaggtggccgccacccaggaccagtatgcagatgccagcattggaaatgtgacaggcagcaatgctgtgaatgtgttcctgggcatcggcgtggcctggagcattgctgccatctaccacgccgccaacggggagcagttcaaggtgtccccaggcaccctggccttctctgtgaccctcttcaccatctttgccttcatcaacgtgggcgtgctgctgtacagaagaagacctgagattggaggagagctgggcggccccaggacagccaagctgctgaccagctgcctgtttgtgctgctgtggctgctgtacatcttcttcagcagcctggaggcctactgccacatcaagggcttctag

SEQ ID NO: 171037 - DNA, 2922 bp, Artificial Sequence; identical to SEQ ID NO: 171034
  Description of Artificial Sequence: Synthetic coding sequence

SEQ ID NO: 171038 - DNA, 2814 bp, Artificial Sequence; identical to SEQ ID NO: 171036
  Description of Artificial Sequence: Synthetic coding sequence

SEQ ID NO: 171039 - DNA, 2907 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgaccctgatggccctgggcagcagcgcccctgagatcctgctgagcgtcatcgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctaccgggccggcaagcagaggggcatgatcatcgagcacgagggggaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgactggagctggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatcagaagaggaggagacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaagaagatgagaacttcctggtgcacctgagcaatgtgaaggtgagcagcgaggcctctgaagatggcatcctggaggccaaccacgtgtccaccctggcctgcctgggcagccccagcacagccaccgtgaccatctttgatgatgaccatgctggcatcttcacctttgaggagcctgtgacccacgtgtctgagagcatcggcatcatggaggtgaaggtgctgcggaccagcggggcccggggaaatgtgattgtgccctacaagaccatcgagggcacagcccggggcggcggggaggactttgaggacacctgtggggagctggagttccagaatgatgagatcgtgaagaccatctctgtgaaggtgattgatgatgaggagtatgagaagaacaagaccttcttcctggagatcggggagccccggctggtggagatgtctgagaagaaggccctgctgctgaatgagctgggcggcttcaccatcaccggccagcccgtcttcaggaaggtgcacgcccgggagcaccccatcctgagcaccgtcatcaccatcgcagatgaatatgatgacaagcagcccctgaccagcaaggaggaggaggagaggagaattgctgagatgggccggcccatcctgggggagcacaccaagctggaggtgatcatcgaggagagctatgagttcaagagcacagtggacaagctgatcaagaagaccaacctggccctggtggtgggcaccaacagctggagggagcagttcatcgaggccatcaccgtgtctgctggagaagatgatgatgatgatgaatgtggggaggagaagctgcccagctgctttgattatgtgatgcacttcctgactgtgttctggaaggtgctgtttgcctttgtgcccccaacagagtactggaatggctgggcctgcttcatcgtgtccatcctgatgattggcctgctgacagccttcatcggggacctggccagccacttcggctgcaccatcggcctgaaggacagcgtgacagctgtggtgtttgtggccctgggcacctctgtgcctgacacctttgccagcaaggtggccgccacccaggaccagtatgcagatgccagcattggaaatgtgacaggcagcaatgctgtgaatgtgttcctgggcattggagtggcctggagcattgctgccatctaccacgccgccaatggagagcagttcaaggtgtccccaggcaccctggccttctctgtgaccctcttcaccatctttgccttcatcaacgtgggcgtgctgctgtacagaagaagacctgagatcggcggggagctgggcggccccaggacagccaagctgctgaccagctgcctgtttgtgctgctgtggctgctgtacatcttcttcagcagcctggaggcctactgccacatcaagggcttctag

SEQ ID NO: 171040 - DNA, 2814 bp, Artificial Sequence; identical to SEQ ID NO: 171036
  Description of Artificial Sequence: Synthetic coding sequence

SEQ ID NO: 171041 - DNA, 2814 bp, Artificial Sequence; identical to SEQ ID NO: 171036
  Description of Artificial Sequence: Synthetic coding sequence

SEQ ID NO: 171042 - DNA, 1995 bp, Artificial Sequence
  Description of Artificial Sequence: Synthetic coding sequence
atgaggcggctgagcctgagccccaccttctccatgggcttccacctgctggtgacagtgtccctgctcttcagccacgtggaccacgtgattgctgagacagagatggagggggagggcaatgaaacaggagaatgtacaggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaggtgatcaccagccaggagaaggagatcaccatcaagaagcccaacggggagaccaccaagaccaccgtgcgcatctggaatgagaccgtgagcaacctgaccctgatggccctgggcagcagcgcccctgagatcctgctgtctgtgattgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctacagagctgggaagcagaggggcatgatcattgaacatgaaggagaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgaccggggccggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatccggcggggcggggacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaggaggatgagaacttcctggtgcacctgagcaatgtgaaggtgtcctctgaggcctctgaagatggcatcctggaggccaaccacgtgtccaccctggcctgcctgggcagccccagcacagccaccgtgaccatctttgatgatgaccacgccggcatcttcacctttgaggagcctgtgacccacgtgtctgagagcatcggcatcatggaggtgaaggtgctgcggaccagcggggcccggggaaatgtcatcgtgccctacaagaccatcgagggcacagcccggggcggcggagaagattttgaggacacctgtggggagctggagttccagaatgatgaaattgtgaagaccatctctgtgaaggtgattgatgatgaggagtatgagaagaacaagaccttcttcctggagattggagagccccggctggtggagatgtctgagaagaagggccgcagcctgcccctggagtacctgactgtgaggaacatgaggaagtctgctgtgagccccctgtgcctgaggaaccagaatggatag

SEQ ID NO: 171043 - DNA, 2898 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgaccctgatggccctgggcagcagcgcccctgagatcctgctgagcgtcatcgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctaccgggccggcaagcagaggggcatgatcatcgagcacgagggggaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgactggagctggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatcagaagaggaggagacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaagaagatgagaacttcctggtgcacctgagcaatgtgaaggtgagcagcgaggcctctgaagatggcatcctggaggccaaccacgtgtccaccctggcctgcctgggcagccccagcacagccaccgtgaccatctttgatgatgaccatgctggcatcttcacctttgaggagcctgtgacccacgtgtctgagagcatcggcatcatggaggtgaaggtgctgcggaccagcggggcccggggaaatgtgattgtgccctacaagaccatcgagggcacagcccggggcggcggggaggactttgaggacacctgtggggagctggagttccagaatgatgagatcgtgaagatcatcaccatccgcatctttgaccgggaggagtatgagaaggaatgttccttcagcctggtgctggaggagcccaagtggatcagaagaggcatgaagggcggcttcaccatcaccgggaagtacctgtttggccagcctgtgttcaggaaggtgcacgcccgggagcaccccatcctgagcaccgtcatcaccatcgcagatgaatatgatgacaagcagcccctgaccagcaaggaggaggaggagaggagaattgctgagatgggccggcccatcctgggggagcacaccaagctggaggtgatcatcgaggagagctatgagttcaagagcacagtggacaagctgatcaagaagaccaacctggccctggtggtgggcaccaacagctggagggagcagttcatcgaggccatcaccgtgtctgctggggaggatgatgatgatgatgaatgtggggaggagaagctgcccagctgctttgattatgtgatgcacttcctgaccgtcttctggaaggtgctgtttgcctttgtgcccccaacagagtactggaatggctgggcctgcttcatcgtgtccatcctgatgattggcctgctgacagccttcatcggggacctggccagccacttcggctgcaccatcggcctgaaggacagcgtgacagctgtggtgtttgtggccctgggcacctctgtgcctgacacctttgccagcaaggtggccgccacccaggaccagtatgcagatgccagcattggaaatgtgacaggcagcaatgctgtgaatgtgttcctgggcatcggcgtggcctggagcattgctgccatctaccacgccgccaacggggagcagttcaaggtgtccccaggcaccctggccttctctgtgaccctcttcaccatctttgccttcatcaacgtgggcgtgctgctgtacagaagaagacctgagattggaggagagctgggcggccccaggacagccaagctgctgaccagctgcctgtttgtgctgctgtggctgctgtacatcttcttcagcagcctggaggcctactgccacatcaagggcttctag

SEQ ID NO: 171044 - DNA, 222 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagactag

SEQ ID NO: 171045 - DNA, 264 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtactag

SEQ ID NO: 171046 - DNA, 264 bp, Artificial Sequence; identical to SEQ ID NO: 171045
  Description of Artificial Sequence: Synthetic coding sequence

SEQ ID NO: 171047 - DNA, 2883 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgaccctgatggccctgggcagcagcgcccctgagatcctgctgagcgtcatcgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctaccgggccggcaagcagaggggcatgatcatcgagcacgagggggaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgactggagctggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatcagaagaggaggagacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaagaagatgagaacttcctggtgcacctgagcaatgtgaaggtgagcagcgaggcctctgaagatggcatcctggaggccaaccacgtgtccaccctggcctgcctgggcagccccagcacagccaccgtgaccatctttgatgatgaccatgctggcatcttcacctttgaggagcctgtgacccacgtgtctgagagcatcggcatcatggaggtgaaggtgctgcggaccagcggggcccggggaaatgtgattgtgccctacaagaccatcgagggcacagcccggggcggcggggaggactttgaggacacctgtggggagctggagttccagaatgatgagatcgtgaagatcatcaccatccgcatctttgaccgggaggagtatgagaaggaatgttccttcagcctggtgctggaggagcccaagtggatcagaagaggcatgaaggagggcttctggctgagcagccagcccgtcttcaggaaggtgcacgcccgggagcaccccatcctgagcaccgtcatcaccatcgcagatgaatatgatgacaagcagcccctgaccagcaaggaggaggaggagaggagaattgctgagatgggccggcccatcctgggggagcacaccaagctggaggtgatcatcgaggagagctatgagttcaagagcacagtggacaagctgatcaagaagaccaacctggccctggtggtgggcaccaacagctggagggagcagttcatcgaggccatcaccgtgtctgctggagaagatgatgatgatgatgaatgtggggaggagaagctgcccagctgctttgattatgtgatgcacttcctgactgtgttctggaaggtgctgtttgcctttgtgcccccaacagagtactggaatggctgggcctgcttcatcgtgtccatcctgatgattggcctgctgacagccttcatcggggacctggccagccacttcggctgcaccatcggcctgaaggacagcgtgacagctgtggtgtttgtggccctgggcacctctgtgcctgacacctttgccagcaaggtggccgccacccaggaccagtatgcagatgccagcattggaaatgtgacaggcagcaatgctgtgaatgtgttcctgggcattggagtggcctggagcattgctgccatctaccacgccgccaatggagagcagttcaaggtgtccccaggcaccctggccttctctgtgaccctcttcaccatctttgccttcatcaacgtgggcgtgctgctgtacagaagaagacctgagatcggcggggagctgggcggccccaggacagccaagctgctgaccagctgcctgtttgtgctgctgtggctgctgtacatcttcttcagcagcctggaggcctactgccacatcaagggcttctag

SEQ ID NO: 171048 - DNA, 2814 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgaccctgatggccctgggcagcagcgcccctgagatcctgctgagcgtcatcgaggtgtgtggccacaacttcaccgctggggacctgggccccagcaccatcgtgggcagcgctgccttcaacatgttcatcatcatcgccctgtgtgtgtatgtggtgcctgatggagagaccaggaagatcaagcacctgcgggtcttctttgtgacagctgcctggagcatctttgcctacacctggctgtacatcatcctgagcgtcatcagccctggggtggtggaggtgtgggagggcctgctgaccttcttcttcttccccatctgtgtggtgtttgcctgggtggccgaccggcggctgctcttctacaagtatgtgtacaagcgctaccgggccggcaagcagaggggcatgatcatcgagcacgagggggaccggcccagcagcaagacagaaattgagatggatggcaaggtggtgaacagccacgtggagaacttcctggatggagccctggtgctggaggtggatgagcgggaccaggatgatgaggaggcccggcgggagatggcccgcatcctgaaggagctgaagcagaagcacccagacaaggagattgagcagctgattgagctggccaactaccaggtgctgagccagcagcagaagagccgggccttctaccgcatccaggccacccggctgatgactggagctggcaacatcctgaagagacatgctgctgaccaggccaggaaggctgtgtccatgcatgaggtgaacacagaggtgacagaaaatgaccctgtgtccaagatcttctttgagcagggcacctaccagtgcctggagaactgtggcaccgtggccctgaccatcatcagaagaggaggagacctgaccaacacagtgtttgtggacttcagaacagaagatggaacagccaatgccggcagtgactatgagttcacagagggcaccgtggtgttcaagccaggggacacccagaaggagatccgggtgggcatcattgatgatgacatctttgaagaagatgagaacttcctggtgcacctgagcaatgtgaaggtgagcagcgaggcctctgaagatggcatcctggaggccaaccacgtgtccaccctggcctgcctgggcagccccagcacagccaccgtgaccatctttgatgatgaccatgctggcatcttcacctttgaggagcctgtgacccacgtgtctgagagcatcggcatcatggaggtgaaggtgctgcggaccagcggggcccggggaaatgtgattgtgccctacaagaccatcgagggcacagcccggggcggcggggaggactttgaggacacctgtggggagctggagttccagaatgatgagatcgtgaagatcatcaccatccgcatctttgaccgggaggagtatgagaaggaatgttccttcagcctggtgctggaggagcccaagtggatcagaagaggcatgaaggagggcttctgcttcacagatgaatatgatgacaagcagcccctgaccagcaaggaggaggaggagaggagaattgctgagatgggccggcccatcctgggggagcacaccaagctggaggtgatcatcgaggagagctatgagttcaagagcacagtggacaagctgatcaagaagaccaacctggccctggtggtgggcaccaacagctggagggagcagttcatcgaggccatcaccgtgtctgctggggaggatgatgatgatgatgaatgtggggaggagaagctgcccagctgctttgattatgtgatgcacttcctgaccgtcttctggaaggtgctgtttgcctttgtgcccccaacagagtactggaatggctgggcctgcttcatcgtgtccatcctgatgattggcctgctgacagccttcatcggggacctggccagccacttcggctgcaccatcggcctgaaggacagcgtgacagctgtggtgtttgtggccctgggcacctctgtgcctgacacctttgccagcaaggtggccgccacccaggaccagtatgcagatgccagcattggaaatgtgacaggcagcaatgctgtgaatgtgttcctgggcatcggcgtggcctggagcattgctgccatctaccacgccgccaacggggagcagttcaaggtgtccccaggcaccctggccttctctgtgaccctcttcaccatctttgccttcatcaacgtgggcgtgctgctgtacagaagaagacctgagattggaggagagctgggcggccccaggacagccaagctgctgaccagctgcctgtttgtgctgctgtggctgctgtacatcttcttcagcagcctggaggcctactgccacatcaagggcttctag

SEQ ID NO: 171049 - DNA, 417 bp, Artificial Sequence
  Description of Artificial Sequence: Synthetic coding sequence
atgtacaacatgaggcggctgagcctgagccccaccttctccatgggcttccacctgctggtgacagtgtccctgctcttcagccacgtggaccacgtgattgctgagacagagatggagggggagggcaatgagaccggggagtgcaccggcagctactactgcaagaagggcgtcatcctgcccatctgggagccccaggaccccagctttggagacaagatcgcccgggccaccgtgtactttgtggccatggtgtacatgttcctgggcgtgtccatcatcgctgaccgcttcatgagcagcattgaagtcatcaccagccaggagaaggagatcaccatcaagaagcccaatggagagaccaccaagaccaccgtgcgcatctggaatgaaacagtgagcaacctgacctag

SEQ ID NO: 171050 - DNA, 2907 bp, Artificial Sequence; identical to SEQ ID NO: 171039
  Description of Artificial Sequence: Synthetic coding sequence

SEQ ID NO: 171051 - DNA, 2766 bp, Artificial Sequence
  Description of Artificial Sequence: Synthetic coding sequence
atggcccccctggccctggtgggcgtgaccctgctgctggccgccccaccctgcagcggggccgccacccccacccccagcctgcccccacctccagccaatgacagcgacaccagcactggaggctgccagggcagctaccgctgccagcccggggtgctgctgcctgtgtgggagccagatgaccccagcctgggggacaaggccgcccgggctgtggtgtactttgtggccatggtgtacatgttcctgggcgtgtccatcatcgctgaccgcttcatggccgccattgaagtcatcaccagcaaggagaaggagatcaccatcaccaaggccaatggagagacctctgtgggcaccgtgcgcatctggaatgaaacagtgagcaacctgaccctgatggccctgggcagcagcgcccctgagatcctgctgagcgtcatcgaggtgtgtggccacaacttccaggccggggagctgggccctggcaccatcgtgggcagcgctgccttcaacatgtttgtggtgattgctgtgtgcatctacgtgatcccagctggggagagcaggaagatcaagcacctgcgggtcttctttgtgacagcctcctggagcatctttgcctacgtgtggctgtacctgatcctggccgtgttcagccctggggtggtgcaggtgtgggaggccctgctgaccctggtgttcttccctgtgtgtgtggtgtttgcctggatggctgacaagaggctgctcttctacaagtatgtgtacaagcgctacagaacagaccccaggagcggcatcatcatcggggctgagggggacccccccaagagcattgagctggatggcacctttgtgggcgctgaggcccctggagagctgggcggcctgggccctggccctgctgaggcccgggagctggatgccagccggcgggaggtgatccagatcctgaaggacctgaagcagaagcacccagacaaggacctggagcagctggtgggcatcgccaactactatgccctgctgcaccagcagaagagccgggccttctaccgcatccaggccacccggctgatgaccggggctggaaatgtgctgcggagacatgctgctgatgccagcagaagagctgccccagctgagggcgctggagaagatgaagatgatggagccagccgcatcttctttgagcccagcctgtaccactgcctggagaactgtggctctgtgctgctgtctgtgacctgccagggcggggagggcaacagcaccttctacgtggactacagaacagaagatggcagcgccaaggccggcagtgactatgagtacagcgagggcaccctggtgttcaagccaggagagacccagaaggagctgcgcatcggcatcattgatgatgacatctttgaggaggatgagcacttctttgtgcggctgctgaacctgcgggtgggagatgcccagggcatgtttgagccagatggcggcggccggcccaagggccgcctggtggcccccctgctggccaccgtgaccatcctggatgatgaccacgccggcatcttctccttccaggaccggctgctgcacgtgtctgagtgcatgggcaccgtggatgtgcgggtggtgcgcagcagcggggcccggggcaccgtgcggctgccctacagaacagtggatggaacagcccggggcggcggcgtgcactatgaagatgcctgtggggagctggagtttggagatgatgagaccatgaagaccctgcaggtgaagatcgtggatgatgaggagtatgagaagaaggacaacttcttcatcgagctgggccagccccagtggctgaagaggggcatcagcgccctgctgctgaaccagggagatggagacaggaagctgacagctgaggaggaggaggccaggagaattgctgagatgggcaagcctgtgctgggggagaactgccgcctggaggtgatcatcgaggagagctatgacttcaagaacacagtggacaagctgatcaagaagaccaacctggccctggtgattggcacccacagctggagggagcagttcctggaggccatcaccgtgtctgctggagatgaggaggaggaggaggatggcagccgggaggagcggctgcccagctgctttgattatgtgatgcacttcctgaccgtcttctggaaggtgctgtttgcctgtgtgcccccaacagagtactgccacggctgggcctgcttcggcgtgtccatcctggtgattggcctgctgacagccctgattggagacctggccagccacttcggctgcaccgtgggcctgaaggacagcgtgaatgctgtggtgtttgtggccctgggcaccagcatcccagacacctttgccagcaaggtggccgccctgcaggaccagtgtgctgatgccagcattggaaatgtgacaggcagcaatgctgtgaatgtgttcctgggcctgggcgtggcctggagcgtggccgctgtgtactgggccgtgcagggccggccctttgaggtgaggacaggcaccctggccttctctgtgaccctcttcaccgtgtttgcctttgtgggcattgctgtgctgctgtacagaagaagaccccacatcggcggggagctgggcggcccccggggccccaagctggccaccacagccctcttcctgggcctgtggctgctgtacatcctgtttgccagcctggaggcctactgccacatccggggcttctag

SEQ ID NO: 171052 - DNA, 2478 bp, Artificial Sequence
  Description of Artificial Sequence: Synthetic coding sequence
atgtttgtggtgattgctgtgtgcatctacgtgatcccagctggggagagcaggaagatcaagcacctgcgggtcttctttgtgacagcctcctggagcatctttgcctacgtgtggctgtacctgatcctggccgtgttcagccctggggtggtgcaggtgtgggaggccctgctgaccctggtgttcttccctgtgtgtgtggtgtttgcctggatggctgacaagaggctgctcttctacaagtatgtgtacaagcgctacagaacagaccccaggagcggcatcatcatcggggctgagggggacccccccaagagcattgagctggatggcacctttgtgggcgctgaggcccctggagagctgggcggcctgggccctggccctgctgaggcccgggagctggatgccagccggcgggaggtgatccagatcctgaaggacctgaagcagaagcacccagacaaggacctggagcagctggtgggcatcgccaactactatgccctgctgcaccagcagaagagccgggccttctaccgcatccaggccacccggctgatgaccggggctggaaatgtgctgcggagacatgctgctgatgccagcagaagagctgccccagctgagggcgctggagaagatgaagatgatggagccagccgcatcttctttgagcccagcctgtaccactgcctggagaactgtggctctgtgctgctgtctgtgacctgccagggcggggagggcaacagcaccttctacgtggactacagaacagaagatggcagcgccaaggccggcagtgactatgagtacagcgagggcaccctggtgttcaagccaggagagacccagaaggagctgcgcatcggcatcattgatgatgacatctttgaggaggatgagcacttctttgtgcggctgctgaacctgcgggtgggagatgcccagggcatgtttgagccagatggcggcggccggcccaagggccgcctggtggcccccctgctggccaccgtgaccatcctggatgatgaccacgccggcatcttctccttccaggaccggctgctgcacgtgtctgagtgcatgggcaccgtggatgtgcgggtggtgcgcagcagcggggcccggggcaccgtgcggctgccctacagaacagtggatggaacagcccggggcggcggcgtgcactatgaagatgcctgtggggagctggagtttggagatgatgagaccatgaagaccctgcaggtgaagatcgtggatgatgaggagtatgagaagaaggacaacttcttcatcgagctgggccagccccagtggctgaagaggggcatcagcgccctgctgctgaaccagggagatggagacaggaagctgacagctgaggaggaggaggccaggagaattgctgagatgggcaagcctgtgctgggggagaactgccgcctggaggtgatcatcgaggagagctatgacttcaagaacacagtggacaagctgatcaagaagaccaacctggccctggtgattggcacccacagctggagggagcagttcctggaggccatcaccgtgtctgctggagatgaggaggaggaggaggatggcagccgggaggagcggctgcccagctgctttgattatgtgatgcacttcctgaccgtcttctggaaggtgctgtttgcctgtgtgcccccaacagagtactgccacggctgggcctgcttcggcgtgtccatcctggtgattggcctgctgacagccctgattggagacctggccagccacttcggctgcaccgtgggcctgaaggacagcgtgaatgctgtggtgtttgtggccctgggcaccagcatccctggcaacaccctgggggactttggaggagtgggcagccagatgagccaggccggggccacccaggaccctgccaagatgagacatgtgcggcagcagggcggcggcgctgctggccctgtgagaagaagagtgcaccggcagagggaccggctgcagagaggagagcgggtgccctggccaggccggcggctggtgtgtggccggcgggtgctgggcggggccggcccccccctgcggggggcccactggcatgctggcctgctgcggcatgccctgcaccggctgcggctgcggggccactgcagagctgctgtgcctgccccagctgcccacagaagaagagctggccggcctgcccggacccaggcccggcaccaccgggccctgcccggccccctggcccctgtgcaccccctgcggcagcccggcggcgtgctgccccaccctggcctgctgggccccagggctgagacccggccccacaggcctcctggggcccgggacagcgctgccccagccctgggcccctggagccccttccccccccggctgggcctgctgtcctgggacagcgccagcctgctgcggcccctgccctggctgtag

SEQ ID NO: 171053 - DNA, 1155 bp, Artificial Sequence
  Description of Artificial Sequence: Synthetic coding sequence
atgggcaccgtggatgtgcgggtggtgcgcagcagcggggcccggggcaccgtgcggctgccctacagaacagtggatggaacagcccggggcggcggcgtgcactatgaagatgcctgtggggagctggagtttggagatgatgagaccatgaagaccctgcaggtgaagatcgtggatgatgaggagtatgagaagaaggacaacttcttcatcgagctgggccagccccagtggctgaagaggggcatcagcgccctgctgctgaaccagggagatggagacaggaagctgacagctgaggaggaggaggccaggagaattgctgagatgggcaagcctgtgctgggggagaactgccgcctggaggtgatcatcgaggagagctatgacttcaagaacacagtggacaagctgatcaagaagaccaacctggccctggtgattggcacccacagctggagggagcagttcctggaggccatcaccgtgtctgctggagatgaggaggaggaggaggatggcagccgggaggagcggctgcccagctgctttgattatgtgatgcacttcctgactgtgttctggaaggtgctgtttgcctgtgtgcccccaacagagtactgccacggctgggcctgctttggagtgtccatcctggtgattggcctgctgacagccctgattggagacctggccagccacttcggctgcaccgtgggcctgaaggacagcgtgaatgctgtggtgtttgtggccctgggcaccagcatcccagacacctttgccagcaaggtggccgccctgcaggaccagtgtgctgatgccagcattggaaatgtgacaggcagcaatgctgtgaatgtgttcctgggcctgggcgtggcctggagcgtggccgctgtgtactgggccgtgcagggccggccctttgaggtgaggacaggcaccctggccttctctgtgaccctcttcaccgtgtttgcctttgtgggcattgctgtgctgctgtacagaagaagaccccacatcggcggggagctgggcggcccccggggccccaagctggccaccacagccctcttcctgggcctgtggctgctgtacatcctgtttgccagcctggaggcctactgccacatccggggcttctag

SEQ ID NO: 171054 - DNA, 2034 bp, Artificial Sequence
  Description of Artificial Sequence: Synthetic coding sequence
atggctgacaagaggctgctcttctacaagtatgtgtacaagcgctacagaacagaccccaggagcggcatcatcatcggggctgagggggacccccccaagagcattgagctggatggcacctttgtgggcgctgaggcccctggagagctgggcggcctgggccctggccctgctgaggcccgggagctggatgccagccggcgggaggtgatccagatcctgaaggacctgaagcagaagcacccagacaaggacctggagcagctggtgggcatcgccaactactatgccctgctgcaccagcagaagagccgggccttctaccgcatccaggccacccggctgatgaccggggctggaaatgtgctgcggagacatgctgctgatgccagcagaagagctgccccagctgagggcgctggagaagatgaagatgatggagccagccgcatcttctttgagcccagcctgtaccactgcctggagaactgtggctctgtgctgctgtctgtgacctgccagggcggggagggcaacagcaccttctacgtggactacagaacagaagatggcagcgccaaggccggcagtgactatgagtacagcgagggcaccctggtgttcaagccaggagagacccagaaggagctgcgcatcggcatcattgatgatgacatctttgaggaggatgagcacttctttgtgcggctgctgaacctgcgggtgggagatgcccagggcatgtttgagccagatggcggcggccggcccaagggccgcctggtggcccccctgctggccaccgtgaccatcctggatgatgaccacgccggcatcttctccttccaggaccggctgctgcacgtgtctgagtgcatgggcaccgtggatgtgcgggtggtgcgcagcagcggggcccggggcaccgtgcggctgccctacagaacagtggatggaacagcccggggcggcggcgtgcactatgaagatgcctgtggggagctggagtttggagatgatgagaccatgaagaccctgcaggtgaagatcgtggatgatgaggagtatgagaagaaggacaacttcttcatcgagctgggccagccccagtggctgaagaggggcatcagcgccctgctgctgaaccagggagatggagacaggaagctgacagctgaggaggaggaggccaggagaattgctgagatgggcaagcctgtgctgggggagaactgccgcctggaggtgatcatcgaggagagctatgacttcaagaacacagtggacaagctgatcaagaagaccaacctggccctggtgattggcacccacagctggagggagcagttcctggaggccatcaccgtgtctgctggagatgaggaggaggaggaggatggcagccgggaggagcggctgcccagctgctttgattatgtgatgcacttcctgaccgtcttctggaaggtgctgtttgcctgtgtgcccccaacagagtactgccacggctgggcctgcttcggcgtgtccatcctggtgattggcctgctgacagccctgattggagacctggccagccacttcggctgcaccgtgggcctgaaggacagcgtgaatgctgtggtgtttgtggccctgggcaccagcatcccagacacctttgccagcaaggtggccgccctgcaggaccagtgtgctgatgccagcattggaaatgtgacaggcagcaatgctgtgaatgtgttcctgggcctgggcgtggcctggagcgtggccgctgtgtactgggccgtgcagggccggccctttgaggtgaggacaggcaccctggccttctctgtgaccctcttcaccgtgtttgcctttgtgggcattgctgtgctgctgtacagaagaagaccccacatcggcggggagctgggcggcccccggggccccaagctggccaccacagccctcttcctgggcctgtggctgctgtacatcctgtttgccagcctggaggcctactgccacatccggggcttctag

SEQ ID NO: 171055 - DNA, 2448 bp, Artificial Sequence
  Description of Artificial Sequence: Synthetic coding sequence
atggtgctgcggagcggcatctgtggcctgagcccccaccgcatcttccccagcctgctggtggtggtggccctggtgggcctgctgcctgtgctgcggagccacggcctgcagctgagccccacagccagcaccatccgcagcagcgagcccccccgggagaggagcattggagatgtgaccacagcccctcctgaggtgaccccagagagcaggcctgtgaaccacagcgtgacagaccacggcatgaagcccaggaaggccttccctgtgctgggcatcgactacacccacgtgaggaccccatttgagatcagcctgtggatcctgctggcctgcctgatgaagattggcttccacgtgatccccaccatcagcagcatcgtgcctgagagctgcctgctgattgtggtgggcctgctggtgggcggcctcatcaagggcgtgggggagaccccacccttcctgcagagtgatgtgttcttcctgttcctgctgccccccatcatcctggatgctggctacttcctgcccctgcggcagttcacagagaacctgggcaccatcctgatctttgctgtggtgggcaccctgtggaatgccttcttcctgggcggcctgatgtatgctgtgtgcctggtgggcggggagcagatcaacaacatcggcctgctggacaacctgctgtttggcagcatcatctctgctgtggaccctgtggccgtgctggccgtgtttgaggagatccacatcaatgagctgctgcacatcctggtgtttggagagagcctgctgaatgatgctgtgacagtggtgctgtaccacctgtttgaggagtttgccaactatgaacatgtgggcatcgtggacatcttcctgggcttcctgtccttctttgtggtggccctgggcggcgtgctggtgggcgtggtgtatggagtgattgctgccttcaccagccgcttcaccagccacatccgggtgattgagcccctgtttgtgttcctgtacagctacatggcctacctgtctgctgagctgttccacctgagcggcatcatggccctgattgccagcggcgtggtgatgaggccctacgtggaggccaacatcagccacaagagccacaccaccatcaagtacttcctgaagatgtggagctctgtgtctgagaccctcatcttcatcttcctgggcgtgtccacagtggccggcagccaccactggaactggacctttgtgatcagcaccctgctcttctgcctgattgcccgggtgctgggcgtgctgggcctgacctggttcatcaacaagttcagaattgtgaagctgacccccaaggaccagttcatcatcgcctacggcggcctgcggggggccatcgccttcagcctgggctacctgctggacaagaagcacttccccatgtgtgacctcttcctgacagccatcatcaccgtcatcttcttcaccgtgtttgtgcagggcatgaccatccggcccctggtggacctgctggccgtgaagaagaagcaggagaccaagaggagcatcaatgaggagatccacacccagttcctggaccacctgctgaccggcatcgaggacatctgtggccactacggccaccaccactggaaggacaagctgaaccgcttcaacaagaagtatgtgaagaagtgcctgattgctggggagaggagcaaggagccccagctgattgccttctaccacaagatggagatgaagcaggccatcgagctggtggagagcggcggcatgggcaagatccccagcgctgtgtccacagtgtccatgcagaacatccaccccaagagcctgcccagcgagcgcatcctgcctgccctgagcaaggacaaggaggaggagatcaggaagatcctgaggaacaacctgcagaagacccggcagaggctgcggagctacaacagacacaccctggtggccgacccctatgaggaggcctggaaccagatgctgctgcggcggcagaaggcccggcagctggagcagaagatcaacaactacctgactgtgcctgcccacaagctggacagccccaccatgagccgggccagaattggaagtgaccccctggcctatgagcccaaggaggacctgcctgtgatcaccattgatcctgccagcccccagagccctgagagcgtggacctggtgaatgaggagctgaagggcaaggtgctgggcctgagccgggaccctgccaaggtggccgaggaggatgaagatgatgatggcggcatcatgatgaggagcaaggagaccagcagccctggaacagatgatgtgttcaccccagcccccagcgacagccccagcagccagaggatccagcgctgcctgagtgaccccggcccccaccctgagcccggggagggggagcccttcttccccaagggccagtag

SEQ ID NO: 171056 - DNA, 408 bp, Artificial Sequence
  Description of Artificial Sequence: Synthetic coding sequence
atggtgctgcggagcggcatctgtggcctgagcccccaccgcatcttccccagcctgctggtggtggtggccctggtgggcctgctgcctgtgctgcggagccacggcctgcagctgagccccacagccagcaccatccgcagcagcgagcccccccgggagaggagcattggagatgtgaccacagcccctcctgaggtgaccccagagagcaggcctgtgaaccacagcgtgacagaccacggcatgaagcccaggaaggccttccctgtgctgggcatcgactacacccacgtgaggaccccatttgagatcagcctgtggatcctgctggcctgcctgatgaagattggcttcccctgtgacccccactacctgaagcacaggcctggagagctgcctgcctag

SEQ ID NO: 171057 - DNA, 1668 bp, Artificial Sequence
  Description of Artificial Sequence: Synthetic coding sequence
atggtgctgcggagcggcatctgtggcctgagcccccaccgcatcttccccagcctgctggtggtggtggccctggtgggcctgctgcctgtgctgcggagccacggcctgcagctgagccccacagccagcaccatccgcagcagcgagcccccccgggagaggagcattggagatgtgaccacagcccctcctgaggtgaccccagagagcaggcctgtgaaccacagcgtgacagaccacggcatgaagcccaggaaggccttccctgtgctgggcatcgactacacccacgtgaggaccccatttgagatcagcctgtggatcctgctggcctgcctgatgaagattggcttccacgtgatccccaccatcagcagcatcgtgcctgagagctgcctgctgattgtggtgggcctgctggtgggcggcctcatcaagggcgtgggggagaccccacccttcctgcagagtgatgtgttcttcctgttcctgctgccccccatcatcctggatgctggctacttcctgcccctgcggcagttcacagagaacctgggcaccatcctgatctttgctgtggtgggcaccctgtggaatgccttcttcctgggcggcctgatgtatgctgtgtgcctggtgggcggggagcagatcaacaacatcggcctgctggacaacctgctgtttggcagcatcatctctgctgtggaccctgtggccgtgctggccgtgtttgaggagatccacatcaatgagctgctgcacatcctggtgtttggagagagcctgctgaatgatgctgtgacagtggtgctgtaccacctgtttgaggagtttgccaactatgaacatgtgggcatcgtggacatcttcctgggcttcctgtccttctttgtggtggccctgggcggcgtgctggtgggcgtggtgtatggagtgattgctgccttcaccagccgcttcaccagccacatccgggtgattgagcccctgtttgtgttcctgtacagctacatggcctacctgtctgctgagctgttccacctgagcggcatcatggccctgattgccagcggcgtggtgatgaggccctacgtggaggccaacatcagccacaagagccacaccaccatcaagtacttcctgaagatgtggagctctgtgtctgagaccctcatcttcatcttcctgggcgtgtccacagtggccggcagccaccactggaactggacctttgtgatcagcaccctgctcttctgcctgattgcccgggtgctgggcgtgctgggcctgacctggttcatcaacaagttcagaattgtgaagctgacccccaaggaccagttcatcatcgcctacggcggcctgcggggggccatcgccttcagcctgggctacctgctggacaagaagcacttccccatgtgtgacctcttcctgacagccatcatcaccgtcatcttcttcaccgtgtttgtgcaggtgctgggccagggccgggccggcccctgcctgggggacccccacaggctcttcccctggaaggagaggaaggcctgtgacctgaagtgtgacagcagccccagcagcaccaccaacctgctgtgtgacctgggccgggccaccccacccttctgggcctctgtgagcagcatcgtgaagtag

SEQ ID NO: 171058 - DNA, 960 bp, Artificial Sequence
  Description of Artificial Sequence: Synthetic coding sequence
atgaccatccggcccctggtggacctgctggccgtgaagaagaagcaggagaccaagaggagcatcaatgaggagatccacacccagttcctggaccacctgctgaccggcatcgaggacatctgtggccactacggccaccaccactggaaggacaagctgaaccgcttcaacaagaagtatgtgaagaagtgcctgattgctggggagaggagcaaggagccccagctgattgccttctaccacaagatggagatgaagcaggccatcgagctggtggagagcggcggcatgggcaagatccccagcgctgtgtccacagtgtccatgcagaacatccaccccaagagcctgcccagcgagcgcatcctgcctgccctgagcaaggacaaggaggaggagatcaggaagatcctgaggaacaacctgcagaagacccggcagaggctgcggagctacaacagacacaccctggtggccgacccctatgaggaggcctggaaccagatgctgctgcggcggcagaaggcccggcagctggagcagaagatcaacaactacctgactgtgcctgcccacaagctggacagccccaccatgagccgggccagaattggaagtgaccccctggcctatgagcccaaggaggacctgcctgtgatcaccattgatcctgccagcccccagagccctgagagcgtggacctggtgaatgaggagctgaagggcaaggtgctgggcctgagccgggaccctgccaaggtggccgaggaggatgaagatgatgatggcggcatcatgatgaggagcaaggagaccagcagccctggaacagatgatgtgttcaccccagcccccagcgacagccccagcagccagaggatccagcgctgcctgagtgaccccggcccccaccctgagcccggggagggggagcccttcttccccaagggccagtag

SEQ ID NO: 171059 - DNA, 675 bp, Artificial Sequence
  Description of Artificial Sequence: Synthetic coding sequence
atggagatgaagcaggccatcgagctggtggagagcggcggcatgggcaagatccccagcgctgtgtccacagtgtccatgcagaacatccaccccaagagcctgcccagcgagcgcatcctgcctgccctgagcaaggacaaggaggaggagatcaggaagatcctgaggaacaacctgcagaagacccggcagaggctgcggagctacaacagacacaccctggtggccgacccctatgaggaggcctggaaccagatgctgctgcggcggcagaaggcccggcagctggagcagaagatcaacaactacctgactgtgcctgcccacaagctggacagccccaccatgagccgggcccgcatcggcagtgaccccctggcctatgagcccaaggaggacctgcccgtcatcaccatcgaccctgccagcccccagagccctgagagcgtggacctggtgaatgaggagctgaagggcaaggtgctgggcctgagccgggaccctgccaaggtggccgaggaggatgaagatgatgatggcggcatcatgatgaggagcaaggagaccagcagccctggaacagatgatgtgttcaccccagcccccagcgacagccccagcagccagaggatccagcgctgcctgagtgaccccggcccccaccctgagtag

SEQ ID NO: 171060 - DNA, 1431 bp, Artificial Sequence
  Description of Artificial Sequence: Synthetic coding sequence
atggcctacctgtctgctgagctgttccacctgagcggcatcatggccctgattgccagcggcgtggtgatgaggccctacgtggaggccaacatcagccacaagagccacaccaccatcaagtacttcctgaagatgtggagctctgtgtctgagaccctcatcttcatcttcctgggcgtgtccacagtggccggcagccaccactggaactggaccttcgtcatcagcaccctgctcttctgcctgattgcccgggtgctgggcgtgctgggcctgacctggttcatcaacaagttccgcatcgtgaagctgacccccaaggaccagttcatcatcgcctatggaggcctgcggggggccatcgccttcagcctgggctacctgctggacaagaagcacttccccatgtgtgacctcttcctgacagccatcatcaccgtcatcttcttcaccgtgtttgtgcagggcatgaccatccggcccctggtggacctgctggccgtgaagaagaagcaggagaccaagaggagcatcaatgaggagatccacacccagttcctggaccacctgctgactggaattgaggacatctgtggccactacggccaccaccactggaaggacaagctgaaccgcttcaacaagaagtatgtgaagaagtgcctgattgctggggagaggagcaaggagccccagctgattgccttctaccacaagatggagatgaagcaggccatcgagctggtggagagcggcggcatgggcaagatccccagcgctgtgtccacagtgtccatgcagaacatccaccccaagagcctgcccagcgagcgcatcctgcctgccctgagcaaggacaaggaggaggagatcaggaagatcctgaggaacaacctgcagaagacccggcagaggctgcggagctacaacagacacaccctggtggccgacccctatgaggaggcctggaaccagatgctgctgcggcggcagaaggcccggcagctggagcagaagatcaacaactacctgactgtgcctgcccacaagctggacagccccaccatgagccgggcccgcatcggcagtgaccccctggcctatgagcccaaggaggacctgcccgtcatcaccatcgaccctgccagcccccagagccctgagagcgtggacctggtgaatgaggagctgaagggcaaggtgctgggcctgagccgggaccctgccaaggtggccgaggaggatgaagatgatgatggcggcatcatgatgaggagcaaggagaccagcagccctggaacagatgatgtgttcaccccagcccccagcgacagccccagcagccagaggatccagcgctgcctgagtgaccccggcccccaccctgagcctggagagggggagcccttcttccccaagggccagtag

SEQ ID NO: 171061 - DNA, 1626 bp, Artificial Sequence; identical to SEQ ID NO: 156394
  Description of Artificial Sequence: Synthetic coding sequence

SEQ ID NO: 171062 - DNA, 2505 bp, Artificial Sequence
  Description of Artificial Sequence: Synthetic coding sequence
atgtggggcctgggcgcccggggccctgaccggggcctgctgctggccctggccctgggcggcctggcccgggccggcggcgtggaggtggagcccggcggggcccacggggagagcggcggcttccaggtggtgacctttgagtgggcccacgtgcaggacccctacgtgattgccctgtggatcctggtggccagcctggccaagattggcttccacctgagccacaaggtgacctctgtggtgcctgagagcgccctgctgattgtgctgggcctggtgctgggcggcatcgtgtgggccgctgaccacatcgccagcttcaccctgacccccaccgtcttcttcttctacctgctgccccccatcgtgctggatgctggctacttcatgcccaacagactcttctttggaaacctgggcaccatcctgctgtatgctgtggtgggcaccgtgtggaatgctgccaccaccggcctgagcctgtatggagtcttcctgagcggcctgatgggagacctgcagatcggcctgctggacttcctgctgtttggcagcctgatggctgctgtggaccctgtggccgtgctggccgtgtttgaggaggtgcacgtgaatgaggtgctcttcatcatcgtgtttggagagagcctgctgaatgatgctgtgacagtggtgctgtacaacgtgtttgagagctttgtggccctgggcggggacaacgtgactggagtggactgtgtgaagggcatcgtgtccttctttgtggtgtccctgggcggcaccctggtgggcgtggtgtttgccttcctgctgagcctggtgacccgcttcaccaagcacgtgcgcatcatcgagcccggctttgtgttcatcatctcctacctgagctacctgaccagcgagatgctgagcctgagcgccatcctggccatcaccttctgtggcatctgctgccagaagtatgtgaaggccaacatcagcgagcagagcgccaccaccgtgcgctacaccatgaagatgctggccagcagcgctgagaccatcatcttcatgttcctgggcatctctgctgtgaaccccttcatctggacctggaacacagcctttgtgctgctgaccctggtgttcatctctgtgtaccgggccatcggcgtggtgctgcagacctggctgctgaaccgctacaggatggtgcagctggagcccatcgaccaggtggtgctgtcctatggaggcctgcggggagctgtggcctttgccctggtggtgctgctggatggagacaaggtgaaggagaagaacctgtttgtgtccaccaccatcatcgtggtgttcttcaccgtcatcttccagggcctgaccatcaagcccctggtgcagtggctgaaggtgaagaggtctgagcaccgggagccccggctgaatgagaagctgcacggccgggcctttgaccacatcctgagcgccatcgaggacatcagcggccagatcggccacaactacctgcgggacaagtggagccactttgacaggaagttcctgagccgggtgctgatgagaagaagtgcccagaagagccgggaccgcatcctgaatgtgttccacgagctgaacctgaaggatgccatctcctatgtggccgagggggagcggcggggcagcctggccttcatccgcagccccagcacagacaacgtggtgaatgtggacttcacccccaggagcagcacagtggaggcctctgtgtcctacctgctgagagaaaatgtgtctgctgtgtgcctggacatgcagagcctggagcagaggagaagaagcatcagagatgctgaggacatggtgacccaccacaccctgcagcagtacctgtacaagccccggcaggagtacaagcacctgtacagcagacatgagctgacccccacagaagatgagaagcaggaccgggagatcttccacaggaccatgaggaagaggctggagagcttcaagagcaccaagctgggcctgaaccagaacaagaaggccgccaagctgtacaagcgggagcgggcccagaagagaagaaacagcagcatccccaacgggaagctgcccatggagagccctgcccagaacttcaccatcaaggagaaggacctggagctgagtgacacagaggagccccccaactatgatgaggagatgtctgggggcatcgagttcctggcctctgtgaccaaggacacagccagtgacagccctgctggcatcgacaaccctgtgttctccccagatgaggccctggacaggagcctgctggcccggctgcccccctggctgagccctggagagaccgtggtgcccagccagagggcccggacccagatcccctacagccctggcaccttctgccgcctgatgcccttccggctgagcagcaagtctgtggacagcttcctgcaggctgatggccctgaggagcggcccccagctgccctgcctgagagcacccacatgtag

SEQ ID NO: 171063 - DNA, 1077 bp, Artificial Sequence
  Description of Artificial Sequence: Synthetic coding sequence
atgtctgcagatgctgctgctggggcccccctgccccggctgtgctgcctggagaagggccccaacggctacggcttccacctgcatggagagaagggcaagctgggccagtacatccggctggtggagcccggcagccctgctgagaaggccggcctgctggccggggaccggctggtggaggtgaatggagaaaatgtggagaaggagacccaccagcaggtggtgagccgcatccgggccgccctgaatgctgtgcggctgctggtggtggaccctgagacagatgagcagctgcagaagctgggcgtgcaggtgcgggaggagctgctgcgggcccaggaggcccctggccaggccgagcccccagctgctgctgaggtgcagggcgctggaaatgaaaatgagccccgggaggccgacaagagccaccctgagcagcgggagctgcggccccggctgtgcaccatgaagaagggccccagcggctacggcttcaacctgcacagcgacaagagcaagccaggccagttcatccgctctgtggaccctgacagccctgctgaggccagcggcctgcgggcccaggacagaattgtggaggtgaatggagtgtgcatggagggcaagcagcacggagatgtggtgtctgccatccgggctggaggagatgagaccaagctgctggtggtggaccgggagacagatgagttcttcaagaagtgcagggtcatccccagccaggagcacctgaatggccccctgcctgtgcccttcaccaatggagagatccagaaggagaacagccgggaggccctggccgaggccgccctggagagccccaggcctgccctggtgcgcagcgccagcagtgacaccagcgaggagctgaacagccaggacagcccccccaagcaggacagcacagcccccagcagcaccagcagcagtgaccccatcctggacttcaacatcagcctggccatggccaaggagcgggcccaccagaagaggagcagcaagagggccccccagatggactggagcaagaagaatgagctgttcagcaacctgtag

SEQ ID NO: 171064 - DNA, 822 bp, Artificial Sequence
  Description of Artificial Sequence: Synthetic coding sequence
atgtctgcagatgctgctgctggggcccccctgccccggctgtgctgcctggagaaggagacccaccagcaggtggtgagccgcatccgggccgccctgaatgctgtgcggctgctggtggtggaccctgagacagatgagcagctgcagaagctgggcgtgcaggtgcgggaggagctgctgcgggcccaggaggcccctggccaggccgagcccccagctgctgctgaggtgcagggcgctggaaatgaaaatgagccccgggaggccgacaagagccaccctgagcagcgggagctgcggccccggctgtgcaccatgaagaagggccccagcggctacggcttcaacctgcacagcgacaagagcaagccaggccagttcatccgctctgtggaccctgacagccctgctgaggccagcggcctgcgggcccaggacagaattgtggaggtgaatggagtgtgcatggagggcaagcagcacggagatgtggtgtctgccatccgggctggaggagatggcagcggcggcggcaaccagagaggagctgagttcccccggcagccccccaagacaggcctgcacagcgccctggtgtacctgctgctgcggccccacccccggctgcagcacctgcccggccacggccagcgggagggccccccagagacccagcagcagacaggccctgcagatggcctggagcaggagaagaggaccctgcagcagcccctgagcgccctgctgcccccaagtgactggcagggccgggccagcatccccccccacctgttccccagcccccagctgctgccctag

SEQ ID NO: 171065 - DNA, 1014 bp, Artificial Sequence
  Description of Artificial Sequence: Synthetic coding sequence
atggccgcccctgagcccctgcggccccggctgtgccgcctggtgcggggggagcagggctacggcttccacctgcacggggagaagggcagaagaggccagttcatcagaagagtggagcccggcagccctgctgaggccgccgccctgcgggccggggaccggctggtggaggtgaatggagtgaatgtggagggggagacccaccaccaggtggtgcagaggatcaaggctgtggagggccagacccggctgctggtggtggaccaggagacagatgaggagctgcggcggcggcagctgacctgcacagaggagatggcccagaggggcctgcccccagcccatgacccctgggagcccaagccagactgggcccacacaggcagccacagcagcgaggccggcaagaaggatgtgtctggccccctgcgggagctgcggccccggctgtgccacctgaggaagggcccccagggctacggcttcaacctgcacagcgacaagagccggcccggccagtacatccgctctgtggaccccggcagccctgctgcccggagcggcctgcgggcccaggaccggctgattgaggtgaatggccagaatgtggagggcctgcggcatgctgaggtggtggccagcatcaaggcccgggaggatgaggcccggctgctggtggtggaccctgagacagatgagcacttcaagaggctgcgggtgacccccacagaggagcacgtggagggccccctgcccagccctgtgaccaacggcaccagccctgcccagctgaatggaggcagcgcctgcagcagcagaagtgacctgcccggcagtgacaaggacacagaagatggcagcgcctggaagcaggaccccttccaggagagcggcctgcacctgagccccacagctgctgaggccaaggagaaggcccgggccatgagggtgaacaagagggccccccagatggactggaacaggaagcgggagatcttcagcaacttctag

SEQ ID NO: 171066 - DNA, 981 bp, Artificial Sequence
  Description of Artificial Sequence: Synthetic coding sequence
atggccgcccctgagcccctgcggccccggctgtgccgcctggtgcggggggagcagggctacggcttccacctgcacggggagaagggcagaagaggccagttcatcagaagagtggagcccggcagccctgctgaggccgccgccctgcgggccggggaccggctggtggaggtgaatggagtgaatgtggagggggagacccaccaccaggtggtgcagaggatcaaggctgtggagggccagacccggctgctggtggtggaccaggagacagatgaggagctgcggcggcggcagctgacctgcacagaggagatggcccagaggggcctgcccccagcccatgacccctgggagcccaagccagactgggcccacacaggcagccacagcagcgaggccggcaagaaggatgtgtctggccccctgcgggagctgcggccccggctgtgccacctgaggaagggcccccagggctacggcttcaacctgcacagcgacaagagccggcccggccagtacatccgctctgtggaccccggcagccctgctgcccggagcggcctgcgggcccaggaccggctgattgaggtgaatggccagaatgtggagggcctgcggcatgctgaggtggtggccagcatcaaggcccgggaggatgaggcccggctgctggtggtggaccctgagacagatgagcacttcaagaggctgcgggtgacccccacagaggagcacgtggagggccccctgcccagccctgtgaccaacggcaccagccctgcccagctgaatggaggcagcgcctgcagcagcagaagtgacctgcccggcagtgacaaggacacagaggagagcggcctgcacctgagccccacagctgctgaggccaaggagaaggcccgggccatgagggtgaacaagagggccccccagatggactggaacaggaagcgggagatcttcagcaacttctag

SEQ ID NO: 171067 - DNA, 2397 bp, Artificial Sequence
  Description of Artificial Sequence: Synthetic coding sequence
atggccctgcagatgtttgtgacctacagcccctggaactgcctgctgctgctggtggccctggagtgcagcgaggccagcagtgacctgaatgaaagtgccaacagcacagcccagtatgccagcaatgcctggtttgctgctgccagcagcgagcctgaggagggcatctctgtgtttgagctggactatgactatgtgcagatcccctatgaggtgaccctgtggatcctgctggccagcctggccaagattggcttccacctgtaccaccggctgcccggcctgatgcctgagagctgcctgctgatcctggtgggcgccctggtgggcggcatcatctttggaacagaccacaagagcccccctgtgatggacagcagcatctacttcctgtacctgctgccccccatcgtgctggagggcggctacttcatgcccacccggcccttctttgaaaatattggcagcatcctgtggtgggccgtgctgggcgccctgatcaatgccctgggcatcggcctgagcctgtacctgatctgccaggtgaaggccttcggcctgggagatgtgaacctgctgcagaacctgctgtttggcagcctcatctctgctgtggaccctgtggccgtgctggccgtgtttgaggaggcccgggtgaatgagcagctgtacatgatgatctttggagaggccctgctgaatgatggcatcaccgtggtgctgtacaacatgctgattgccttcaccaagatgcacaagtttgaggacatcgagaccgtggacatcctggccggctgtgcccgcttcatcgtggtgggcctgggcggcgtgctgtttggcatcgtgtttggcttcatcagcgccttcatcacccgcttcacccagaacatcagcgccatcgagcccctgattgtgttcatgttctcctacctgagctacctggccgctgagaccctgtacctgagcggcatcctggccatcacagcctgtgctgtgaccatgaagaagtatgtggaggagaatgtgtcccagaccagctacaccaccatcaagtacttcatgaagatgctgagctctgtgtctgagaccctcatcttcatcttcatgggcgtgtccacagtgggcaagaaccacgagtggaactgggccttcatctgcttcaccctggccttctgccagatctggagggccatctctgtgtttgccctcttctacatcagcaaccagttccgcaccttccccttcagcatcaaggaccagtgcatcatcttctacagcggcgtgcggggggccggcagcttcagcctggccttcctgctgcccctgagcctcttccccaggaagaagatgtttgtgacagccaccctggtggtgatctacttcaccgtcttcatccagggcatcaccgtgggccccctggtgcgctacctggatgtgaagaagaccaacaagaaggagagcatcaatgaggagctgcacatccggctgatggaccacctgaaggccggcattgaagatgtgtgtggccactggagccactaccaggtgcgggacaagttcaagaagtttgaccaccgctacctgaggaagatcctgatcaggaagaacctgcccaagagcagcatcgtgtccctgtacaagaagctggagatgaagcaggccatcgagatggtggagaccggcatcctgagcagcacagccttcagcatcccccaccaggcccagaggatccagggcatcaagaggctgagcccagaagatgtggagagcatccgggacatcctgaccagcaacatgtaccaggtgcggcagaggaccctgagctacaacaagtacaacctgaagccccagaccagcgagaagcaggccaaggagatcctgatccggcggcagaacaccctgcgggagagcatgaggaagggccacagcctgccctggggcaagccagctggcaccaagaacatccgctacctgagctacccctacggcaacccccagagcgctggccgggacaccagggctgctggcttcagtgatgatgacagcagtgaccccggcagccccagcatcaccttcagcgcctgcagcagaattggcagcctgcagaagcaggaggcccaggagatcatccccatgaagagcctgcaccggggcaggaaggccttctcctttggctaccagaggaacaccagccaggaggagtacctgggcggcgtgagaagagtggccctgcggcccaagcccctcttccacgctgtggatgaggagggggagagcggcggggagagcgagggcaaggccagcctggtggaggtgcgcagccgctggacagctgaccacggccacggccgggaccaccacaggagccacagccccctgctgcagaagaagtag

SEQ ID NO: 171068 - DNA, 2691 bp, Artificial Sequence
  Description of Artificial Sequence: Synthetic coding sequence
atgctgcgggccgccctgagcctgctggccctgcccctggccggggctgctgaggagcccacccagaagccagagagccctggagagcccccacctggcctggagctgttccgctggcagtggcatgaggtggaggccccctacctggtggccctgtggatcctggtggccagcctggccaagatcgtgttccacctgagcaggaaggtgaccagcctggtgcctgagagctgcctgctgatcctgctgggcctggtgctgggcggcatcgtgctggccgtggccaagaaggccgagtaccagctggagcccggcaccttcttcctgttcctgctgccccccatcgtgctggacagcggctacttcatgcccagccgcctcttctttgacaacctgggcgccatcctgacctatgctgtggtgggcaccctgtggaatgccttcaccaccggggccgccctgtggggcctgcagcaggccggcctggtggccccccgggtgcaggccggcctgctggacttcctgctgtttggcagcctcatctctgctgtggaccctgtggccgtgctggccgtgtttgaggaggtgcacgtgaatgagaccctcttcatcatcgtgtttggagagagcctgctgaatgatgctgtgacagtggtgctgtacaaggtgtgcaacagctttgtggagatgggcagcgccaacgtgcaggccacagactacctgaagggcgtggccagcctgtttgtggtgtccctgggcggcgctgctgtgggcctggtgtttgccttcctgctggccctgaccacccgcttcaccaagagggtgcgcatcatcgagcccctgctggtgttcctgctggcctatgctgcctacctgacagctgagatggccagcctgagcgccatcctggccgtgaccatgtgtggcctgggctgcaagaagtatgtggaggccaacatcagccacaagagcaggaccaccgtgaagtacaccatgaagaccctggccagctgtgccgagaccgtcatcttcatgctgctgggcatctctgctgtggacagcagcaagtgggcctgggacagcggcctggtgctgggcaccctcatcttcatcctcttcttccgggccctgggcgtggtgctgcagacctgggtgctgaaccagttccggctggtgcccctggacaagattgaccaggtggtgatgtcctatggaggcctgcggggagctgtggcctttgccctggtgatcctgctggacaggaccaaggtgcctgccaaggactactttgtggccaccaccatcgtggtggtgttcttcaccgtgattgtgcagggcctgaccatcaagcccctggtgaagtggctgaaggtgaagaggtctgagcaccacaagcccaccctgaaccaggagctgcacgagcacacctttgaccacatcctggccgctgtggaggatgtggtgggccaccacggctaccactactggagggaccgctgggagcagtttgacaagaagtacctgagccagctgctgatgagaagaagtgcctaccgcatccgggaccagatctgggatgtgtactaccgcctgaacatcagagatgccatcagctttgtggaccagggcggccacgtgctgagcagcacaggcctgaccctgcccagcatgcccagcaggaacagcgtggccgagacctctgtgaccaacctgctgcgggagagcggcagcggggcctgcctggacctgcaggtgattgacacagtgcgcagcggccgggaccgggaggatgctgtgatgcaccacctgctgtgtggcggcctgtacaagccccggcggcgctacaaggccagctgcagccgccacttcatcagtgaagatgcccaggagcggcaggacaaggaggtgttccagcagaacatgaagaggcggctggagagcttcaagagcaccaagcacaacatctgcttcaccaagagcaagccccggcccaggaagacaggaagaaggaagaaggatggagtggccaatgctgaggccaccaacgggaagcaccggggcctgggcttccaggacacagctgctgtgatcctgactgtggagagcgaggaggaggaggaggagagtgacagcagcgagacagagaaggaggatgatgagggcatcatctttgtggcccgggccaccagcgaggtgctgcaggagggcaaggtgtctggcagcctggaggtgtgccccagcccccgcatcatcccccccagccccacctgtgccgagaaggagctgccctggaagagcggccagggcgacctggccgtgtatgtgtcctctgagaccaccaagatcgtgcctgtggacatgcagacaggctggaaccagagcatcagcagcctggagagcctggccagccccccctgcaaccaggcccccatcctgacctgcctgcccccccacccccggggcacagaggagccccaggtgcccctgcacctgcccagcgaccccaggagcagctttgccttcccccccagcctggccaaggccggccgcagccgctctgagagcagcgctgacctgccccagcagcaggagctgcagcccctgatgggccacaaggaccacacccacctgagccctggaacagccaccagccactggtgcatccagttcaacagaggcagccggctgtag

SEQ ID NO: 171069 - DNA, 1308 bp, Artificial Sequence
  Description of Artificial Sequence: Synthetic coding sequence
atgagaagaagtgcctaccgcatccgggaccagatctgggatgtgtactaccgcctgaacatcagagatgccatcagctttgtggaccagggcggccacgtgctgagcagcacaggcctgaccctgcccagcatgcccagcaggaacagcgtggccgagacctctgtgaccaacctgctgcgggagagcggcagcggggcctgcctggacctgcaggtgattgacacagtgcgcagcggccgggaccgggaggatgctgtgatgcaccacctgctgtgtggcggcctgtacaagcccaggagaagaattgagctgaggacagagccctgtggcatgctgctgaagaccttcctgcagacagacatggaccaggccttcctgggcaccaagccagctgctgtggccaccagcagccagaggatgaggaggagcggccgcacccggcgcagcagcagcaggatgaagaggcggctggagagcttcaagagcaccaagcacaacatctgcttcaccaagagcaagccccggcccaggaagacaggccgcaggaagaaggatggagtggccaatgctgaggccaccaacgggaagcaccggggcctgggcttccaggacacagctgctgtgatcctgactgtggagagcgaggaggaggaggaggagagtgacagcagcgagacagagaaggaggatgatgagggcatcatctttgtggcccgggccaccagcgaggtgctgcaggagggcaaggtgtctggcagcctggaggtgtgccccagcccccgcatcatcccccccagccccacctgtgccgagaaggagctgccctggaagagcggccagggcgacctggccgtgtatgtgagcagcgagaccaccaagatcgtgcctgtggacatgcagacaggctggaaccagagcatcagcagcctggagagcctggccagccccccctgcaaccaggcccccatcctgacctgcctgcccccccacccccggggcacagaggagccccaggtgcccctgcacctgcccagcgaccccaggagcagctttgccttcccccccagcctggccaaggccggcctggccgtgcgggccgccctgaccagccccagcagccgcagctgcagccccagctgggccaccaggaccacccccatcagcgcccaggcccccctgcccccaactggagccagcagcagcacagaagctgctggctgcagcagccggccccggggcggggccggcggcggcatccctgtgggcagcgccccctgggtgatgggccgggccctggagacctag

SEQ ID NO: 171070 - DNA, 2106 bp, Artificial Sequence
  Description of Artificial Sequence: Synthetic coding sequence
atggcccggcggggctggaggcgggcccccctgcggcggggcgtgggcagcagcccccgggcccggcggctgatgaggcccctgtggctgctgctggccgtgggcgtgtttgactgggccggggccagtgatggcggcggcggggaggcccgggccatggatgaggagatcgtgtctgagaagcaggccgaggagagccaccggcaggacagcgccaacctgctgatcttcatcctgctgctgaccctgaccatcctgaccatctggctgttcaagcaccggcgggcccgcttcctgcacgagaccggcctggccatgatctacggcctgctggtgggcctggtgctgcgctatggcatccacgtgcccagtgatgtgaacaacgtgaccctgagctgtgaggtgcagagcagccccaccaccctgctggtgaatgtgtctgggaagttctatgagtacatgctgaagggggagatcagcagccatgagctgaacaacgtgcaggacaatgagatgctgaggaaggtgacctttgatcctgaggtgttcttcaacatcctgctgccccccatcatcttctacgccggctacagcctgaagagaagacacttcttcaggaacctgggcagcatcctggcctatgccttcctgggcacagccatcagctgcttcgtcatcggcagcatcatgtatggctgtgtgaccctgatgaaggtgacaggccagctggccggggacttctacttcacagactgcctgctgtttggagccatcgtgtctgccacagatcctgtgacagtgctggccatcttccacgagctgcaggtggatgtggagctgtatgccctgctgtttggagagagcgtgctgaatgatgctgtggccatcgtgctgagcagcagcatcgtggcctaccagcctgctggggacaacagccacacctttgatgtgacagccatgttcaagagcatcggcatcttcctgggcatcttcagcggcagctttgccatgggcgccgccactggagtggtgacagccctggtgaccaagttcaccaagctgcgggagttccagctgctggagaccggcctcttcttcctgatgtcctggagcaccttcctgctggccgaggcctggggcttcaccggggtggtggccgtgctcttctgtggcatcacccaggcccactacacctacaacaacctgagcacagagagccagcacaggaccaagcagctgtttgagctgctgaacttcctggccgagaacttcatcttctcctacatgggcctgaccctcttcaccttccagaaccacgtgttcaaccccacctttgtggtgggcgcctttgtggccatcttcctgggccgggccgccaacatctaccccctgagcctgctgctgaacctgggccgccgcagcaagattggcagcaacttccagcacatgatgatgtttgctggcctgcggggggccatggcctttgccctggccatccgggacacagccacctacgcccggcagatgatgttcagcaccaccctgctgattgtgttcttcaccgtgtgggtgtttggaggcggcaccacagccatgctgagctgcctgcacatccgggtgggcgtggacagcgaccaggagcacctgggcgtgcctgaaaatgaaagaaggaccaccaaggccgagagcgcctggctgttcaggatgtggtacaactttgaccacaactacctgaagcccctgctgacccacagcggcccccccctgaccaccaccctgcctgcctgctgcggccccatcgcccgctgcctgaccagcccccaggcctatgagaaccaggagcagctgaaggatgatgacagcgacctgatcctgaatgatggagacatcagcctgacctacggggacagcacagtgaacacagagcccgccaccagcagcgccccccggcgcttcatgggcaacagcagtgaagatgccctggaccgggagctggcctttggagaccacgagctggtgatccggggcacccggctggtgctgcccatggatgacagcgagccccccctgaacctgctggacaacaccaggcatggccctgcctag

SEQ ID NO: 171071 - DNA, 2010 bp, Artificial Sequence
  Description of Artificial Sequence: Synthetic coding sequence
atggcccggcggggctggaggcgggcccccctgcggcggggcgtgggcagcagcccccgggcccggcggctgatgaggcccctgtggctgctgctggccgtgggcgtgtttgactgggccggggccagtgatggcggcggcggggaggcccgggccatggatgaggagatcgtgtctgagaagcaggccgaggagagccaccggcaggacagcgccaacctgctgatcttcatcctgctgctgaccctgaccatcctgaccatctggctgttcaagcaccggcgggcccgcttcctgcacgagaccggcctggccatgatctacggcctgctggtgggcctggtgctgcgctatggcatccacgtgcccagtgatgtgaacaacgtgaccctgagctgtgaggtgcagagcagccccaccaccctgctggtgacctttgatcctgaggtgttcttcaacatcctgctgccccccatcatcttctacgccggctacagcctgaagagaagacacttcttcaggaacctgggcagcatcctggcctatgccttcctgggcacagccatcagctgcttcgtcatcggcagcatcatgtatggctgtgtgaccctgatgaaggtgacaggccagctggccggggacttctacttcacagactgcctgctgtttggagccatcgtgtctgccacagatcctgtgacagtgctggccatcttccacgagctgcaggtggatgtggagctgtatgccctgctgtttggagagagcgtgctgaatgatgctgtggccatcgtgctgagcagcagcatcgtggcctaccagcctgctggggacaacagccacacctttgatgtgacagccatgttcaagagcatcggcatcttcctgggcatcttcagcggcagctttgccatgggcgccgccactggagtggtgacagccctggtgaccaagttcaccaagctgcgggagttccagctgctggagaccggcctcttcttcctgatgtcctggagcaccttcctgctggccgaggcctggggcttcaccggggtggtggccgtgctcttctgtggcatcacccaggcccactacacctacaacaacctgagcacagagagccagcacaggaccaagcagctgtttgagctgctgaacttcctggccgagaacttcatcttctcctacatgggcctgaccctcttcaccttccagaaccacgtgttcaaccccacctttgtggtgggcgcctttgtggccatcttcctgggccgggccgccaacatctaccccctgagcctgctgctgaacctgggccgccgcagcaagattggcagcaacttccagcacatgatgatgtttgctggcctgcggggggccatggcctttgccctggccatccgggacacagccacctacgcccggcagatgatgttcagcaccaccctgctgattgtgttcttcaccgtgtgggtgtttggaggcggcaccacagccatgctgagctgcctgcacatccgggtgggcgtggacagcgaccaggagcacctgggcgtgcctgaaaatgaaagaaggaccaccaaggccgagagcgcctggctgttcaggatgtggtacaactttgaccacaactacctgaagcccctgctgacccacagcggcccccccctgaccaccaccctgcctgcctgctgcggccccatcgcccgctgcctgaccagcccccaggcctatgagaaccaggagcagctgaaggatgatgacagcgacctgatcctgaatgatggagacatcagcctgacctacggggacagcacagtgaacacagagcccgccaccagcagcgccccccggcgcttcatgggcaacagcagtgaagatgccctggaccgggagctggcctttggagaccacgagctggtgatccggggcacccggctggtgctgcccatggatgacagcgagccccccctgaacctgctggacaacaccaggcatggccctgcctag

SEQ ID NO: 171072 - DNA, 1950 bp, Artificial Sequence
  Description of Artificial Sequence: Synthetic coding sequence
atggatgaggagatcgtgtctgagaagcaggccgaggagagccaccggcaggacagcgccaacctgctgatcttcatcctgctgctgaccctgaccatcctgaccatctggctgttcaagcaccggcgggcccgcttcctgcacgagaccggcctggccatgatctacggcctgctggtgggcctggtgctgcgctatggcatccacgtgcccagtgatgtgaacaacgtgaccctgagctgtgaggtgcagagcagccccaccaccctgctggtgaatgtgtctgggaagttctatgagtacatgctgaagggggagatcagcagccatgagctgaacaacgtgcaggacaatgagatgctgaggaaggtgacctttgatcctgaggtgttcttcaacatcctgctgccccccatcatcttctacgccggctacagcctgaagagaagacacttcttcaggaacctgggcagcatcctggcctatgccttcctgggcacagccatcagctgcttcgtcatcggcagcatcatgtatggctgtgtgaccctgatgaaggtgacaggccagctggccggggacttctacttcacagactgcctgctgtttggagccatcgtgtctgccacagatcctgtgacagtgctggccatcttccacgagctgcaggtggatgtggagctgtatgccctgctgtttggagagagcgtgctgaatgatgctgtggccatcgtgctgagcagcagcatcgtggcctaccagcctgctggggacaacagccacacctttgatgtgacagccatgttcaagagcatcggcatcttcctgggcatcttcagcggcagctttgccatgggcgccgccactggagtggtgacagccctggtgaccaagttcaccaagctgcgggagttccagctgctggagaccggcctcttcttcctgatgtcctggagcaccttcctgctggccgaggcctggggcttcaccggggtggtggccgtgctcttctgtggcatcacccaggcccactacacctacaacaacctgagcacagagagccagcacaggaccaagcagctgtttgagctgctgaacttcctggccgagaacttcatcttctcctacatgggcctgaccctcttcaccttccagaaccacgtgttcaaccccacctttgtggtgggcgcctttgtggccatcttcctgggccgggccgccaacatctaccccctgagcctgctgctgaacctgggccgccgcagcaagattggcagcaacttccagcacatgatgatgtttgctggcctgcggggggccatggcctttgccctggccatccgggacacagccacctacgcccggcagatgatgttcagcaccaccctgctgattgtgttcttcaccgtgtgggtgtttggaggcggcaccacagccatgctgagctgcctgcacatccgggtgggcgtggacagcgaccaggagcacctgggcgtgcctgaaaatgaaagaaggaccaccaaggccgagagcgcctggctgttcaggatgtggtacaactttgaccacaactacctgaagcccctgctgacccacagcggcccccccctgaccaccaccctgcctgcctgctgcggccccatcgcccgctgcctgaccagcccccaggcctatgagaaccaggagcagctgaaggatgatgacagcgacctgatcctgaatgatggagacatcagcctgacctacggggacagcacagtgaacacagagcccgccaccagcagcgccccccggcgcttcatgggcaacagcagtgaagatgccctggaccgggagctggcctttggagaccacgagctggtgatccggggcacccggctggtgctgcccatggatgacagcgagccccccctgaacctgctggacaacaccaggcatggccctgcctag

SEQ ID NO: 171073 - DNA, 2178 bp, Artificial Sequence
  Description of Artificial Sequence: Synthetic coding sequence
atggagcctggagatgctgcccggcccggcagcggccgggccactggagcccccccaccccggctgctgctgctgcccctgctgctgggctggggcctgcgggtggccgccgccgccagcgccagcagcagcggggctgctgctgaggacagcagcgccatggaggagctggccacagagaaggaggccgaggagagccaccggcaggacagcgtgtccctgctgaccttcatcctgctgctgaccctgaccatcctgaccatctggctgttcaagcaccggcgggtgcgcttcctgcacgagaccggcctggccatgatctacggcctgattgtgggcgtcatcctgcgctatggcaccccagccaccagcggccgggacaagagcctgagctgcacccaggaggaccgggccttcagcaccctgctggtgaatgtgtctgggaagttctttgagtacaccctgaagggggagatcagccctgggaagatcaacagcgtggagcagaatgacatgctgaggaaggtgacctttgatcctgaggtgttcttcaacatcctgctgccccccatcatcttccacgccggctacagcctgaagaagaggcacttcttcaggaacctgggcagcatcctggcctatgccttcctgggcacagctgtgtcctgcttcatcatcggcaacctgatgtatggagtggtgaagctgatgaagatcatgggccagctgagtgacaagttctactacacagactgcctcttctttggagccatcatcagcgccacagatcctgtgacagtgctggccatcttcaatgagctgcacgcagatgtggacctgtatgccctgctgtttggagagagcgtgctgaatgatgctgtggccatcgtgctgagcagcagcatcgtggcctaccagcctgctggcctgaacacccacgcctttgatgctgctgccttcttcaagtctgtgggcatcttcctgggcatcttcagcggcagcttcaccatgggcgctgtgactggagtgaatgccaacgtgaccaagttcaccaagctgcactgcttccccctgctggagacagccctcttcttcctgatgtcctggagcaccttcctgctggccgaggcctgtggcttcaccggggtggtggccgtgctcttctgtggcatcacccaggcccactacacctacaacaacctgtctgtggagagccgcagcaggaccaagcagctgtttgaggtgctgcacttcctggccgagaacttcatcttctcctacatgggcctggccctcttcaccttccagaagcacgtgttcagccccatcttcatcatcggggcctttgtggccatcttcctgggccgggccgcccacatctaccccctgtccttcttcctgaacctgggcagaagacacaagattggctggaacttccagcacatgatgatgttcagcggcctgcggggggccatggcctttgccctggccatccgggacacagccagctatgcccggcagatgatgttcaccaccaccctgctgattgtgttcttcaccgtgtggatcatcggcggcggcaccacccccatgctgtcctggctgaacatccgggtgggcgtggaggagcccagcgaggaggaccagaatgagcaccactggcagtacttccgggtgggcgtggaccctgaccaggaccccccacccaacaatgacagcttccaggtgctgcagggagatggccctgacagcgcccggggcaacagaaccaagcaggagagcgcctggatcttccggctgtggtacagctttgaccacaactacctgaagcccatcctgacccacagcggcccccccctgaccaccaccctgcctgcctggtgtggcctgctggcccgctgcctgaccagcccccaggtgtatgacaaccaggagcccctgcgggaggaggacagcgacttcatcctgacagaaggagacctgaccctgacctatggagacagcacagtgacagccaacggcagcagcagcagccacacagccagcaccagcctggagggcagcaggaggaccaagagcagcagcgaggaggtgctggagcgggacctgggcatgggagaccagaaggtgagcagccggggcacccggctggtgttccccctggaggacaatgcctag

SEQ ID NO: 171074 - DNA, 1746 bp, Artificial Sequence
  Description of Artificial Sequence: Synthetic coding sequence
atgggagagaagatggccgaggaggagcgcttccccaacaccacccatgagggcttcaacgtgaccctgcacaccaccctggtggtgaccaccaagctggtgctgcccacccctgggaagcccatcctgcctgtgcagacaggagagcaggcccagcaggaggagcagagcagcggcatgaccatcttcttcagcctgctggtgctggccatctgcatcatcctggtgcacctgctgatccgctaccgcctgcacttcctgcctgagagcgtggccgtggtgtccctgggcatcctgatgggcgccgtcatcaagatcatcgagttcaagaagctggccaactggaaggaggaggagatgttccggcccaacatgttcttcctgctgctgctgccccccatcatctttgagagcggctacagcctgcacaagggcaacttcttccagaacatcggcagcatcaccctgtttgctgtgtttggaacagccatcagcgcctttgtggtgggcggcggcatctacttcctgggccaggctgatgtgatcagcaagctgaacatgacagacagctttgccttcggcagcctcatctctgctgtggaccctgtggccaccatcgccatcttcaatgccctgcacgtggaccctgtgctgaacatgctggtgtttggagagagcatcctgaatgatgctgtgtccatcgtgctgaccaacacagctgagggcctgaccaggaagaacatgtctgatgtgtctggctggcagaccttcctgcaggccctggactacttcctgaagatgttctttggatctgctgccctgggcaccctgaccggcctcatcagcgccctggtgctgaagcacatcgacctgaggaagacccccagcctggagtttggcatgatgatcatctttgcctacctgccctacggcctggccgagggcatcagcctgagcggcatcatggccatcctcttctctggaattgtgatgagccactacacccaccacaacctgagccctgtgacccagatcctgatgcagcagaccctgaggacagtggccttcctgtgtgagacctgtgtgtttgccttcctgggcctgagcatcttctccttcccccacaagtttgagatcagctttgtgatctggtgcatcgtgctggtgctgtttggccgggctgtgaacatcttccccctgagctacctgctgaacttcttccgggaccacaagatcacccccaagatgatgttcatcatgtggttcagcggcctgcggggggccatcccctatgccctgagcctgcacctggacctggagcccatggagaagaggcagctgattggcaccaccaccatcgtgattgtgctcttcaccatcctgctgctgggcggcagcaccatgcccctcatccggctgatggacattgaagatgccaaggcccacagaagaaacaagaaggatgtgaacctgagcaagacagagaagatgggcaacacagtggagagcgagcacctgtctgagctgacagaggaggagtatgaggcccactacatccggcggcaggacctgaagggctttgtgtggctggatgccaagtacctgaaccccttcttcacccggcggctgacccaggaggacctgcaccacggccgcatccagatgaagaccctgaccaacaagtggtatgaggaggtgcggcagggccccagcggctctgaagatgatgagcaggagctgctgtag

SEQ ID NO: 171075 - DNA, 1794 bp, Artificial Sequence
  Description of Artificial Sequence: Synthetic coding sequence
atgggagagaagatggccgaggaggagcgcttccccaacaccacccatgagggcttcaacgtgaccctgcacaccaccctggtggtgaccaccaagctggtgctgcccacccctgggaagcccatcctgcctgtgcagacaggagagcaggcccagcaggaggagcagagcagcggcatgaccatcttcttcagcctgctggtgctggccatctgcatcatcctggtgcacctgctgatccgctaccgcctgcacttcctgcctgagagcgtggccgtggtgtccctgggcatcctgatgggcgccgtcatcaagatcatcgagttcaagaagctggccaactggaaggaggaggagatgttccggcccaacatgttcttcctgctgctgctgccccccatcatctttgagagcggctacagcctgcacaagggcaacttcttccagaacatcggcagcatcaccctgtttgctgtgtttggaacagccatcagcgcctttgtggtgggcggcggcatctacttcctgggccagggcttcttctttgtgtgtgtgtgtgtgtttgtgtgcttcatcctgcaggctgatgtgatcagcaagctgaacatgacagacagctttgccttcggcagcctcatctctgctgtggaccctgtggccaccatcgccatcttcaatgccctgcacgtggaccctgtgctgaacatgctggtgtttggagagagcatcctgaatgatgctgtgtccatcgtgctgaccaacacagctgagggcctgaccaggaagaacatgtctgatgtgtctggctggcagaccttcctgcaggccctggactacttcctgaagatgttctttggatctgctgccctgggcaccctgaccggcctcatcagcgccctggtgctgaagcacatcgacctgaggaagacccccagcctggagtttggcatgatgatcatctttgcctacctgccctacggcctggccgagggcatcagcctgagcggcatcatggccatcctcttctctggaattgtgatgagccactacacccaccacaacctgagccctgtgacccagatcctgatgcagcagaccctgaggacagtggccttcctgtgtgagacctgtgtgtttgccttcctgggcctgagcatcttctccttcccccacaagtttgagatcagctttgtgatctggtgcatcgtgctggtgctgtttggccgggctgtgaacatcttccccctgagctacctgctgaacttcttccgggaccacaagatcacccccaagatgatgttcatcatgtggttcagcggcctgcggggggccatcccctatgccctgagcctgcacctggacctggagcccatggagaagaggcagctgattggcaccaccaccatcgtgattgtgctcttcaccatcctgctgctgggcggcagcaccatgcccctcatccggctgatggacattgaagatgccaaggcccacagaagaaacaagaaggatgtgaacctgagcaagacagagaagatgggcaacacagtggagagcgagcacctgtctgagctgacagaggaggagtatgaggcccactacatccggcggcaggacctgaagggctttgtgtggctggatgccaagtacctgaaccccttcttcacccggcggctgacccaggaggacctgcaccacggccgcatccagatgaagaccctgaccaacaagtggtatgaggaggtgcggcagggccccagcggctctgaagatgatgagcaggagctgctgtag

SEQ ID NO: 171076 - DNA, 1089 bp, Artificial Sequence
  Description of Artificial Sequence: Synthetic coding sequence
atgctggtgtttggagagagcatcctgaatgatgctgtgtccatcgtgctgaccaacacagctgagggcctgaccaggaagaacatgtctgatgtgtctggctggcagaccttcctgcaggccctggactacttcctgaagatgttcttcggcagcgctgccctgggcaccctgaccggcctcatcagcgccctggtgctgaagcacatcgacctgaggaagacccccagcctggagtttggcatgatgatcatctttgcctacctgccctacggcctggccgagggcatcagcctgagcggcatcatggccatcctcttcagcggcatcgtgatgagccactacacccaccacaacctgagccctgtgacccagatcctgatgcagcagaccctgaggacagtggccttcctgtgtgagacctgtgtgtttgccttcctgggcctgagcatcttctccttcccccacaagtttgagatcagctttgtgatctggtgcatcgtgctggtgctgtttggccgggctgtgaacatcttccccctgagctacctgctgaacttcttccgggaccacaagatcacccccaagatgatgttcatcatgtggttcagcggcctgcggggggccatcccctatgccctgagcctgcacctggacctggagcccatggagaagaggcagctgattggcaccaccaccatcgtcatcgtgctcttcaccatcctgctgctgggcggcagcaccatgcccctcatccggctgatggacattgaagatgccaaggcccacagaagaaacaagaaggatgtgaacctgagcaagacagagaagatgggcaacacagtggagagcgagcacctgtctgagctgacagaggaggagtatgaggcccactacatccggcggcaggacctgaagggctttgtgtggctggatgccaagtacctgaaccccttcttcacccggcggctgacccaggaggacctgcaccacggccgcatccagatgaagaccctgaccaacaagtggtatgaggaggtgcggcagggccccagcggctctgaagatgatgagcaggagctgctgtag

SEQ ID NO: 171077 - DNA, 846 bp, Artificial Sequence
  Description of Artificial Sequence: Synthetic coding sequence
atgatgatcatctttgcctacctgccctacggcctggccgagggcatcagcctgagcggcatcatggccatcctcttctctggaattgtgatgagccactacacccaccacaacctgagccctgtgacccagatcctgatgcagcagaccctgaggacagtggccttcctgtgtgagacctgtgtgtttgccttcctgggcctgagcatcttctccttcccccacaagtttgagatcagctttgtgatctggtgcatcgtgctggtgctgtttggccgggctgtgaacatcttccccctgagctacctgctgaacttcttccgggaccacaagatcacccccaagatgatgttcatcatgtggttcagcggcctgcggggggccatcccctatgccctgagcctgcacctggacctggagcccatggagaagaggcagctgattggcaccaccaccatcgtgattgtgctcttcaccatcctgctgctgggcggcagcaccatgcccctcatccggctgatggacattgaagatgccaaggcccacagaagaaacaagaaggatgtgaacctgagcaagacagagaagatgggcaacacagtggagagcgagcacctgtctgagctgacagaggaggagtatgaggcccactacatccggcggcaggacctgaagggctttgtgtggctggatgccaagtacctgaaccccttcttcacccggcggctgacccaggaggacctgcaccacggccgcatccagatgaagaccctgaccaacaagtggtatgaggaggtgcggcagggccccagcggctctgaagatgatgagcaggagctgctgtag

SEQ ID NO: 171078 - DNA, 1938 bp, Artificial Sequence
  Description of Artificial Sequence: Synthetic coding sequence
atggagcggcagagccgggtgatgtctgagaaggatgagtaccagttccagcaccagggcgctgtggagctgctggtgttcaacttcctgctgatcctgaccatcctgaccatctggctgttcaagaaccaccgcttccgcttcctgcacgagaccggcggggccatggtgtatggcctcatcatgggcctcatcctgcgctatgccacagcccccacagacattgaaagtggcaccgtgtatgactgtgtgaagctgaccttcagccccagcaccctgctggtgaacatcacagaccaggtgtatgagtacaagtacaagcgggagatcagccagcacaacatcaacccccaccagggcaatgccatcctggagaagatgacctttgatcctgagatcttcttcaacgtgctgctgccccccatcatcttccacgccggctacagcctgaagaagaggcacttcttccagaacctgggcagcatcctgacctacgccttcctgggcacagccatcagctgcatcgtgattggcctcatcatgtatggctttgtgaaggccatgattcatgctggccagctgaagaatggagacttccacttcacagactgcctcttcttcggcagcctgatgtctgccacagatcctgtgacagtgctggccatcttccacgagctgcacgtggaccctgacctgtacaccctgctgtttggagagagcgtgctgaatgatgctgtggccatcgtgctgacctacagcatcagcatctacagccccaaggagaaccccaatgcctttgatgctgctgccttcttccagagcgtgggcaacttcctgggcatctttgctggcagctttgccatgggcagcgcctatgccatcatcacagccctgctgaccaagttcaccaagctgtgtgagttccccatgctggagaccggcctcttcttcctgctgtcctggagcgccttcctgtctgctgaggccgccggcctgactggaattgtggccgtgctcttctgtggggtgacccaggcccactacacctacaacaacctgagcagtgacagcaagatccgcaccaagcagctgtttgagttcatgaacttcctggctgaaaatgtcatcttctgctacatgggcctggccctcttcaccttccagaaccacatcttcaatgccctcttcatcctgggcgccttcctggccatctttgtggcccgggcctgcaacatctaccccctgtccttcctgctgaacctgggcaggaagcagaagatcccctggaacttccagcacatgatgatgttcagcggcctgcggggggccatcgcctttgccctggccatccggaacacagagagccagcccaagcagatgatgttcaccaccaccctgctgctggtgttcttcaccgtgtgggtgtttggaggcggcaccacccccatgctgacctggctgcagatccgggtgggcgtggacctggatgagaacctgaaggaggaccccagcagccagcaccaggaggccaacaacctggacaagaacatgaccaaggccgagagcgcccggctcttcaggatgtggtacagctttgaccacaagtacctgaagcccatcctgacccacagcggcccccccctgaccaccaccctgcctgagtggtgtggccccatcagccggctgctgaccagcccccaggcctatggagagcagctgaaggaggatgatgtggagtgcatcgtgaaccaggatgagctggccatcaactaccaggagcaggccagcagcccctgcagccccccagcccggctgggcctggaccagaaggccagcccccagacccctgggaaggagaacatctatgaaggagacctgggcctgggcggctatgagctgaagctggagcagaccctgggccagagccagctgaactag

SEQ ID NO: 171079 - DNA, 978 bp, Artificial Sequence
  Description of Artificial Sequence: Synthetic coding sequence
ctgcggctgcagagctcctgggagcagatgacctttgatcctgagatcttcttcaacgtgctgctgccccccatcatcttccacgccggctacagcctgaagaagaggcacttcttccagaacctgggcagcatcctgacctacgccttcctgggcacagccatcagctgcatcgtcatcggcctcatcatgtatggctttgtgaaggccatgattcatgctggccagctgaagaatggagacttccacttcacagactgcctcttcttcggcagcctgatgtctgccacagatcctgtgacagtgctggccatcttccacgagctgcacgtggaccctgacctgtacaccctgctgtttggagagagcgtgctgaatgatgctgtggccatcgtgctgacctacagcatcagcatctacagccccaaggagaaccccaatgcctttgatgctgctgccttcttccagagcgtgggcaacttcctgggcatctttgctggcagctttgccatgggcagcgcctatgccatcatcacagccctgctgaccaagttcaccaagctgtgtgagttccccatgctggagaccggcctcttcttcctgctgtcctggagcgccttcctgtctgctgaggccgccggcctgaccggcatcgtggccgtgctcttctgtggggtgacccaggcccactacacctacaacaacctgagcagtgacagcaagatccgcaccaagcagctgtttgagttcatgaacttcctggccgagaatgtcatcttctgctacatgggcctggccctcttcaccttccagaaccacatcttcaatgccctcttcatcctgggcgcctttgtgtccatcttcctggcccgggcccacacagagctgaagaacctgctcttcttcctggccagcttcctgtgctacttcagccacaggagcaagggcctgcccatggccggctgtgccctgccctag

SEQ ID NO: 171080 - DNA, 3534 bp, Artificial Sequence
  Description of Artificial Sequence: Synthetic coding sequence
atggccggcatcttcaaggagttcttcttcagcacagaggacctgcctgaggtgatcctgaccctgagcctcatcagcagcatcggggccttcctgaacagacacctggaggacttccccatccctgtgcctgtgatcctcttcctgctgggctgcagctttgaggtgctgtccttcaccagcagccaggtgcagagatatgccaatgccatccagtggatgagcccagacctcttcttccgcatcttcacccctgtggtgttcttcaccacagcctttgacatggacacctacatgctgcagaagctgttctggcagatcctgctgatcagcatccctggcttcctggtgaactacatcctggtgctgtggcacctggcctctgtgaaccagctgctgctgaagcccacccagtggctgctcttcagcgccatcctggtgtccagtgaccccatgctgacagctgctgccatccgggacctgggcctgagccgcagcctcatcagcctcatcaacggggagagcctgatgaccagcgtcatcagcctcatcaccttcaccagcatcatggactttgaccagaggctgcagagcaagaggaaccacaccctggccgaggagatcgtgggcggcatctgcagctacatcatcgccagcttcctgtttggcatcctgagcagcaagctgatccagttctggatgagcacagtgtttggagatgatgtgaaccacatcagcctcatcttcagcatcctgtacctgatcttctacatctgtgagctggtgggcatgagcggcatcttcaccctggccatcgtgggcctgctgctgaacagcaccagcttcaaggccgccatcgaggagaccctgctgctggagttctggaccttcctgagcagaattgccttcctgatggtgttcaccttcttcggcctgctgatcccagcccacacctacctgtacatcgagtttgtggacatctactacagcctgaacatctacctgaccctcatcgtgctgcgcttcctgaccctgctgctgatcagccctgtgctgagccgggtgggccacgagttctcctggcgctggatcttcatcatggtgtgcagcgagatgaagggcatgcccaacatcaacatggccctgctgctggcctacagcgacctgtactttggaagtgacaaggagaagagccagatcctcttccatggagtgctggtgtgcctgatcaccctggtggtgaaccgcttcatcctgcctgtggccgtgaccatcctgggcctgagagatgccaccagcaccaagtacaagtctgtgtgctgcaccttccagcacttccaggagctgaccaagtctgctgccagcgccctgaagtttgacaaggacctggccaatgctgactggaacatgattgagaaggccatcaccctggagaacccctacatgctgaatgaggaggagaccacagagcaccagaaggtgaagtgcccccactgcaacaaggagattgatgagatcttcaacacagaggccatggagctggccaacagaaggctgctgagcgcccagatcgccagctaccagaggcagtacagaaatgagatcctgagccagagcgctgtgcaggtgctggtgggcgctgctgagagctttggagagaagaagggcaagtgcatgagcctggacaccatcaagaactacagcgagagccagaagacagtgacctttgccaggaagctgctgctgaactgggtgtacaacaccaggaaggagaaggagggccccagcaagtacttcttcttccgcatctgccacaccatcgtgttcacagaggagtttgaacatgtgggctacctggtgatcctgatgaacatcttccccttcatcatctcctggatcagccagctgaatgtcatctaccacagcgagctgaagcacaccaactactgcttcctgaccctgtacatcctggaggccctgctgaagattgctgccatgaggaaggacttcttcagccacgcctggaacatctttgagctggccatcaccctgattggcatcctgcacgtgatcctgattgaaattgacaccatcaagtacatcttcaatgaaacagaggtgattgtgttcatcaaggtggtgcagttcttccgcatcctgcgcatcttcaagctgattgcccccaagctgctgcagatcatcgacaagaggatgagccaccagaagaccttctggtacggcatcctgaagggctacgtgcagggcgaggccgacatcatgaccatcatcgaccagatcaccagcagcaagcagatcaagcagatgctgctgaagcaggtgatccggaacatggagcacgccatcaaggagctgggctacctggagtatgaccaccctgagattgctgtgacagtgaagaccaaggaggagatcaacgtgatgctgaacatggccacagagatcctgaaggccttcggcctgaagggcatcatcagcaagacagagggcgccggcatcaacaagctgatcatggccaagaagaaggaggtgctggacagccagagcatcatccggcccctgactgtggaggaggtgctgtaccacatcccctggctggacaagaacaaggactacatcaacttcatccaggagaaggccaaggtggtgacctttgactgtggaaatgacatctttgaggagggagatgagcccaagggcatctacatcatcatcagcggcatggtgaagctggagaagagcaagccaggcctgggcatcgaccagatggtggagagcaaggagaaggacttccccatcatcgacacagactacatgctgtctggagagatcattggagagatcaactgcctgaccaatgagcccatgaagtacagcgccacctgcaagacagtggtggagacctgcttcatccccaagacccacctgtatgatgcctttgagcagtgcagccccctcatcaagcagaagatgtggctgaagctgggcctggccatcacagccaggaagatccgggagcacctgtcctatgaggactggaactacaacatgcagctgaagctgagcaacatctacgtggtggacatccccatgagcaccaagacagacatctatgatgagaacctgatctacgtgatcctgattcatggagctgtggaggactgcctgctgaggaagacctaccgggcccccttcctgatccccatcacctgccaccagatccagagcattgaggacttcaccaaggtggtgatcatccagacccccatcaacatgaagaccttcagaagaaacatcaggaagtttgtgcccaagcacaagagctacctgaccccaggcctgattggctctgtgggcaccctggaggagggcatccaggaggagagaaatgtgaaggaggatggagcccacagcgctgccacagcccggagcccccagccctgcagcctgctgggcaccaagttcaactgcaaggagagcccccgcatcaacctgaggaaggtgaggaaggagtag

SEQ ID NO: 171081 - DNA, 3390 bp, Artificial Sequence
  Description of Artificial Sequence: Synthetic coding sequence
atggccggcatcttcaaggagttcttcttcagcacagaggacctgcctgaggtgatcctgaccctgagcctcatcagcagcatcggggccttcctgaacagacacctggaggacttccccatccctgtgcctgtgatcctcttcctgctgggctgcagctttgaggtgctgtccttcaccagcagccaggtgcagagatatgccaatgccatccagtggatgagcccagacctcttcttccgcatcttcacccctgtggtgttcttcaccacagcctttgacatggacacctacatgctgcagaagctgttctggcagatcctgctgatcagcatccctggcttcctggtgaactacatcctggtgctgtggcacctggcctctgtgaaccagctgctgctgaagcccacccagtggctgctcttcagcgccatcctggtgtccagtgaccccatgctgacagctgctgccatccgggacctgggcctgagccgcagcctcatcagcctcatcaacggggagagcctgatgaccagcgtcatcagcctcatcaccttcaccagcatcatggactttgaccagaggctgcagagcaagaggaaccacaccctggccgaggagatcgtgggcggcatctgcagctacatcatcgccagcttcctgtttggcatcctgagcagcaagctgatccagttctggatgagcacagtgtttggagatgatgtgaaccacatcagcctcatcttcagcatcctgtacctgatcttctacatctgtgagctggtgggcatgagcggcatcttcaccctggccatcgtgggcctgctgctgaacagcaccagcttcaaggccgccatcgaggagaccctgctgctggagttcctgaccctgctgctgatcagccctgtgctgagccgggtgggccacgagttctcctggcgctggatcttcatcatggtgtgcagcgagatgaagggcatgcccaacatcaacatggccctgctgctggcctacagcgacctgtactttggaagtgacaaggagaagagccagatcctcttccatggagtgctggtgtgcctgatcaccctggtggtgaaccgcttcatcctgcctgtggccgtgaccatcctgggcctgagagatgccaccagcaccaagtacaagtctgtgtgctgcaccttccagcacttccaggagctgaccaagtctgctgccagcgccctgaagtttgacaaggacctggccaatgctgactggaacatgattgagaaggccatcaccctggagaacccctacatgctgaatgaggaggagaccacagagcaccagaaggtgaagtgcccccactgcaacaaggagattgatgagatcttcaacacagaggccatggagctggccaacagaaggctgctgagcgcccagatcgccagctaccagaggcagtacagaaatgagatcctgagccagagcgctgtgcaggtgctggtgggcgctgctgagagctttggagagaagaagggcaagtgcatgagcctggacaccatcaagaactacagcgagagccagaagacagtgacctttgccaggaagctgctgctgaactgggtgtacaacaccaggaaggagaaggagggccccagcaagtacttcttcttccgcatctgccacaccatcgtgttcacagaggagtttgaacatgtgggctacctggtgatcctgatgaacatcttccccttcatcatctcctggatcagccagctgaatgtcatctaccacagcgagctgaagcacaccaactactgcttcctgaccctgtacatcctggaggccctgctgaagattgctgccatgaggaaggacttcttcagccacgcctggaacatctttgagctggccatcaccctgattggcatcctgcacgtgatcctgattgaaattgacaccatcaagtacatcttcaatgaaacagaggtgattgtgttcatcaaggtggtgcagttcttccgcatcctgcgcatcttcaagctgattgcccccaagctgctgcagatcatcgacaagaggatgagccaccagaagaccttctggtacggcatcctgaagggctacgtgcagggcgaggccgacatcatgaccatcatcgaccagatcaccagcagcaagcagatcaagcagatgctgctgaagcaggtgatccggaacatggagcacgccatcaaggagctgggctacctggagtatgaccaccctgagattgctgtgacagtgaagaccaaggaggagatcaacgtgatgctgaacatggccacagagatcctgaaggccttcggcctgaagggcatcatcagcaagacagagggcgccggcatcaacaagctgatcatggccaagaagaaggaggtgctggacagccagagcatcatccggcccctgactgtggaggaggtgctgtaccacatcccctggctggacaagaacaaggactacatcaacttcatccaggagaaggccaaggtggtgacctttgactgtggaaatgacatctttgaggagggagatgagcccaagggcatctacatcatcatcagcggcatggtgaagctggagaagagcaagccaggcctgggcatcgaccagatggtggagagcaaggagaaggacttccccatcatcgacacagactacatgctgtctggagagatcattggagagatcaactgcctgaccaatgagcccatgaagtacagcgccacctgcaagacagtggtggagacctgcttcatccccaagacccacctgtatgatgcctttgagcagtgcagccccctcatcaagcagaagatgtggctgaagctgggcctggccatcacagccaggaagatccgggagcacctgtcctatgaggactggaactacaacatgcagctgaagctgagcaacatctacgtggtggacatccccatgagcaccaagacagacatctatgatgagaacctgatctacgtgatcctgattcatggagctgtggaggactgcctgctgaggaagacctaccgggcccccttcctgatccccatcacctgccaccagatccagagcattgaggacttcaccaaggtggtgatcatccagacccccatcaacatgaagaccttcagaagaaacatcaggaagtttgtgcccaagcacaagagctacctgaccccaggcctgattggctctgtgggcaccctggaggagggcatccaggaggagagaaatgtgaaggaggatggagcccacagcgctgccacagcccggagcccccagccctgcagcctgctgggcaccaagttcaactgcaaggagagcccccgcatcaacctgaggaaggtgaggaaggagtag

SEQ ID NO: 171082 - DNA, 2079 bp, Artificial Sequence
  Description of Artificial Sequence: Synthetic coding sequence
atgcagggcaagaagccaggcggcagcagcggcggcggccgctctggagagctgcagggagatgaggcccagaggaacaagaagaagaagaagaaggtgtcctgcttcagcaacatcaagatcttcctggtgtctgaatgtgccctgatgctggcccagggcaccgtgggcgcctacctggtgtctgtgctgaccaccctggagcggcgcttcaacctgcagagcgcagatgtgggcgtgattgccagcagctttgaaattggcaacctggccctgatcctgtttgtgtcctactttggagcccggggccaccggccccggctgattggctgcggcggcatcgtgatggccctgggcgccctgctgagcgccctgcctgagttcctgacccaccagtacaagtatgaagctggggagatccgctggggcgctgagggcagagatgtgtgtgccgccaatggaagtggaggagatgagggccctgaccctgacctgatctgcaggaacagaacagccaccaacatgatgtacctgctgctgattggagcccaggtgctgctgggcattggagccacccctgtgcagcccctgggcgtgtcctacattgatgaccacgtgcggaggaaggacagcagcctgtacatcggcatcctcttcaccatgctggtgtttggacctgcctgtggcttcatcctgggcagcttctgcaccaagatctacgtggatgctgtgttcatcgacaccagcaacctggacatcaccccagatgacccccgctggattggagcctggtggggcggcttcctgctgtgtggggccctgctcttcttcagcagcctgctgatgtttggcttcccccagagcctgcccccccacagcgagcccgccatggagagcgagcaggccatgctgtctgagcgggagtatgagcggcccaagcccagcaatggagtgctgcggcaccccctggagccagacagcagcgccagctgcttccagcagctgcgggtcatccccaaggtgaccaagcacctgctgagcaaccctgtgttcacctgcatcatcctggccgcctgcatggagattgctgtggtggccggctttgctgccttcctgggcaagtacctggagcagcagttcaacctgaccaccagcagcgccaaccagctgctgggcatgacagccatcccctgtgcctgcctgggcatcttcctgggcggcctgctggtgaagaagctgagcctgagcgccctgggcgccatccgcatggccatgctggtgaacctggtgtccacagcctgctacgtgtccttcctgttcctgggctgtgacaccggccctgtggccggcgtgacagtgccctacggcaacagcacagcccctggcagcgccctggacccctacagcccctgcaacaacaactgtgagtgccagacagacagcttcacccctgtgtgtggggctgatggcatcacctacctgagcgcctgctttgctggctgcaacagcaccaacctgaccggctgtgcctgcctgaccaccgtgcctgcagaaaatgccaccgtggtgcctgggaagtgccccagccctggctgccaggaggccttcctgaccttcctgtgtgtgatgtgcatctgcagcctgattggagccatggcccagaccccatctgtcatcatcctgatcagaacagtgtccccagagctgaagagctatgccctgggcgtgctcttcctgctgctgcggctgctgggcttcatccccccacccctcatctttggagctggcatcgacagcacctgcctcttctggagcaccttctgtggggagcagggcgcctgtgtgctgtatgacaacgtggtgtaccgctacctgtatgtgtccatcgccatcgccctgaagagctttgccttcatcctgtacaccaccacctggcagtgcctgaggaagaactacaagcgctacatcaagaaccatgaaggaggcctgagcaccagcacagagtaccaggacatcgagacagagaagacctgcccagagagccacagccccagcgaggacagctttgtgcgctcctag

SEQ ID NO: 171083 - DNA, 2076 bp, Artificial Sequence
  Description of Artificial Sequence: Synthetic coding sequence
atggaccagaaccagcacctgaacaagacagctgaggcccagcccagcgagaacaagaagacccgctactgcaatggcctgaagatgttcctggccgccctgagcctgtccttcatcgccaagaccctgggcgccatcatcatgaagagcagcatcatccacattgaaagaagatttgagatcagcagcagcctggtgggcttcattgatggcagctttgaaattggcaacctgctggtgattgtgtttgtgtcctacttcggcagcaagctgcaccggcccaagctgattggaattggctgcttcatcatgggcatcggcggcgtgctgacagccctgccccacttcttcatgggctactaccgctacagcaaggagaccaacatcaacagcagcgagaacagcaccagcaccctgagcacctgcctgatcaaccagatcctgagcctgaacagagccagccctgagatcgtgggcaagggctgcctgaaggagagcggcagctacatgtggatctacgtgttcatgggcaacatgctgcggggcattggagagacccccatcgtgcccctgggcctgagctacattgatgactttgccaaggagggccacagcagcctgtacctgggcatcctgaatgccatcgccatgattggccccatcatcggcttcaccctgggcagcctcttcagcaagatgtatgtggacatcggctacgtggacctgagcaccatccgcatcacccccacagacagccgctgggtgggcgcctggtggctgaacttcctggtgtctggcctcttcagcatcatcagcagcatccccttcttcttcctgccccagacccccaacaagccccagaaggagaggaaggccagcctgagcctgcacgtgctggagaccaatgatgagaaggaccagacagccaacctgaccaaccagggcaagaacatcaccaagaatgtgacaggcttcttccagagcttcaagagcatcctgaccaaccccctgtatgtgatgtttgtgctgctgaccctgctgcaggtgtcctcctacatcggggccttcacctacgtgttcaagtatgtggagcagcagtatggccagcccagcagcaaggccaacatcctgctgggcgtcatcaccatccccatctttgccagcggcatgttcctgggcggctacatcatcaagaagttcaagctgaacacagtgggcatcgccaagttcagctgcttcaccgctgtgatgagcctgtccttctacctgctgtacttcttcatcctgtgtgagaacaagtctgtggccggcctgaccatgacctatgatggcaacaaccctgtgaccagccacagagatgtgcccctgagctactgcaacagcgactgcaactgtgatgagagccagtgggagcctgtgtgtggcaacaacggcatcacctacatcagcccctgcctggccggctgcaagagcagcagcggcaacaagaagcccatcgtgttctacaactgcagctgcctggaggtgacaggcctgcagaacagaaactacagcgcccacctgggagaatgtcccagagatgatgcctgcaccaggaagttctacttctttgtggccatccaggtgctgaacctcttcttcagcgccctgggcggcaccagccacgtgatgctgattgtgaagatcgtgcagcctgagctgaagagcctggccctgggcttccacagcatggtgatccgggccctgggcggcatcctggcccccatctactttggagccctgattgacaccacctgcatcaagtggagcaccaacaactgtggcacccggggcagctgcaggacctacaacagcaccagcttcagccgggtgtacctgggcctgagctccatgctgcgggtgagcagcctggtgctgtacatcatcctgatctatgccatgaagaagaagtaccaggagaaggacatcaatgcctctgaaaatggatctgtgatggatgaggccaacctggagagcctgaacaagaacaagcactttgtgcccagcgctggagctgacagcgagacccactgctag

SEQ ID NO: 171084 - DNA, 2109 bp, Artificial Sequence
  Description of Artificial Sequence: Synthetic coding sequence
atggaccagcaccagcacctgaacaagacagctgagagcgccagcagcgagaagaagaagacccggcgctgcaatggcttcaagatgttcctggccgccctgtccttctcctacatcgccaaggccctgggcggcatcatcatgaagatcagcatcacccagattgaaagaagatttgacatcagcagcagcctggccggcctgattgatggcagctttgaaattggcaacctgctggtgattgtgtttgtgtcctacttcggcagcaagctgcaccggcccaagctgattggaattggctgcctgctgatgggcaccggcagcatcctgaccagcctgccccacttcttcatgggctactaccgctacagcaaggagacccacatcaaccccagcgagaacagcaccagcagcctgagcacctgcctgatcaaccagaccctgtccttcaacggcaccagccctgagatcgtggagaaggactgtgtgaaggagagcggcagccacatgtggatctacgtgttcatgggcaacatgctgcggggcattggagagacccccatcgtgcccctgggcatctcctacattgatgactttgccaaggagggccacagcagcctgtacctgggcagcctgaatgccatcggcatgattggccctgtgattggatttgccctgggcagcctgtttgccaagatgtatgtggacatcggctacgtggacctgagcaccatccgcatcacccccaaggacagccgctgggtgggcgcctggtggctgggcttcctggtgtctggcctcttcagcatcatcagcagcatccccttcttcttcctgcccaagaaccccaacaagccccagaaggagaggaagatcagcctgagcctgcacgtgctgaagaccaatgatgacaggaaccagacagccaacctgaccaaccagggcaagaatgtgaccaagaatgtgacaggcttcttccagagcctgaagagcatcctgaccaaccccctgtatgtgatcttcctgctgctgaccctgctgcaggtgtcctccttcatcggcagcttcacctacgtgttcaagtacatggagcagcagtatggccagagcgccagccacgccaacttcctgctgggcatcatcaccatccccaccgtggccaccggcatgttcctgggcggcttcatcatcaagaagttcaagctgagcctggtgggcatcgccaagttctccttcctgacctccatgatctccttcctgttccagctgctgtacttccccctcatctgtgagagcaagtctgtggccggcctgaccctgacctatgatggcaacaacagcgtggccagccacgtggatgtgcccctgagctactgcaacagcgagtgcaactgtgatgagagccagtgggagcctgtgtgtggcaacaacggcatcacctacctgagcccctgcctggccggctgcaagagcagcagcggcatcaagaagcacacagtgttctacaactgcagctgtgtggaggtgacaggcctgcagaacagaaactacagcgcccacctgggagaatgtccccgggacaacacctgcaccaggaagttcttcatctacgtggccatccaggtgatcaacagcctcttcagcgccaccggcggcaccaccttcatcctgctgactgtgaagatcgtgcagcctgagctgaaggccctggccatgggcttccagagcatggtgatccgcaccctgggcggcatcctggcccccatctactttggagccctgattgacaagacctgcatgaagtggagcaccaacagctgtggggcccagggcgcctgccgcatctacaacagcgtcttcttcggccgggtgtacctgggcctgagcatcgccctgcgcttccctgccctggtgctgtacatcgtgttcatctttgccatgaagaagaagttccagggcaaggacaccaaggccagtgacaatgaaaggaaggtgatggatgaggccaacctggagttcctgaacaacggggagcactttgtgcccagcgctggaacagacagcaagacctgcaacctggacatgcaggacaatgctgctgccaactag

SEQ ID NO: 171085 - DNA, 2109 bp, Artificial Sequence; identical to SEQ ID NO: 171084
  Description of Artificial Sequence: Synthetic coding sequence

SEQ ID NO: 171086 - DNA, 2247 bp, Artificial Sequence
  Description of Artificial Sequence: Synthetic coding sequence
atggaccagcaccagcacctgaacaagacagctgagagcgccagcagcgagaagaagaagacccggcgctgcaatggcttcaagatgttcctggccgccctgtccttctcctacatcgccaaggccctgggcggcatcatcatgaagatcagcatcacccagattgaaagaagatttgacatcagcagcagcctggccggcctgattgatggcagctttgaaattggcaacctgctggtgattgtgtttgtgtcctacttcggcagcaagctgcaccggcccaagctgattggaattggctgcctgctgatgggcaccggcagcatcctgaccagcctgccccacttcttcatgggctactaccgctacagcaaggagacccacatcaaccccagcgagaacagcaccagcagcctgagcacctgcctgatcaaccagaccctgtccttcaacggcaccagccctgagatcgtggagaaggactgtgtgaaggagagcggcagccacatgtggatctacgtgttcatgggcaacatgctgcggggcattggagagacccccatcgtgcccctgggcatctcctacattgatgactttgccaaggagggccacagcagcctgtacctgggcagcctgaatgccatcggcatgattggccctgtgattggatttgccctgggcagcctgtttgccaagatgtatgtggacatcggctacgtggacctgagcaccatccgcatcacccccaaggacagccgctgggtgggcgcctggtggctgggcttcctggtgtctggcctcttcagcatcatcagcagcatccccttcttcttcctgcccaagaaccccaacaagccccagaaggagaggaagatcagcctgagcctgcacgtgctgaagaccaatgatgacaggaaccagacagccaacctgaccaaccagggcaagaatgtgaccaagaatgtgacaggcttcttccagagcctgaagagcatcctgaccaaccccctgtatgtgatcttcctgctgctgaccctgctgcaggtgtcctccttcatcggcagcttcacctacgtgttcaagtacatggagcagcagtatggccagagcgccagccacgccaacttcctgctgggcatcatcaccatccccaccgtggccaccggcatgttcctgggcggcttcatcatcaagaagttcaagctgagcctggtgggcatcgccaagttctccttcctgacctccatgatctccttcctgttccagctgctgtacttccccctcatctgtgagagcaagtctgtggccggcctgaccctgacctatgatggcaacaacagcgtggccagccacgtggatgtgcccctgagctactgcaacagcgagtgcaactgtgatgagagccagtgggagcctgtgtgtggcaacaacggcatcacctacctgagcccctgcctggccggctgcaagagcagcagcggcatcaagaagcacacagtgttctacaactgcagctgtgtggaggtgacaggcctgcagaacagaaactacagcgcccacctgggagaatgtccccgggacaacacctgcaccaggaagttcttcatctacgtggccatccaggtgatcaacagcctcttcagcgccaccggcggcaccaccttcatcctgctgactgtgaagatcgtgcagcctgagctgaaggccctggccatgggcttccagagcatggtgatccgcaccctgggcggcatcctggcccccatctactttggagccctgattgacaagacctgcatgaagtggagcaccaacagctgtggggcccagggcgcctgccgcatctacaacagcgtcttctttggaattgtgcagcctgagctgaaggccctggccatcggcttccacagcatgatcatgaggagcctgggcggcatcctggtgcccatctactttggagccctgattgacaccacctgcatgaagtggagcaccaacagctgtggggcccggggggcctgccgcatctacaacagcacctacctgggccgggccttcttcggcctgaaggtggccctgatcttccctgtgctggtgctgctgaccgtcttcatctttgtggtgaggaagaagagccacggcaaggacaccaaggtgctggagaatgaaaggcaggtgatggatgaggccaacctggagttcctgaatgacagcgagcactttgtgcccagcgctgaggagcagtag

SEQ ID NO: 171087 - DNA, 2139 bp, Artificial Sequence
  Description of Artificial Sequence: Synthetic coding sequence
atggacaccagcagcaaagaaaacatccagctgttctgcaagacctctgtgcagcctgtgggccggcccagcttcaagacagagtaccccagcagcgaggagaagcagccctgctgcggggagctgaaggtgttcctgtgtgccctgagctttgtgtactttgccaaggccctggccgagggctacctgaagagcaccatcacccagatcgagaggagatttgacatccccagcagcctggtgggcgtgattgatggcagctttgagatcggcaacctgctggtgatcacctttgtgtcctactttggagccaagctgcaccggcccaagatcatcggggccggctgcgtcatcatgggcgtgggcaccctgctgattgccatgccccagttcttcatggagcagtacaagtatgaaagatacagccccagcagcaacagcaccctgagcatcagcccctgcctgctggagagcagcagccagctgcctgtgtctgtgatggagaagagcaagagcaagatcagcaatgaatgtgaggtggacaccagcagctccatgtggatctacgtgttcctgggcaacctgctgcggggcattggagagacccccatccagcccctgggcatcgcctacctggatgactttgccagcgaggacaatgctgccttctacatcggctgtgtgcagacagtggccatcatcggccccatcttcggcttcctgctgggcagcctgtgtgccaagctgtatgtggacattggatttgtgaacctggaccacatcaccatcacccccaaggacccccagtgggtgggcgcctggtggctgggctacctgattgctggcatcatcagcctgctggccgctgtgcccttctggtacctgcccaagagcctgcccaggagccagagccgggaggacagcaacagcagcagcgagaagagcaagttcatcattgatgaccacacagactaccagaccccccagggagaaaatgccaagatcatggagatggcccgggacttcctgcccagcctgaagaacctgtttggaaatcctgtgtacttcctgtacctgtgcaccagcacagtgcagttcaacagcctgtttggcatggtgacctacaagcccaagtacatcgagcagcagtatggccagagcagcagccgggccaactttgtgattggcctcatcaacatcccagctgtggccctgggcatcttcagcggcggcatcgtgatgaagaagttccgcatctctgtgtgtggggccgccaagctgtacctgggcagctctgtgtttggctacctgctcttcctgagcctgtttgccctgggctgtgagaacagtgatgtggccggcctgactgtgtcctaccagggcaccaagcctgtgtcctaccacgagcgggccctcttcagtgactgcaacagccgctgcaagtgcagcgagaccaagtgggagcccatgtgtggagaaaatggcatcacctacgtgtctgcctgcctggccggctgccagaccagcaacagaagtggcaagaacatcatcttctacaactgcacctgtgtgggcattgctgccagcaagagcggcaacagcagcggcatcgtgggccgctgccagaaggacaatggctgcccccagatgttcctgtacttcctggtgatcagcgtcatcaccagctacaccctgagcctgggcggcatccctggctacatcctgctgctgcgctgcatcaagccccagctgaagagctttgccctgggcatctacaccctggccatccgggtgctggccggcatcccagcccctgtgtactttggagtgctgattgacaccagctgcctgaagtggggcttcaagagatgtggcagccggggcagctgccgcctgtatgacagcaatgtgttccgccacatctacctgggcctgaccgtcatcctgggcaccgtgtccatcctgctgagcattgctgtgctcttcatcctgaagaagaactacgtgtccaagcacaggagcttcatcaccaagcgggagaggaccatggtgtccacccgcttccagaaggagaactacaccaccagtgaccacctgctgcagcccaactactggccaggcaaggagacccagctgtag

SEQ ID NO: 171088 - DNA, 2193 bp, Artificial Sequence
  Description of Artificial Sequence: Synthetic coding sequence
atggacaccagcagcaaagaaaacatccagctgttctgcaagacctctgtgcagcctgtgggccggcccagcttcaagacagagtaccccagcagcgaggagaagcagccctgctgcggggagctgaaggtgttcctgtgtgccctgagctttgtgtactttgccaaggccctggccgagggctacctgaagagcaccatcacccagatcgagaggagatttgacatccccagcagcctggtgggcgtgattgatggcagctttgagatcggcaacctgctggtgatcacctttgtgtcctactttggagccaagctgcaccggcccaagatcatcggggccggctgcgtcatcatgggcgtgggcaccctgctgattgccatgccccagttcttcatggagcagtacaagtatgaaagatacagccccagcagcaacagcaccctgagcatcagcccctgcctgctggagagcagcagccagctgcctgtgtctgtgatggagaagagcaagagcaagatcagcaatgaatgtgaggtggacaccagcagctccatgtggatctacgtgttcctgggcaacctgctgcggggcattggagagacccccatccagcccctgggcatcgcctacctggatgactttgccagcgaggacaatgctgccttctacatcggctgtgtgcagacagtggccatcatcggccccatcttcggcttcctgctgggcagcctgtgtgccaagctgtatgtggacattggatttgtgaacctggaccacatcaccatcacccccaaggacccccagtgggtgggcgcctggtggctgggctacctgattgctggcatcatcagcctgctggccgctgtgcccttctggtacctgcccaagagcctgcccaggagccagagccgggaggacagcaacagcagcagcgagaagagcaagttcatcattgatgaccacacagactaccagaccccccagggagaaaatgccaagatcatggagatggcccgggacttcctgcccagcctgaagaacctgtttggaaatcctgtgtacttcctgtacctgtgcaccagcacagtgcagttcaacagcctgtttggcatggtgacctacaagcccaagtacatcgagcagcagtatggccagagcagcagccgggccaactttgtgattggcctcatcaacatcccagctgtggccctgggcatcttcagcggcggcatcgtgatgaagaagttccgcatctctgtgtgtggggccgccaagctgtacctgggcagctctgtgtttggctacctgctcttcctgagcctgtttgccctgggctgtgagaacagtgatgtggccggcctgactgtgtcctaccagggcaccaagcctgtgtcctaccacgagcgggccctcttcagtgactgcaacagccgctgcaagtgcagcgagaccaagtgggagcccatgtgtggagaaaatggcatcacctacgtgtctgcctgcctggccggctgccagaccagcaacagaagtggcaagaacatcatcttctacaactgcacctgtgtgggcattgctgccagcaagagcggcaacagcagcggcatcgtgggccgctgccagaaggacaatggctgcccccagatgttcctgtacttcctggtgatcagcgtcatcaccagctacaccctgagcctgggcggcatccctggctacatcctgctgctgcgctgcatcaagccccagctgaagagctttgccctgggcatctacaccctggccatccgggtgctggccggcatcccagcccctgtgtactttggagtgctgattgacaccagctgcctgaagtggggcttcaagagatgtggcagccggggcagctgccgcctgtatgacagcaatgtgttccgctaccagatcaagagcatcccagccagccactgctacagcatcccagacctgcacaatgccacagacaccaacaagttcagctgccacttcaccgcctgcaagacctacatcagcggcaccaactgtgacaccggccacagcgtgaacagccccaagcactgcagcaccttccacttcaaggagaagctgtgcttcaagacccagaagttctacaaccaggagaggaagaacaatggagtgtacaagatccccaagggcaagctgcactacaagtag

SEQ ID NO: 171089 - DNA, 1992 bp, Artificial Sequence
  Description of Artificial Sequence: Synthetic coding sequence
atggacaccagcagcaaagaaaacatccagctgttctgcaagacctctgtgcagcctgtgggccggcccagcttcaagacagagtaccccagcagcgaggagaagcagccctgctgcggggagctgaaggtgttcctgtgtgccctgagctttgtgtactttgccaaggccctggccgagggctacctgaagagcaccatcacccagatcgagaggagatttgacatccccagcagcctggtgggcgtgattgatggcagctttgagatcggcaacctgctggtgatcacctttgtgtcctactttggagccaagctgcaccggcccaagatcatcggggccggctgcgtcatcatgggcgtgggcaccctgctgattgccatgccccagttcttcatggagcagtacaagtatgaaagatacagccccagcagcaacagcaccctgagcatcagcccctgcctgctggagagcagcagccagctgcctgtgtctgtgatggagaagagcaagagcaagatcagcaatggctgtgtgcagacagtggccatcatcggccccatcttcggcttcctgctgggcagcctgtgtgccaagctgtatgtggacatcggctttgtgaacctggaccacatcaccatcacccccaaggacccccagtgggtgggcgcctggtggctgggctacctgattgctggcatcatcagcctgctggccgctgtgcccttctggtacctgcccaagagcctgcccaggagccagagccgggaggacagcaacagcagcagcgagaagagcaagttcatcattgatgaccacacagactaccagaccccccagggagaaaatgccaagatcatggagatggcccgggacttcctgcccagcctgaagaacctgtttggaaatcctgtgtacttcctgtacctgtgcaccagcacagtgcagttcaacagcctgtttggcatggtgacctacaagcccaagtacatcgagcagcagtatggccagagcagcagccgggccaacttcgtcatcggcctcatcaacatcccagctgtggccctgggcatcttcagcggcggcatcgtgatgaagaagttccgcatctctgtgtgtggggccgccaagctgtacctgggcagctctgtgtttggctacctgctcttcctgagcctgtttgccctgggctgtgaaaattctgatgtggccggcctgactgtgtcctaccagggcaccaagcctgtgtcctaccacgagcgggccctcttcagtgactgcaacagccgctgcaagtgcagcgagaccaagtgggagcccatgtgtggggagaatggcatcacctacgtgtctgcctgcctggccggctgccagaccagcaacagaagtggcaagaacatcatcttctacaactgcacctgtgtgggcattgctgccagcaagagcggcaacagcagcggcatcgtgggccgctgccagaaggacaatggctgcccccagatgttcctgtacttcctggtgatcagcgtcatcaccagctacaccctgagcctgggcggcatccctggctacatcctgctgctgcgctgcatcaagccccagctgaagagctttgccctgggcatctacaccctggccatccgggtgctggccggcatcccagcccctgtgtactttggagtgctgattgacaccagctgcctgaagtggggcttcaagagatgtggcagccggggcagctgccgcctgtatgacagcaatgtgttccgccacatctacctgggcctgaccgtcatcctgggcaccgtgtccatcctgctgagcattgctgtgctcttcatcctgaagaagaactacgtgtccaagcaccgctccttcatcaccaagcgggagaggaccatggtgtccacccgcttccagaaggagaactacaccaccagtgaccacctgctgcagcccaactactggccaggcaaggagacccagctgtag

SEQ ID NO: 171090 - DNA, 1839 bp, Artificial Sequence
  Description of Artificial Sequence: Synthetic coding sequence
atgggcgtgggcaccctgctgattgccatgccccagttcttcatggagcagtacaagtatgaaagatacagccccagcagcaacagcaccctgagcatcagcccctgcctgctggagagcagcagccagctgcctgtgtctgtgatggagaagagcaagagcaagatcagcaatgaatgtgaggtggacaccagcagctccatgtggatctacgtgttcctgggcaacctgctgcggggcattggagagacccccatccagcccctgggcatcgcctacctggatgactttgccagcgaggacaatgctgccttctacatcggctgtgtgcagacagtggccatcatcggccccatcttcggcttcctgctgggcagcctgtgtgccaagctgtatgtggacattggatttgtgaacctggaccacatcaccatcacccccaaggacccccagtgggtgggcgcctggtggctgggctacctgattgctggcatcatcagcctgctggccgctgtgcccttctggtacctgcccaagagcctgcccaggagccagagccgggaggacagcaacagcagcagcgagaagagcaagttcatcattgatgaccacacagactaccagaccccccagggagaaaatgccaagatcatggagatggcccgggacttcctgcccagcctgaagaacctgtttggaaatcctgtgtacttcctgtacctgtgcaccagcacagtgcagttcaacagcctgtttggcatggtgacctacaagcccaagtacatcgagcagcagtatggccagagcagcagccgggccaactttgtgattggcctcatcaacatcccagctgtggccctgggcatcttcagcggcggcatcgtgatgaagaagttccgcatctctgtgtgtggggccgccaagctgtacctgggcagctctgtgtttggctacctgctcttcctgagcctgtttgccctgggctgtgagaacagtgatgtggccggcctgactgtgtcctaccagggcaccaagcctgtgtcctaccacgagcgggccctcttcagtgactgcaacagccgctgcaagtgcagcgagaccaagtgggagcccatgtgtggagaaaatggcatcacctacgtgtctgcctgcctggccggctgccagaccagcaacagaagtggcaagaacatcatcttctacaactgcacctgtgtgggcattgctgccagcaagagcggcaacagcagcggcatcgtgggccgctgccagaaggacaatggctgcccccagatgttcctgtacttcctggtgatcagcgtcatcaccagctacaccctgagcctgggcggcatccctggctacatcctgctgctgcgctgcatcaagccccagctgaagagctttgccctgggcatctacaccctggccatccgggtgctggccggcatcccagcccctgtgtactttggagtgctgattgacaccagctgcctgaagtggggcttcaagagatgtggcagccggggcagctgccgcctgtatgacagcaatgtgttccgctaccagatcaagagcatcccagccagccactgctacagcatcccagacctgcacaatgccacagacaccaacaagttcagctgccacttcaccgcctgcaagacctacatcagcggcaccaactgtgacaccggccacagcgtgaacagccccaagcactgcagcaccttccacttcaaggagaagctgtgcttcaagacccagaagttctacaaccaggagaggaagaacaatggagtgtacaagatccccaagggcaagctgcactacaagtag

SEQ ID NO: 171091 - DNA, 2193 bp, Artificial Sequence; identical to SEQ ID NO: 171088
  Description of Artificial Sequence: Synthetic coding sequence

SEQ ID NO: 171092 - DNA, 1932 bp, Artificial Sequence
  Description of Artificial Sequence: Synthetic coding sequence
atgggcctgctgcccaagctgggcgccagccagggcagtgacaccagcaccagccgggccggccgctgtgcccggtctgtgtttggaaacatcaaggtgtttgtgctgtgccagggcctgctgcagctgtgccagctgctgtacagcgcctacttcaagagcagcctgaccaccatcgagaagagatttggcctgagcagcagcagcagcggcctcatcagcagcctgaatgagatcagcaatgccatcctgatcatctttgtgtcctacttcggcagccgggtgcaccggccccggctgattggaattggaggcctcttcctggccgccggggccttcatcctgaccctgccccacttcctgtctgagccctaccagtacaccctggccagcacaggcaacaacagccggctgcaggccgagctgtgccagaagcactggcaggacctgccccccagcaagtgccacagcaccacccagaacccccagaaggagaccagctccatgtggggcctgatggtggtggcccagctgctggccggcatcggcaccgtgcccatccagcccttcggcatctcctatgtggatgacttcagcgagcccagcaacagccccctgtacatcagcatcctgtttgccatctctgtgtttggacctgccttcggctacctgctgggctctgtgatgctgcagatctttgtggactatggccgggtgaacacagctgctgtgaacctggtgcctggggacccccgctggattggagcctggtggctgggcctgctgatcagcagcgccctgctggtgctgaccagcttccccttcttcttcttcccccgggccatgcccatcggggccaagagggccccagccacagcagatgaggccaggaagctggaggaggccaagagccggggcagcctggtggacttcatcaagcgcttcccctgcatcttcctgcggctgctgatgaacagcctgtttgtgctggtggtgctggcccagtgcaccttcagctctgtgattgctggcctgagcaccttcctgaacaagttcctggagaagcagtatggcaccagcgctgcctatgccaacttcctgattggagctgtgaacctgcctgctgctgccctgggcatgctgtttggaggcatcctgatgaagagatttgtgttcagcctgcaggccatcccccgcatcgccaccaccatcatcaccatctccatgatcctgtgtgtgcccctcttcttcatgggctgcagcacccccaccgtggccgaggtgtacccacccagcaccagcagcagcatccacccccagagccctgcctgcagaagagactgcagctgcccagacagcatcttccaccctgtgtgtggggacaatggcatcgagtacctgagcccctgccacgccggctgcagcaacatcaacatgagcagcgccaccagcaagcagctgatctacctgaactgcagctgtgtgactggaggcagcgccagcgccaagacaggcagctgccctgtgccctgtgcccacttcctgctgcctgccatcttcctgatcagctttgtgtccctcatcgcctgcatcagccacaaccccctgtacatgatggtgctgcgggtggtgaaccaggaggagaagagctttgccatcggcgtgcagttcctgctgatgaggctgctggcctggctgcccagccctgccctgtatggcctgaccatcgaccacagctgcatccgctggaacagcctgtgcctgggccggcggggggcctgtgcctactatgacaatgatgccctgcgggaccgctacctgggcctgcagatgggctacaaggccctgggcatgctgctgctgtgcttcatctcctggagggtgaagaagaacaaggagtacaacgtgcagaaggccgccggcctcatctag

SEQ ID NO: 171093 - DNA, 1248 bp, Artificial Sequence
  Description of Artificial Sequence: Synthetic coding sequence
atgggcctgctgcccaagctgggcgccagccagggcagtgacaccagcaccagccgggccggccgctgtgcccggtctgtgtttggaaacatcaaggtgtttgtgctgtgccagggcctgctgcagctgtgccagctgctgtacagcgcctacttcaagagcagcctgaccaccatcgagaagagatttggcctgagcagcagcagcagcggcctcatcagcagcctgaatgagatcagcaatgccatcctgatcatctttgtgtcctacttcggcagccgggtgcaccggccccggctgattggaattggaggcctcttcctggccgccggggccttcatcctgaccctgccccacttcctgtctgagccctaccagtacaccctggccagcacaggcaacaacagccggctgcaggccgagctgtgccagaagcactggcaggacctgccccccagcaagtgccacagcaccacccagaacccccagaaggagaccagctccatgtggggcctgatggtggtggcccagctgctggccggcatcggcaccgtgcccatccagcccttcggcatctcctatgtggatgacttcagcgagcccagcaacagccccctgtacatcagcatcctgtttgccatctctgtgtttggacctgccttcggctacctgctgggctctgtgatgctgcagatctttgtggactatggccgggtgaacacagctgctgtgaacctggtgcctggggacccccgctggattggagcctggtggctgggcctgctgatcagcagcgccctgctggtgctgaccagcttccccttcttcttcttcccccgggccatgcccatcggggccaagagggccccagccacagcagatgaggccaggaagctggaggaggccaagagccggggcagcctggtggacttcatcaagcgcttcccctgcatcttcctgcggctgctgatgaacagcctgtttgtgctggtggtgctggcccagtgcaccttcagctctgtgattgctggcctgagcaccttcctgaacaagttcctggagaagcagtatggcaccagcgctgcctatgccaacttcctgattgcccaccaggtgctgtacatccgcagcctgctgcctgctgctggaacagcccgggcccagatcctgagcagcaccaggtctgtggagaccatggagagcagcaccagccccctggccatgcctgctgctgccaccagcacctag

SEQ ID NO: 171094 - DNA, 2133 bp, Artificial Sequence
  Description of Artificial Sequence: Synthetic coding sequence
atgcagggcaagaagccaggcggcagcagcggcggcggccgctctggagagctgcagggagatgaggcccagaggaacaagaagaagaagaagaaggtgtcctgcttcagcaacatcaagatcttcctggtgtctgaatgtgccctgatgctggcccagggcaccgtgggcgcctacctggtgtctgtgctgaccaccctggagcggcgcttcaacctgcagagcgcagatgtgggcgtgattgccagcagctttgaaattggcaacctggccctgatcctgtttgtgtcctactttggagcccggggccaccggccccggctgattggctgcggcggcatcgtgatggccctgggcgccctgctgagcgccctgcctgagttcctgacccaccagtacaagtatgaagctggggagatccgctggggcgctgagggcagagatgtgtgtgccgccaatggaagtggaggagatgagggccctgaccctgacctgatctgcaggaacagaacagccaccaacatgatgtacctgctgctgattggagcccaggtgctgctgggcattggagccacccctgtgcagcccctgggcgtgtcctacattgatgaccacgtgcggaggaaggacagcagcctgtacatcggcatcctcttcaccatgctggtgtttggacctgcctgtggcttcatcctgggcagcttctgcaccaagatctacgtggatgctgtgttcatcgacaccagcaacctggacatcaccccagatgacccccgctggattggagcctggtggggcggcttcctgctgtgtggggccctgctcttcttcagcagcctgctgatgtttggcttcccccagagcctgcccccccacagcgagcccgccatggagagcgagcaggccatgctgtctgagcgggagtatgagcggcccaagcccagcaatggagtgctgcggcaccccctggagccagacagcagcgccagctgcttccagcagctgcgggtcatccccaaggtgaccaagcacctgctgagcaaccctgtgttcacctgcatcatcctggccgcctgcatggagattgctgtggtggccggctttgctgccttcctgggcaagtacctggagcagcagttcaacctgaccaccagcagcgccaaccagctgctgggcatgacagccatcccctgtgcctgcctgggcatcttcctgggcggcctgctggtgaagaagctgagcctgagcgccctgggcgccatccgcatggccatgctggtgaacctggtgtccacagcctgctacgtgtccttcctgttcctgggctgtgacaccggccctgtggccggcgtgacagtgccctacggcaacagcacagcccctggcagcgccctggacccctacagcccctgcaacaacaactgtgagtgccagacagacagcttcacccctgtgtgtggggctgatggcatcacctacctgagcgcctgctttgctggctgcaacagcaccaacctgaccggctgtgcctgcctgaccaccgtgcctgcagaaaatgccaccgtggtgcctgggaagtgccccagccctggctgccaggaggccttcctgaccttcctgtgtgtgatgtgcatctgcagcctgattggagccatggcccagaccccatctgtcatcatcctgatcagaacagtgtccccagagctgaagagctatgccctgggcgtgctcttcctgctgctgcggctgctgggcttcatccccccacccctcatctttggagctggcatcgacagcacctgcctcttctggagcaccttctgtggggagcagggcgcctgtgtgctgtatgacaacgtggtgtaccgctacctgtatgtgtccatcgccatcgccctgaagagctttgccttcatcctgtacaccaccacctggcagtgcctgaggaagaactacaagcgctacatcaagaaccatgaaggaggcctgagcaccagcgagttctttgccagcaccctgaccctggacaacctgggccgggaccctgtgcctgccaaccagacccacaggaccaagttcatctacaacctggaggaccacgagtggtgtgagaacatggagagcgtgctgtag

SEQ ID NO: 171095 - DNA, 1356 bp, Artificial Sequence
  Description of Artificial Sequence: Synthetic coding sequence
atgagggagatcgtgcacatccagatcggccagtgtggcaaccagatcggggccaagttctgggagatgattggagaggagcacggcatcgacctggccggcagtgacagaggagccagcgccctgcagctggagcgcatctctgtgtactacaatgaggcctacggcaggaaatatgtgcccagggctgtgctggtggacctggagcccggcaccatggacagcatccgcagcagcaagctgggcgccctcttccagcctgacagctttgtgcacggcaacagcggggccggcaacaactgggccaagggccactacacagaaggagctgagctgattgaaaatgtgctggaggtggtgagacatgagagcgagagctgtgactgcctgcagggcttccagatcgtgcacagcctgggcggcggcactggaagtggcatgggcaccctgctgatgaacaagatccgggaggagtacccagaccgcatcatgaacagcttctctgtgatgcccagccccaaggtgtctgacacagtggtggagccctacaatgctgtgctgagcatccaccagctgattgaaaatgctgatgcctgcttctgcatcgacaatgaggccctgtatgacatctgcttccgcaccctgaagctgaccacccccacctacggggacctgaaccacctggtgtccctgaccatgagcggcatcaccaccagcctgcgcttccctggccagctgaatgctgacctgaggaagctggccgtgaacatggtgcccttcccccggctgcacttcttcatgcctggctttgcccccctgacagcccagggcagccagcagtaccgggccctgtctgtggccgagctgacccagcagatgtttgatgccaggaacaccatggccgcctgtgacctgcggcggggccgctacctgactgtggcctgcatcttccggggcaagatgagcaccaaggaggtggaccagcagctgctgtctgtgcagaccaggaacagcagctgctttgtggagtggatccccaacaacgtgaaggtggccgtgtgtgacatccccccccggggcctgtccatggccgccaccttcatcggcaacaacacagccatccaggagatcttcaacagagtgtctgagcacttcagcgccatgttcaagaggaaggcctttgtgcactggtacaccagcgagggcatggacatcaatgaatttggagaggccgagaacaacatccatgacctggtgtctgagtaccagcagttccaggatgccaaggctgtgctggaggaggatgaggaggtgacagaggaggccgagatggagccagaagataaaggccactag

SEQ ID NO: 171096 - DNA, 1749 bp, Artificial Sequence
  Description of Artificial Sequence: Synthetic coding sequence
atgcccctgcaccagctgggggacaagcccctgaccttccccagccccaacagcgccatggagaatggcctggaccacaccccacccagcagaagagccagccctggcacccccctgagccctggcagcctgcggtctgctgcccacagccccctggacaccagcaagcagcccctgtgccagctgtgggccgagaagcatggagcccggggcacccatgaggtgcgctacgtgtctgctggccagagcgtggcctgtggctggtgggcctttgccccaccctgcctgcaggtgctgaacacccccaagggcatcctcttcttcctgtgtgccgccgccttcctgcagggcatgacagtgaatggcttcatcaacacagtcatcaccagcctggagaggagatatgacctgcacagctaccagagcggcctgattgccagcagctatgacattgctgcctgcctgtgcctgacctttgtgtcctactttggaggcagcggccacaagccccgctggctgggctggggcgtgctgctgatgggcaccggcagcctggtgtttgccctgccccacttcaccgctggccgctatgaggtggagctggatgctggggtgaggacctgcccagccaaccctggagctgtgtgtgccgacagcaccagcggcctgagccgctaccagctggtgttcatgctgggccagttcctgcatggagtgggcgccacccccctgtacaccctgggcgtgacctacctgggcatgagcaccttcagccccaagttcctggagagccagttcagcctgagcgccagcgaggccgccaccctgtttggctacctggtggtgcctgctgggggcggcggcaccttcctgggcggcttctttgtgaacaagctgcggctgcggggcagcgctgtgatcaagttctgcctcttctgcaccgtggtgtccctgctgggcatcctggtgttcagcctgcactgccccagcgtgcccatggccggcgtgacagccagctatggaggcagcctgctgcctgagggccacctgaacctgacagccccctgcaatgctgcctgcagctgccagcctgagcactacagccctgtgtgtggcagtgatggcctgatgtacttcagcctgtgccacgccggctgcccagctgccacagagaccaacgtggatggccagaaggtgtacagagactgcagctgcatcccccagaacctgagcagcggcttcggccacgccacagctgggaagtgcaccagcacctgccagaggaagcccctgctgctggtgttcatctttgtggtgatcttcttcaccttcctgagcagcatcccagccctgacagccaccctgcgctgtgtgcgggacccccagaggagctttgccctgggcatccagtggatcgtggtgcgcatcctgggcggcatccctggccccatcgccttcggctgggtgattgacaaggcctgcctgctgtggcaggaccagtgtggccagcagggcagctgcctggtgtaccagaacagcgccatgagccgctacatcctgatcatgggcctgctgtacaaggtgctgggcgtgctcttctttgccatcgccagcagcagagctgccagtgaccaccggcccaggcctcctggccacggcggccacagcgccttcccagatgacagaacagtgcccctgggagatgccatcacccgggagctgctgtttgacctgcagcccagcacctag

SEQ ID NO: 171097 - DNA, 2169 bp, Artificial Sequence
  Description of Artificial Sequence: Synthetic coding sequence
atgcccctgcaccagctgggggacaagcccctgaccttccccagccccaacagcgccatggagaatggcctggaccacaccccacccagcagaagagccagccctggcacccccctgagccctggcagcctgcggtctgctgcccacagccccctggacaccagcaagcagcccctgtgccagctgtgggccgagaagcatggagcccggggcacccatgaggtgcgctacgtgtctgctggccagagcgtggcctgtggctggtgggcctttgccccaccctgcctgcaggtgctgaacacccccaagggcatcctcttcttcctgtgtgccgccgccttcctgcagggcatgacagtgaatggcttcatcaacacagtcatcaccagcctggagaggagatatgacctgcacagctaccagagcggcctgattgccagcagctatgacattgctgcctgcctgtgcctgacctttgtgtcctactttggaggcagcggccacaagccccgctggctgggctggggcgtgctgctgatgggcaccggcagcctggtgtttgccctgccccacttcaccgctggccgctatgaggtggagctggatgctggggtgaggacctgcccagccaaccctggagctgtgtgtgccgacagcaccagcggcctgagccgctaccagctggtgttcatgctgggccagttcctgcatggagtgggcgccacccccctgtacaccctgggcgtgacctacctggatgaaaatgtgaagagcagctgcagccctgtgtacatcgccatcttctacacagctgccatcctgggccctgctgctggctacctgattggaggagccctgctgaacatctacacagagatgggcagaagaacagagctgaccacagagagccccctgtgggtgggcgcctggtgggtgggcttcctgggcagcggggccgccgccttcttcaccgctgtgcccatcctgggctacccccggcagctgcccggcagccagagatatgctgtgatgagagctgctgagatgcaccagctgaaggacagcagcagaggagaggccagcaacccagactttgggaagaccatccgggacctgcccctgagcatctggctgctgctgaagaaccccaccttcatcctgctgtgcctggccggggccacagaggccaccctcatcaccggcatgagcaccttcagccccaagttcctggagagccagttcagcctgagcgccagcgaggccgccaccctgtttggctacctggtggtgcctgctgggggcggcggcaccttcctgggcggcttctttgtgaacaagctgcggctgcggggcagcgctgtgatcaagttctgcctcttctgcaccgtggtgtccctgctgggcatcctggtgttcagcctgcactgccccagcgtgcccatggccggcgtgacagccagctatggaggcagcctgctgcctgagggccacctgaacctgacagccccctgcaatgctgcctgcagctgccagcctgagcactacagccctgtgtgtggcagtgatggcctgatgtacttcagcctgtgccacgccggctgcccagctgccacagagaccaacgtggatggccagaaggtgtacagagactgcagctgcatcccccagaacctgagcagcggcttcggccacgccacagctgggaagtgcaccagcacctgccagaggaagcccctgctgctggtgttcatctttgtggtgatcttcttcaccttcctgagcagcatcccagccctgacagccaccctgcgctgtgtgcgggacccccagaggagctttgccctgggcatccagtggatcgtggtgcgcatcctgggcggcatccctggccccatcgccttcggctgggtgattgacaaggcctgcctgctgtggcaggaccagtgtggccagcagggcagctgcctggtgtaccagaacagcgccatgagccgctacatcctgatcatgggcctgctgtacaaggtgctgggcgtgctcttctttgccatcgcctgcttcctgtacaagcccctgtctgagagcagtgatggcctggagacctgcctgcccagccagagcagcgccccagacagcgccacagacagccagctgcagagctctgtgtag

SEQ ID NO: 171098 - DNA, 2169 bp, Artificial Sequence
  Description of Artificial Sequence: Synthetic coding sequence
atgcccctgcaccagctgggggacaagcccctgaccttccccagccccaacagcgccatggagaatggcctggaccacaccccacccagcagaagagccagccctggcacccccctgagccctggcagcctgcggtctgctgcccacagccccctggacaccagcaagcagcccctgtgccagctgtgggccgagaagcatggagcccggggcacccatgaggtgcgctacgtgtctgctggccagagcgtggcctgtggctggtgggcctttgccccaccctgcctgcaggtgctgaacacccccaagggcatcctcttcttcctgtgtgccgccgccttcctgcagggcatgacagtgaatggcttcatcaacacagtcatcaccagcctggagaggagatatgacctgcacagctaccagagcggcctgattgccagcagctatgacattgctgcctgcctgtgcctgacctttgtgtcctactttggaggcagcggccacaagccccgctggctgggctggggcgtgctgctgatgggcaccggcagcctggtgtttgccctgccccacttcaccgctggccgctatgaggtggagctggatgctggggtgaggacctgcccagccaaccctggagctgtgtgtgccgacagcaccagcggcctgagccgctaccagctggtgttcatgctgggccagttcctgcatggagtgggcgccacccccctgtacaccctgggcgtgacctacctggatgaaaatgtgaagagcagctgcagccctgtgtacatcgccatcttctacacagctgccatcctgggccctgctgctggctacctgattggaggagccctgctgaacatctacacagagatgggcagaagaacagagctgaccacagagagccccctgtgggtgggcgcctggtgggtgggcttcctgggcagcggggccgccgccttcttcaccgctgtgcccatcctgggctacccccggcagctgcccggcagccagagatatgctgtgatgagagctgctgagatgcaccagctgaaggacagcagcagaggagaggccagcaacccagactttgggaagaccatccgggacctgcccctgagcatctggctgctgctgaagaaccccaccttcatcctgctgtgcctggccggggccacagaggccaccctcatcaccggcatgagcaccttcagccccaagttcctggagagccagttcagcctgagcgccagcgaggccgccaccctgtttggctacctggtggtgcctgctgggggcggcggcaccttcctgggcggcttctttgtgaacaagctgcggctgcggggcagcgctgtgatcaagttctgcctcttctgcaccgtggtgtccctgctgggcatcctggtgttcagcctgcactgccccagcgtgcccatggccggcgtgacagccagctatggaggcagcctgctgcctgagggccacctgaacctgacagccccctgcaatgctgcctgcagctgccagcctgagcactacagccctgtgtgtggcagtgatggcctgatgtacttcagcctgtgccacgccggctgcccagctgccacagagaccaacgtggatggccagaaggtgtacagagactgcagctgcatcccccagaacctgagcagcggcttcggccacgccacagctgggaagtgcaccagcaccttcctgtacatcccccagcagcacagctgcaccaatggaaacagcaccaccggggccctgcaggagacccccaggagcaagagggcctgccgctgtgtgcgggacccccagaggagctttgccctgggcatccagtggatcgtggtgcgcatcctgggcggcatccctggccccatcgccttcggctgggtgattgacaaggcctgcctgctgtggcaggaccagtgtggccagcagggcagctgcctggtgtaccagaacagcgccatgagccgctacatcctgatcatgggcctgctgtacaaggtgctgggcgtgctcttctttgccatcgcctgcttcctgtacaagcccctgtctgagagcagtgatggcctggagacctgcctgcccagccagagcagcgccccagacagcgccacagacagccagctgcagagctctgtgtag

SEQ ID NO: 171099 - DNA, 456 bp, Artificial Sequence
  Description of Artificial Sequence: Synthetic coding sequence
accacagccctgtgtgccgccaggacagccagctgcaccagccactgtgccacccagggcgccctgcagcccaggaggaggatgtggacagcccggcgctgtgtgcgggacccccagaggagctttgccctgggcatccagtggatcgtggtgcgcatcctgggcggcatccctggccccatcgccttcggctgggtgattgacaaggcctgcctgctgtggcaggaccagtgtggccagcagggcagctgcctggtgtaccagaacagcgccatgagccgctacatcctgatcatgggcctgctgtacaaggtgctgggcgtgctcttctttgccatcgcctgcttcctgtacaagcccctgtctgagagcagtgatggcctggagacctgcctgcccagccagagcagcgccccagattctgccacagacagccagctgcagagctctgtgtag

SEQ ID NO: 171100 - DNA, 1863 bp, Artificial Sequence
  Description of Artificial Sequence: Synthetic coding sequence
atgcccctgcaccagctgggggacaagcccctgaccttccccagccccaacagcgccatggagaatggcctggaccacaccccacccagcagaagagccagccctggcacccccctgagccctggcagcctgcggtctgctgcccacagccccctggacaccagcaagcagcccctgtgccagctgtgggccgagaagcatggagcccggggcacccatgaggtgcgctacgtgtctgctggccagagcgtggcctgtggctggtgggcctttgccccaccctgcctgcaggtgctgaacacccccaagggcatcctcttcttcctgtgtgccgccgccttcctgcagggcatgacagtgaatggcttcatcaacacagtcatcaccagcctggagaggagatatgacctgcacagctaccagagcggcctgattgccagcagctatgacattgctgcctgcctgtgcctgacctttgtgtcctactttggaggcagcggccacaagccccgctggctgggctggggcgtgctgctgatgggcaccggcagcctggtgtttgccctgccccacttcaccgctggccgctatgaggtggagctggatgctggggtgaggacctgcccagccaaccctggagctgtgtgtgccgacagcaccagcggcctgagccgctaccagctggtgttcatgctgggccagttcctgcatggagtgggcgccacccccctgtacaccctgggcgtgacctacctggatgaaaatgtgaagagcagctgcagccctgtgtacatcgccatcttctacacagctgccatcctgggccctgctgctggctacctgattggaggagccctgctgaacatctacacagagatgggcagaagaacagagctgaccacagagagccccctgtgggtgggcgcctggtgggtgggcttcctgggcagcggggccgccgccttcttcaccgctgtgcccatcctgggctacccccggcagctgcccggcagccagagatatgctgtgatgagagctgctgagatgcaccagctgaaggacagcagcagaggagaggccagcaacccagactttgggaagaccatccgggacctgcccctgagcatctggctgctgctgaagaaccccaccttcatcctgctgtgcctggccggggccacagaggccaccctcatcaccggcatgagcaccttcagccccaagttcctggagagccagttcagcctgagcgccagcgaggccgccaccctgtttggctacctggtggtgcctgctgggggcggcggcaccttcctgggcggcttctttgtgaacaagctgcggctgcggggcagcgctgtgatcaagttctgcctcttctgcaccgtggtgtccctgctgggcatcctggtgttcagcctgcactgccccagcgtgcccatggccggcgtgacagccagctatggaggcagcctgctgcctgagggccacctgaacctgacagccccctgcaatgctgcctgcagctgccagcctgagcactacagccctgtgtgtggcagtgatggcctgatgtacttcagcctgtgccacgccggctgcccagctgccacagagaccaacgtggatggccagaaggtgtctggagctgctgcctaccggccctgcccccccctggaccctggaaaaggaccaccctgcctgcccctggtgattggagccatcgtgggcctgccccgctgcacagagaccgtggccgtgtccctgcgcatcttccccctggtgctggccatgcccctgcagggcaatgccctgcagctggtgcgggagagccccagcttctggttctcctacagcctgtag

SEQ ID NO: 171101 - DNA, 2160 bp, Artificial Sequence
  Description of Artificial Sequence: Synthetic coding sequence
atgtttgtgggcgtggcccggcacagcggcagccaggatgaggtgtcccggggcgtggagcccctggaggccgcccgggcccagcctgccaaggacagaagagccaagggcacccccaagagcagcaagccaggcaagaagcaccgctacctgcggctgctgcctgaggccctgatccgctttggaggcttcaggaagaggaagaaggccaagagctctgtgtccaagaagccaggagaggtggatgacagcctggagcagccctgtggcctgggctgcctggtgtccacctgctgtgagtgctgcaacaacatccgctgcttcatgatcttctactgcatcctgctgatctgccagggcgtggtgtttggcctgattgatgtgtccatcggggacttccagaaggagtaccagctgaagaccatcgagaagctggccctggagaagagctatgacatcagcagcggcctggtggccatcttcatcgccttctatggagacaggaagaaggtgatctggtttgtggccagcagcttcctgattggcctgggcagcctgctgtgtgccttccccagcatcaatgaggagaacaagcagagcaaggtgggcatcgaggacatctgtgaggagatcaaggtggtgtctggctgccagagcagcggcatctccttccagagcaagtacctgtccttcttcatcctgggccagacagtgcagggcattgctggcatgcccctgtacatcctgggcatcaccttcattgatgaaaatgtggccacccacagcgctggcatctacctgggcattgctgaatgtacctccatgattggctacgccctgggctacgtgctgggcgcccccctggtgaaggtgcctgagaacaccaccagcgccaccaacaccaccgtgaacaacggcagccctgagtggctgtggacctggtggatcaacttcctgtttgctgctgtggtggcctggtgcaccctcatccccctgagctgcttccccaacaacatgcctggcagcacccgcatcaaggccaggaagaggaagcagctgcacttctttgacagccggctgaaggacctgaagctgggcaccaacatcaaggacctgtgtgccgccctgtggatcctgatgaagaaccctgtgctgatctgcctggccctgagcaaggccacagagtacctggtgatcatcggggccagcgagttcctgcccatctacctggagaaccagttcatcctgacccccaccgtggccaccaccctggccggcctggtgctgatccctggaggagccctgggccagctgctgggcggcgtgattgtgtccaccctggagatgagctgcaaggccctgatgaggttcatcatggtgaccagcgtcatcagcctcatcctgctggtgttcatcatctttgtgcgctgcaaccctgtgcagtttgctggcatcaatgaagattatgatggcaccgggaagctgggcaacctgacagccccctgcaatgaaaaatgtcgctgcagcagcagcatctacagcagcatctgtggcagagatgacatcgagtacttcagcccctgctttgctggctgcacctacagcaaggcccagaaccagaagaagatgtactacaactgcagctgcatcaaggagggcctcatcacagcagatgctgagggggacttcattgatgcccggcctggaaaatgtgatgccaagtgctacaagctgcccctcttcatcgccttcatcttcagcaccctcatcttcagcggcttctctggagtgcccatcgtgctggccatgaccagggtggtgcctgacaagctgcggagcctggccctgggcgtgtcctatgtgatcctgcgcatcttcggcaccatccctggccccagcatcttcaagatgtctggagagaccagctgcatcctgagagatgtgaacaagtgtggccacacaggccgctgctggatctacaacaagaccaagatggccttcctgctggtgggcatctgcttcctgtgcaagctgtgcaccatcatcttcaccaccatcgccttcttcatctacaagaggcggctgaatgaaaatacagacttcccagatgtgacagtgaagaaccccaaggtgaagaagaaggaggagacagacctgtag

SEQ ID NO: 171102 - DNA, 1401 bp, Artificial Sequence
  Description of Artificial Sequence: Synthetic coding sequence
atgtttgtgggcgtggcccggcacagcggcagccaggatgaggtgtcccggggcgtggagcccctggaggccgcccgggcccagcctgccaaggacagaagagccaagggcacccccaagagcagcaagccaggcaagaagcaccgctacctgcggctgctgcctgaggccctgatccgctttggaggcttcaggaagaggaagaaggccaagagctctgtgtccaagaagccaggagaggtggatgacagcctggagcagccctgtggcctgggctgcctggtgtccacctgctgtgagtgctgcaacaacatccgctgcttcatgatcttctactgcatcctgctgatctgccagggcgtggtgtttggcctgattgatgtgtccatcggggacttccagaaggagtaccagctgaagaccatcgagaagctggccctggagaagagctatgacatcagcagcggcctggtggccatcttcatcgccttctatggagacaggaagaaggtgatctggtttgtggccagcagcttcctgattggcctgggcagcctgctgtgtgccttccccagcatcaatgaggagaacaagcagagcaaggtgggcatcgagggcattgctgaatgtacctccatgattggctacgccctgggctacgtgctgggcgcccccctggtgaaggtgcctgagaacaccaccagcgccaccaagacaggcaagctgggcaacctgacagccccctgcaatgagaagtgccgctgcagcagcagcatctacagcagcatctgtggcagagatgacatcgagtacttcagcccctgctttgctggctgcacctacagcaaggcccagaaccagaagaagatgtactacaactgcagctgcatcaaggagggcctcatcacagcagatgctgagggggacttcattgatgcccggcctggaaaatgtgatgccaagtgctacaagctgcccctcttcatcgccttcatcttcagcaccctcatcttcagcggcttcagcggcgtgcccatcgtgctggccatgaccagggtggtgcctgacaagctgcggagcctggccctgggcgtgtcctatgtgatcctgcgcatcttcggcaccatccctggccccagcatcttcaagatgtctggagagaccagctgcatcctgagagatgtgaacaagtgtggccacacaggccgctgctggatctacaacaagaccaagatggccttcctgctggtgggcatctgcttcctgtgcaagctgtgcaccatcatcttcaccaccatcgccttcttcatctacaagaggcggctgaatgaaaatacagacttcccagatgtgacagtgaagaaccccaaggtgaagaagaaggaggagacagacctgtag

SEQ ID NO: 171103 - DNA, 1974 bp, Artificial Sequence
  Description of Artificial Sequence: Synthetic coding sequence
atgtttgtgggcgtggcccggcacagcggcagccaggatgaggtgtcccggggcgtggagcccctggaggccgcccgggcccagcctgccaaggacagaagagccaagggcacccccaagagcagcaagccaggcaagaagcaccgctacctgcggctgctgcctgaggccctgatccgctttggaggcttcaggaagaggaagaaggccaagagctctgtgtccaagaagccaggagaggtggatgacagcctggagcagccctgtggcctgggctgcctggtgtccacctgctgtgagtgctgcaacaacatccgctgcttcatgatcttctactgcatcctgctgatctgccagggcgtggtgtttggcctgattgatgtgtccatcggggacttccagaaggagtaccagctgaagaccatcgagaagctggccctggagaagagctatgacatcagcagcggcctggtggccatcttcatcgccttctatggagacaggaagaaggtgatctggtttgtggccagcagcttcctgattggcctgggcagcctgctgtgtgccttccccagcatcaatgaggagaacaagcagagcaaggtgggcatcgagggcattgctgaatgtacctccatgattggctacgccctgggctacgtgctgggcgcccccctggtgaaggtgcctgagaacaccaccagcgccaccaacaccaccgtgaacaacggcagccctgagtggctgtggacctggtggatcaacttcctgtttgctgctgtggtggcctggtgcaccctcatccccctgagctgcttccccaacaacatgcctggcagcacccgcatcaaggccaggaagaggaagcagctgcacttctttgacagccggctgaaggacctgaagctgggcaccaacatcaaggacctgtgtgccgccctgtggatcctgatgaagaaccctgtgctgatctgcctggccctgagcaaggccacagagtacctggtgatcatcggggccagcgagttcctgcccatctacctggagaaccagttcatcctgacccccaccgtggccaccaccctggccggcctggtgctgatccctggaggagccctgggccagctgctgggcggcgtgattgtgtccaccctggagatgagctgcaaggccctgatgaggttcatcatggtgaccagcgtcatcagcctcatcctgctggtgttcatcatctttgtgcgctgcaaccctgtgcagtttgctggcatcaatgaagattatgatggcaccgggaagctgggcaacctgacagccccctgcaatgaaaaatgtcgctgcagcagcagcatctacagcagcatctgtggcagagatgacatcgagtacttcagcccctgctttgctggctgcacctacagcaaggcccagaaccagaagaagatgtactacaactgcagctgcatcaaggagggcctcatcacagcagatgctgagggggacttcattgatgcccggcctggaaaatgtgatgccaagtgctacaagctgcccctcttcatcgccttcatcttcagcaccctcatcttcagcggcttctctggagtgcccatcgtgctggccatgaccagggtggtgcctgacaagctgcggagcctggccctgggcgtgtcctatgtgatcctgcgcatcttcggcaccatccctggccccagcatcttcaagatgtctggagagaccagctgcatcctgagagatgtgaacaagtgtggccacacaggccgctgctggatctacaacaagaccaagatggccttcctgctggtgggcatctgcttcctgtgcaagctgtgcaccatcatcttcaccaccatcgccttcttcatctacaagaggcggctgaatgaaaatacagacttcccagatgtgacagtgaagaaccccaaggtgaagaagaaggaggagacagacctgtag

SEQ ID NO: 171104 - DNA, 2160 bp, Artificial Sequence; identical to SEQ ID NO: 171101
  Description of Artificial Sequence: Synthetic coding sequence

SEQ ID NO: 171105 - DNA, 78 bp, Artificial Sequence
  Description of Artificial Sequence: Synthetic coding sequence
ctcaatgaaaatacagacttcccagatgtgacagtgaagaaccccaaggtgaagaagaaggaggagacagacctgtag

SEQ ID NO: 171106 - DNA, 1401 bp, Artificial Sequence; identical to SEQ ID NO: 171102
  Description of Artificial Sequence: Synthetic coding sequence

SEQ ID NO: 171107 - DNA, 351 bp, Artificial Sequence
  Description of Artificial Sequence: Synthetic coding sequence
atgctgagctgccgcctgcagtgtgccctggccgccctgagcatcgtgctggccctgggctgtgtgactggagcccccagcgacccccggctgcggcagttcctgcagaagagcctggccgctgctgctgggaagcaggagctggccaagtacttcctggccgagctgctgtctgagcccaaccagacagaaaatgatgccctggagcctgaggacctgagccaggccgctgagcaggatgagatgaggctggagctgcagaggtctgccaacagcaacccagccatggccccccgggagaggaaggccggctgcaagaacttcttctggaagaccttcaccagctgctag

SEQ ID NO: 171108 - DNA, 1176 bp, Artificial Sequence
  Description of Artificial Sequence: Synthetic coding sequence
atgttccccaacggcacagccagcagccccagcagcagccccagccccagccctggcagctgtggggagggcggcggcagccggggccctggggccggggctgctgatggcatggaggagcctggaagaaatgccagccagaatggcaccctgtctgagggccagggcagcgccatcctgatctccttcatctacagcgtggtgtgcctggtgggcctgtgtggcaacagcatggtgatctacgtgatcctgcgctatgccaagatgaagacagccaccaacatctacatcctgaacctggccatcgcagatgagctgctgatgctgtctgtgcccttcctggtgaccagcaccctgctgcggcactggccctttggagccctgctgtgccgcctggtgctgtctgtggatgctgtgaacatgttcaccagcatctactgcctgactgtgctgtctgtggaccgctacgtggccgtggtgcaccccatcaaggccgcccgctacagaagacccaccgtggccaaggtggtgaacctgggcgtgtgggtgctgagcctgctggtgatcctgcccatcgtggtgttcagcaggacagctgccaacagtgatggcaccgtggcctgcaacatgctgatgcctgagcccgcccagcgctggctggtgggctttgtgctgtacaccttcctgatgggcttcctgctgcctgtgggcgccatctgcctgtgctacgtgctgatcatcgccaagatgaggatggtggccctgaaggccggctggcagcagaggaagaggtctgagaggaagatcaccctgatggtgatgatggtggtgatggtgtttgtgatctgctggatgcccttctacgtggtgcagctggtgaatgtgtttgctgagcaggatgatgccaccgtgtcccagctgagcgtcatcctgggctacgccaacagctgtgccaaccccatcctgtatggcttcctgagtgacaacttcaagaggagcttccagaggatcctgtgcctgtcctggatggacaatgctgctgaggagcctgtggactactatgccacagccctgaagagccgggcctacagcgtggaggacttccagcctgagaacctggagagcggaggagtcttcagaaatggcacctgcaccagccgcatcaccaccctgtag

SEQ ID NO: 171109 - DNA, 1257 bp, Artificial Sequence
  Description of Artificial Sequence: Synthetic coding sequence
atggacatgctgcaccccagctctgtgtccaccaccagcgagccagaaaatgccagcagcgcctggcccccagatgccaccctgggcaatgtgtctgctggccccagccctgctggcctggccgtgtctggagtgctgatccccctggtgtacctggtggtgtgtgtggtgggcctgctgggcaacagcctggtgatctacgtggtgctgcggcacacagccagccccagcgtgaccaacgtgtacatcctgaacctggccctggctgatgagctgttcatgctgggcctgcccttcctggccgcccagaatgccctgagctactggcccttcggcagcctgatgtgccgcctggtgatggctgtggatggcatcaaccagttcaccagcatcttctgcctgactgtgatgtctgtggaccgctacctggccgtggtgcaccccaccaggtctgcccgctggaggacagcccctgtggccaggacagtgtctgctgctgtgtgggtggccagcgctgtggtggtgctgcctgtggtggtgttcagcggcgtgccccggggcatgagcacctgccacatgcagtggccagagcctgctgctgcctggagggctggcttcatcatctacacagctgccctgggcttcttcggccccctgctggtgatctgcctgtgctacctgctgattgtggtgaaggtgcgctctgctggccggcgggtgtgggcccccagctgccagaggagaagaagaagtgaaagaagagtgaccaggatggtggtggccgtggtggccctgtttgtgctgtgctggatgcccttctacgtgctgaacatcgtgaatgtggtgtgccccctgcctgaggagcccgccttcttcggcctgtacttcctggtggtggccctgccctatgccaacagctgtgccaaccccatcctgtatggcttcctgagctaccgcttcaagcagggcttcagaagagtgctgctgcggcccagcagaagagtgcgcagccaggagcccaccgtgggccccccagagaagacagaggaggaggatgaggaggaggaggatggagaggagagccgggagggcggcaagggcaaggagatgaatggccgggtgtcccagatcacccagcccggcaccagcggccaggagcggccccccagccgggtggccagcaaggagcagcagctgctgccccaggaggccagcactggagagaagagcagcaccatgaggatctcctacctgtag

SEQ ID NO: 171110 - DNA, 1257 bp, Artificial Sequence; identical to SEQ ID NO: 171109
  Description of Artificial Sequence: Synthetic coding sequence

SEQ ID NO: 171111 - DNA, 1167 bp, Artificial Sequence
  Description of Artificial Sequence: Synthetic coding sequence
atgtctgcccccagcaccctgcccccaggaggagaggagggcctgggcacagcctggcccagcgctgccaatgccagcagcgccccagctgaggccgaggaggccgtggccggccctggagatgcccgggctgctggcatggtggccatccagtgcatctatgccctggtgtgcctggtgggcctggtgggcaatgccctggtgatcttcgtcatcctgcgctatgccaagatgaagacagccaccaacatctacctgctgaacctggccgtggctgatgagctgttcatgctgtctgtgccctttgtggccagcagcgctgccctgcggcactggcccttcggctctgtgctgtgcagagctgtgctgtctgtggatggcctgaacatgttcacctctgtgttctgcctgactgtgctgtctgtggacagatatgtggccgtggtgcaccccctgcgggccgccacctaccgccggcccagcgtggccaagctgatcaacctgggcgtgtggctggccagcctgctggtgaccctgcccatcgccatctttgctgacaccaggcctgcccggggcggccaggccgtggcctgcaacctgcagtggccccacccagcctggagcgctgtgtttgtggtgtacaccttcctgctgggcttcctgctgcctgtgctggccatcggcctgtgctacctgctgattgtgggcaagatgagagctgtggccctgcgggccggctggcagcagaggagaagaagtgagaagaagatcacccggctggtgctgatggtggtggtggtgtttgtgctgtgctggatgcccttctacgtggtgcagctgctgaacctgtttgtgaccagcctggatgccaccgtgaaccacgtgtccctcatcctgtcctatgccaacagctgtgccaaccccatcctgtatggcttcctgagtgacaacttccgccgcttcttccagagggtgctgtgcctgcgctgctgcctgctggagggcgctgggggcgctgaggaggagcccctggactactatgccacagccctgaagagcaagggcggggccggctgcatgtgcccccccctgccctgccagcaggaggccctgcagcctgagcccggcaggaagaggatccccctgaccaggaccaccaccttctag

SEQ ID NO: 171112 - DNA, 1095 bp, Artificial Sequence
  Description of Artificial Sequence: Synthetic coding sequence
atggagcccctcttccctgccagcacccccagctggaatgccagcagccctggagctgccagcggcggcggggacaacagaaccctggtgggccctgcccccagcgctggggcccgggctgtgctggtgcctgtgctgtacctgctggtgtgtgccgccggcctgggcggcaacaccctggtgatctacgtggtgctgcgctttgccaagatgaagacagtgaccaacatctacatcctgaacctggccgtggctgatgtgctgtacatgctgggcctgcccttcctggccacccagaatgctgccagcttctggccctttggacctgtgctgtgccgcctggtgatgaccctggatggagtgaaccagttcaccagcgtcttctgcctgactgtgatgtctgtggaccgctacctggccgtggtgcaccccctgagcagcgcccgctggaggcggccccgggtggccaagctggccagcgctgctgcctgggtgctgagcctgtgcatgagcctgcccctgctggtgtttgctgatgtgcaggagggcggcacctgcaatgcctcctggccagagcctgtgggcctgtggggcgctgtgttcatcatctacacagctgtgctgggcttctttgcccccctgctggtgatctgcctgtgctacctgctgattgtggtgaaggtgcgggctgctggggtgcgggtgggctgtgtgagaagaagaagtgagaggaaggtgaccaggatggtgctggtggtggtgctggtgtttgctggctgctggctgcccttcttcaccgtgaacatcgtgaacctggccgtggccctgccccaggagcccgccagcgctggcctgtacttctttgtggtgatcctgtcctatgccaacagctgtgccaaccctgtgctgtatggcttcctgagtgacaacttccggcagagcttccagaaggtgctgtgcctgaggaaaggaagtggggccaaggatgctgatgccacagagcccaggccagaccgcatccggcagcagcaggaggccaccccaccagcccacagagctgctgccaacggcctgatgcagaccagcaagctgtag

SEQ ID NO: 171113 - DNA, 1095 bp, Artificial Sequence; identical to SEQ ID NO: 171112
  Description of Artificial Sequence: Synthetic coding sequence

SEQ ID NO: 171114 - DNA, 822 bp, Artificial Sequence
  Description of Artificial Sequence: Synthetic coding sequence
atggagcccctcttccctgccagcacccccagctggaatgccagcagccctggagctgccagcggcggcggggacaacagaaccctggtgggccctgcccccagcgctggggcccgggctgtgctggtgcctgtgctgtacctgctggtgtgtgccgccggcctgggcggcaacaccctggtgatctacgtggtgctgcgctttgccaagatgaagacagtgaccaacatctacatcctgaacctggccgtggctgatgtgctgtacatgctgggcctgcccttcctggccacccagaatgctgccagcttctggccctttggacctgtgctgtgccgcctggtgatgaccctggatggagtgaaccagttcaccagcgtcttctgcctgactgtgatgtctgtggaccgctacctggccgtggtgcaccccctgagcagcgcccgctggaggcggccccgggtggccaagctggccagcgctgctgcctgggtgctgagcctgtgcatgagcctgcccctgctggtgtttgctgatgtgcaggagggcggcacctgcaatgcctcctggccagagcctgtgggcctgtggggcgctgtgttcatcatctacacagctgtgctgggcttctttgcccccctgctgcggggcagcggccgggctggagatgccaacggccggccctgggagagccggcggctgcccccacgcatcgtgctgcccccaccaccccagaccccagccttccctggggcccctggccctgagcggggcccccgggagccctgctggggcctgtggggcaccctggccctgctgtag

SEQ ID NO: 171115 - DNA, 6978 bp, Artificial Sequence
  Description of Artificial Sequence: Synthetic coding sequence
atggccaccaacatcgagcagatcttccgcagctttgtggtgtccaagttccgggagatccagcaggagctgagcagcggcagaaatgaaggccagctgaatggagagaccaacacccccatcgagggcaaccaggccggagatgctgctgccagcgcccggagcctgcccaatgaggagatcgtgcagaagattgaggaggtgctgagcggcgtgctggacacagagctgcgctacaagccagacctgaaggagggcagcaggaagagccgctgtgtgtctgtgcagacagaccccacagatgagatccccaccaagaagagcaagaagcacaagaagcacaagaacaagaagaagaagaagaagaaggagaaggagaagaagtacaagaggcagcctgaggagagcgagagcaagaccaagagccatgatgatggcaacatcgacctggagagtgacagcttcctgaagtttgacagcgagcccagcgctgtggccctggagctgcccacccgggccttcggccccagcgagaccaatgaatctccagctgtggtgctggagccccctgtggtgtccatggaggtgtctgagccccacatcctggagaccctgaagccagccaccaagacagctgagctgtctgtggtgtccaccagcgtcatcagcgagcagagcgagcagagcgtggccgtgatgcctgagcccagcatgaccaagatcctggacagctttgctgctgcccctgtgcccaccaccaccctggtgctgaagagcagcgagcctgtggtgaccatgtctgtggagtaccagatgaagtctgtgctgaagtctgtggagagcaccagccctgagcccagcaagatcatgctggtggagccccctgtggccaaggtgctggagcccagcgagaccctggtggtgagcagcgagacccccacagaggtgtacccagagcccagcaccagcaccaccatggacttccctgagagcagcgccatcgaggccctgcggctgcctgagcagcctgtggatgtgcccagcgagattgctgacagctccatgacccggccccaggagctgcctgagctgcccaagaccacagccctggagctgcaggagagctctgtggccagcgccatggagctgcccggccccccagccacctccatgcctgagctgcagggcccccctgtgacccctgtgctggagctgcccggccccagcgccacccctgtgcctgagctgcccggccccctgagcacccctgtgcctgagctgcccggccccccagccacagctgtgcctgagctgcccggccccagcgtgacccctgtgccccagctgagccaggagctgcccggcctgcctgcccccagcatgggcctggagcccccccaggaggtgcctgagccccctgtgatggcccaggagctgcccggcctgcccctggtgacagctgctgtggagctgcctgagcagcctgctgtgacagtggccatggagctgacagagcagcctgtgaccaccacagagctggagcagcctgtgggcatgaccaccgtggagcaccctggccaccctgaggtgaccacagccaccggcctgctgggccagcctgaggccaccatggtgctggagctgcccggccagcctgtggccaccacagccctggagctgcccggccagcccagcgtgactggagtgcctgagctgcccggcctgcccagcgccacccgggccctggagctgagcggccagcctgtggccactggagccctggagctgcccggccccctgatggctgctggggccctggagttcagcggccagagcggggctgctggggccctggagctgctgggccagcccctggccactggagtgctggagctgcccggccagcccggggcccctgagctgcccggccagcctgtggccaccgtggccctggagatctctgtgcagagcgtggtgaccaccagcgagctgagcaccatgacagtgtcccagagcctggaggtgcccagcaccacagccctggagagctacaacacagtggcccaggagctgcccaccaccctggtgggggagacctctgtgacagtgggcgtggaccccctgatggcccctgagagccacatcctggccagcaacaccatggagacccacatcctggccagcaacaccatggacagccagatgctggccagcaacaccatggacagccagatgctggccagcaacaccatggacagccagatgctggccagcagcaccatggacagccagatgctggccaccagctccatggacagccagatgctggccaccagctccatggacagccagatgctggccaccagcaccatggacagccagatgctggccaccagctccatggacagccagatgctggccaccagctccatggacagccagatgctggccaccagctccatggacagccagatgctggccaccagctccatggacagccagatgctggccaccagcaccatggacagccagatgctggccaccagcaccatggacagccagatgctggccaccagctccatggacagccagatgctggccagcggcaccatggacagccagatgctggccagcggcaccatggatgcccagatgctggccagcggcaccatggatgcccagatgctggccagcagcacccaggacagcgccatgctgggcagcaagagcccagacccctaccgcctggcccaggacccctaccgcctggcccaggacccctaccgcctgggccatgacccctaccgcctgggccatgatgcctaccgcctgggccaggacccctaccgcctgggccatgacccctaccgcctgaccccagacccctacaggatgagcccccggccctaccgcatcgcccccaggagctacagaattgccccccggccctaccgcctggccccccggcccctgatgctggccagccgccgctccatgatgatgtcctatgctgctgagaggtccatgatgagcagctatgaaagatccatgatgtcctatgaaagatccatgatgagccccatggccgagaggtccatgatgtctgcctatgaaagatccatgatgtctgcctatgaaagatccatgatgagccccatggccgagaggtccatgatgtctgcctatgaaagatccatgatgtctgcctatgaaagatccatgatgagccccatggctgaccgctccatgatgtccatgggcgctgaccgctccatgatgagcagctacagcgctgctgaccgctccatgatgagcagctacagcgctgctgaccgctccatgatgagcagctacacagctgaccgctccatgatgtccatggctgctgacagctacacagacagctacacagacacctacacagaggcctacatggtgccccccctgcccccagaggagccccccaccatgccacccctgcccccagaggagccccccatgaccccacccctgcccccagaggagcccccagagggccctgccctgcccacagagcagagcgccctgacagctgagaacacctggcccacagaggtgcccagcagccccagcgaggagagcgtgtcccagcctgagccccctgtgtcccagagcgagatcagcgagcccagcgctgtgcccacagactacagcgtgtctgccagtgaccccagcgtgctggtgtctgaggccgctgtgacagtgcctgagcccccacctgagcctgagagcagcatcaccctgacccctgtggagagcgctgtggtggccgaggagcacgaggtggtgcctgagaggcctgtgacctgcatggtgtctgagaccccagccatgtctgctgagcccaccgtgctggccagcgagccccctgtgatgtctgaaacagctgagacctttgacagcatgagggccagcggccacgtggccagcgaggtgtccaccagcctgctggtgcctgctgtgaccacccctgtgctggccgagagcatcctggagcccccagccatggccgcccctgagagcagcgccatggctgtgctggagagcagcgctgtgacagtgctggagagcagcacagtgacagtgctggagagcagcacagtgacagtgctggagcccagcgtggtgacagtgcctgagccccctgtggtggccgagccagactatgtgaccatccctgtgcctgtggtgtctgccctggagcccagcgtgcctgtgctggagcctgctgtgtctgtgctgcagcccagcatgattgtgtctgagcccagcgtgtctgtgcaggagagcacagtgacagtgtctgagcctgctgtgacagtgtctgagcagacccaggtgatccccacagaggtggccatcgagagcacccccatgatcctggagagcagcatcatgagcagccacgtgatgaagggcatcaacctgagcagcggggaccagaacctggcccctgagatcggcatgcaggagatcgccctgcacagcggggaggagccccatgctgaggagcacctgaagggggacttctatgagagcgagcacggcatcaacatcgacctgaacatcaacaaccacctgattgccaaggagatggagcacaacacagtgtgtgccgccggcaccagccctgtgggggagattggagaggagaagatcctgcccaccagcgagaccaagcagaggacagtgctggacacctacccaggagtgtctgaggctgatgctggggagaccctgagcagcacaggcccctttgccctggagccagatgccaccggcaccagcaagggcatcgagttcaccacagccagcaccctgagcctggtgaacaagtatgatgtggacctgagcctgaccacccaggacacagaacatgacatggtgatcagcaccagccccagcggcggcagcgaggccgacatcgagggccccctgcctgccaaggacatccacctggacctgcccagcaacaacaacctggtgtccaaggacacagaggagcccctgcctgtgaaggagagtgaccagaccctggccgccctgctgagccccaaggagagcagcggcggggagaaggaggtgcccccaccacccaaggagaccctgcctgattctggcttcagcgccaacatcgaggacatcaatgaagctgacctggtgcggcccctgctgcccaaggacatggagcggctgaccagcctgcgggccggcatcgagggccccctgctggccagtgatgtgggccgggacagatctgctgccagccctgtggtgtcctccatgcctgagcgggccagcgagagcagcagcgaggagaaggatgattatgagatctttgtgaaggtgaaggacacccatgagaagagcaagaagaacaagaacagagacaagggggagaaggagaagaagagggacagcagcctgcggagccgcagcaagaggagcaagagcagcgagcacaagagcaggaagaggaccagcgagagccgcagccgggccaggaagaggagcagcaagagcaagagccacaggagccagaccaggagccgcagccgcagcagaagaagaagaagaagcagccgcagccgcagcaagagccggggcagaagatctgtgtccaaggagaagaggaagaggagccccaagcacaggagcaagagccgggagaggaagaggaagaggagcagcagccgggacaacaggaagacagtgcgggcccggagcaggacccccagcagaagaagccgcagccacacccccagcagaagaagaagaagccgctctgtgggcagaagaagaagcttcagcatcagccccagcagaagaagcaggacccccagccgccgcagcaggacccccagcagaagaagcaggacccccagccgccgcagcaggacccccagcagaagaagcaggacccccagccgccgcagcaggacccccagcagaagaagaagaagccgctctgtggtgagaagaagaagcttcagcatcagccctgtgcggctgcggcgcagcaggacccccctgcggcggcgcttcagccgcagccccatccggaggaagaggagccgcagcagcgagcggggccgcagccccaagaggctgacagacctggacaaggcccagctgctggagatcgccaaggccaatgctgctgccatgtgtgccaaggccggcgtgcccctgccccccaacctgaagccagcccccccacccaccatcgaggagaaggtggccaagaagtctggaggagccaccatcgaggagctgacagagaagtgcaagcagatcgcccagagcaaagaagatgatgatgtgattgtgaacaagccccacgtgtctgatgaggaggaggaggagccccccttctaccaccaccccttcaagctgtctgagcccaagcccatcttcttcaacctgaacattgctgctgccaagcccaccccacccaagagccaggtgaccctgaccaaggagttccctgtgagcagcggcagccagcacaggaagaaggaggccgacagcgtgtatggagagtgggtgcctgtggagaagaatggagaggagaacaaggatgatgacaacgtgttcagcagcaacctgcccagcgagcctgtggacatcagcacagccatgtctgagcgggccctggcccagaagaggctgtctgaaaatgcctttgacctggaggccatgtccatgctgaacagagcccaggagagaattgatgcctgggcccagctgaacagcatccctggccagttcaccggcagcactggagtgcaggtgctgacccaggagcagctggccaacacaggagcccaggcctggatcaagaagggccagatcctggtggccgtgttcctgcccaggtctgtgcctgctgtgctcttcaccaccctgctgctgccccggccccgcatcagcagctag

SEQ ID NO: 171116 - DNA, 6912 bp, Artificial Sequence
  Description of Artificial Sequence: Synthetic coding sequence
atggccaccaacatcgagcagatcttccgcagctttgtggtgtccaagttccgggagatccagcaggagctgagcagcggcagaaatgaaggccagctgaatggagagaccaacacccccatcgagggcaaccaggccggagatgctgctgccagcgcccggagcctgcccaatgaggagatcgtgcagaagattgaggaggtgctgagcggcgtgctggacacagagctgcgctacaagccagacctgaaggagggcagcaggaagagccgctgtgtgtctgtgcagacagaccccacagatgagatccccaccaagaagagcaagaagcacaagaagcacaagaacaagaagaagaagaagaagaaggagaaggagaagaagtacaagaggcagcctgaggagagcgagagcaagaccaagagccatgatgatggcaacatcgacctggagagtgacagcttcctgaagtttgacagcgagcccagcgctgtggccctggagctgcccacccgggccttcggccccagcgagaccaatgaatctccagctgtggtgctggagccccctgtggtgtccatggaggtgtctgagccccacatcctggagaccctgaagccagccaccaagacagctgagctgtctgtggtgtccaccagcgtcatcagcgagcagagcgagcagagcgtggccgtgatgcctgagcccagcatgaccaagatcctggacagctttgctgctgcccctgtgcccaccaccaccctggtgctgaagagcagcgagcctgtggtgaccatgtctgtggagtaccagatgaagtctgtgctgaagtctgtggagagcaccagccctgagcccagcaagatcatgctggtggagccccctgtggccaaggtgctggagcccagcgagaccctggtggtgagcagcgagacccccacagaggtgtacccagagcccagcaccagcaccaccatggacttccctgagagcagcgccatcgaggccctgcggctgcctgagcagcctgtggatgtgcccagcgagattgctgacagctccatgacccggccccaggagctgcctgagctgcccaagaccacagccctggagctgcaggagagctctgtggccagcgccatggagctgcccggccccccagccacctccatgcctgagctgcagggcccccctgtgacccctgtgctggagctgcccggccccagcgccacccctgtgcctgagctgcccggccccctgagcacccctgtgcctgagctgcccggccccccagccacagctgtgcctgagctgcccggccccagcgtgacccctgtgccccagctgagccaggagctgcccggcctgcctgcccccagcatgggcctggagcccccccaggaggtgcctgagccccctgtgatggcccaggagctgcccggcctgcccctggtgacagctgctgtggagctgcctgagcagcctgctgtgacagtggccatggagctgacagagcagcctgtgaccaccacagagctggagcagcctgtgggcatgaccaccgtggagcaccctggccaccctgaggtgaccacagccaccggcctgctgggccagcctgaggccaccatggtgctggagctgcccggccagcctgtggccaccacagccctggagctgcccggccagcccagcgtgactggagtgcctgagctgcccggcctgcccagcgccacccgggccctggagctgagcggccagcctgtggccactggagccctggagctgcccggccccctgatggctgctggggccctggagttcagcggccagagcggggctgctggggccctggagctgctgggccagcccctggccactggagtgctggagctgcccggccagcccggggcccctgagctgcccggccagcctgtggccaccgtggccctggagatctctgtgcagagcgtggtgaccaccagcgagctgagcaccatgacagtgtcccagagcctggaggtgcccagcaccacagccctggagagctacaacacagtggcccaggagctgcccaccaccctggtgggggagacctctgtgacagtgggcgtggaccccctgatggcccctgagagccacatcctggccagcaacaccatggagacccacatcctggccagcaacaccatggacagccagatgctggccagcaacaccatggacagccagatgctggccagcaacaccatggacagccagatgctggccagcagcaccatggacagccagatgctggccaccagctccatggacagccagatgctggccaccagctccatggacagccagatgctggccaccagcaccatggacagccagatgctggccaccagctccatggacagccagatgctggccaccagctccatggacagccagatgctggccaccagctccatggacagccagatgctggccaccagctccatggacagccagatgctggccaccagcaccatggacagccagatgctggccaccagcaccatggacagccagatgctggccaccagctccatggacagccagatgctggccagcggcaccatggacagccagatgctggccagcggcaccatggatgcccagatgctggccagcggcaccatggatgcccagatgctggccagcagcacccaggacagcgccatgctgggcagcaagagcccagacccctaccgcctggcccaggacccctaccgcctggcccaggacccctaccgcctgggccatgacccctaccgcctgggccatgatgcctaccgcctgggccaggacccctaccgcctgggccatgacccctaccgcctgaccccagacccctacaggatgagcccccggccctaccgcatcgcccccaggagctacagaattgccccccggccctaccgcctggccccccggcccctgatgctggccagccgccgctccatgatgatgtcctatgctgctgagaggtccatgatgagcagctatgaaagatccatgatgtcctatgaaagatccatgatgagccccatggccgagaggtccatgatgtctgcctatgaaagatccatgatgtctgcctatgaaagatccatgatgagccccatggccgagaggtccatgatgtctgcctatgaaagatccatgatgtctgcctatgaaagatccatgatgagccccatggctgaccgctccatgatgtccatgggcgctgaccgctccatgatgagcagctacagcgctgctgaccgctccatgatgagcagctacagcgctgctgaccgctccatgatgagcagctacacagctgaccgctccatgatgtccatggctgctgacagctacacagacagctacacagacacctacacagaggcctacatggtgccccccctgcccccagaggagccccccaccatgccacccctgcccccagaggagccccccatgaccccacccctgcccccagaggagcccccagagggccctgccctgcccacagagcagagcgccctgacagctgagaacacctggcccacagaggtgcccagcagccccagcgaggagagcgtgtcccagcctgagccccctgtgtcccagagcgagatcagcgagcccagcgctgtgcccacagactacagcgtgtctgccagtgaccccagcgtgctggtgtctgaggccgctgtgacagtgcctgagcccccacctgagcctgagagcagcatcaccctgacccctgtggagagcgctgtggtggccgaggagcacgaggtggtgcctgagaggcctgtgacctgcatggtgtctgagaccccagccatgtctgctgagcccaccgtgctggccagcgagccccctgtgatgtctgaaacagctgagacctttgacagcatgagggccagcggccacgtggccagcgaggtgtccaccagcctgctggtgcctgctgtgaccacccctgtgctggccgagagcatcctggagcccccagccatggccgcccctgagagcagcgccatggctgtgctggagagcagcgctgtgacagtgctggagagcagcacagtgacagtgctggagagcagcacagtgacagtgctggagcccagcgtggtgacagtgcctgagccccctgtggtggccgagccagactatgtgaccatccctgtgcctgtggtgtctgccctggagcccagcgtgcctgtgctggagcctgctgtgtctgtgctgcagcccagcatgattgtgtctgagcccagcgtgtctgtgcaggagagcacagtgacagtgtctgagcctgctgtgacagtgtctgagcagacccaggtgatccccacagaggtggccatcgagagcacccccatgatcctggagagcagcatcatgagcagccacgtgatgaagggcatcaacctgagcagcggggaccagaacctggcccctgagatcggcatgcaggagatcgccctgcacagcggggaggagccccatgctgaggagcacctgaagggggacttctatgagagcgagcacggcatcaacatcgacctgaacatcaacaaccacctgattgccaaggagatggagcacaacacagtgtgtgccgccggcaccagccctgtgggggagattggagaggagaagatcctgcccaccagcgagaccaagcagaggacagtgctggacacctacccaggagtgtctgaggctgatgctggggagaccctgagcagcacaggcccctttgccctggagccagatgccaccggcaccagcaagggcatcgagttcaccacagccagcaccctgagcctggtgaacaagtatgatgtggacctgagcctgaccacccaggacacagaacatgacatggtgatcagcaccagccccagcggcggcagcgaggccgacatcgagggccccctgcctgccaaggacatccacctggacctgcccagcaacaacaacctggtgtccaaggacacagaggagcccctgcctgtgaaggagagtgaccagaccctggccgccctgctgagccccaaggagagcagcggcggggagaaggaggtgcccccaccacccaaggagaccctgcctgattctggcttcagcgccaacatcgaggacatcaatgaagctgacctggtgcggcccctgctgcccaaggacatggagcggctgaccagcctgcgggccggcatcgagggccccctgctggccagtgatgtgggccgggacagatctgctgccagccctgtggtgtcctccatgcctgagcgggccagcgagagcagcagcgaggagaaggatgattatgagatctttgtgaaggtgaaggacacccatgagaagagcaagaagaacaagaacagagacaagggggagaaggagaagaagagggacagcagcctgcggagccgcagcaagaggagcaagagcagcgagcacaagagcaggaagaggaccagcgagagccgcagccgggccaggaagaggagcagcaagagcaagagccacaggagccagaccaggagccgcagccgcagcagaagaagaagaagaagcagccgcagccgcagcaagagccggggcagaagatctgtgtccaaggagaagaggaagaggagccccaagcacaggagcaagagccgggagaggaagaggaagaggagcagcagccgggacaacaggaagacagtgcgggcccggagcaggacccccagcagaagaagccgcagccacacccccagcagaagaagaagaagccgctctgtgggcagaagaagaagcttcagcatcagccccagcagaagaagcaggacccccagccgccgcagcaggacccccagcagaagaagcaggacccccagccgccgcagcaggacccccagcagaagaagcaggacccccagccgccgcagcaggacccccagcagaagaagaagaagccgctctgtggtgagaagaagaagcttcagcatcagccctgtgcggctgcggcgcagcaggacccccctgcggcggcgcttcagccgcagccccatccggaggaagaggagccgcagcagcgagcggggccgcagccccaagaggctgacagacctggacaaggcccagctgctggagatcgccaaggccaatgctgctgccatgtgtgccaaggccggcgtgcccctgccccccaacctgaagccagcccccccacccaccatcgaggagaaggtggccaagaagtctggaggagccaccatcgaggagctgacagagaagtgcaagcagatcgcccagagcaaagaagatgatgatgtgattgtgaacaagccccacgtgtctgatgaggaggaggaggagccccccttctaccaccaccccttcaagctgtctgagcccaagcccatcttcttcaacctgaacattgctgctgccaagcccaccccacccaagagccaggtgaccctgaccaaggagttccctgtgagcagcggcagccagcacaggaagaaggaggccgacagcgtgtatggagagtgggtgcctgtggagaagaatggagaggagaacaaggatgatgacaacgtgttcagcagcaacctgcccagcgagggccgggtgaagaggcagggccgggtgcggcggcagatgaagcagcctgctgccagccacctgactgtgacccgctgcaacagcctgtgtggcaccaagccccagagcgagaagcacagaattgctgagaacagcgtcatcaccagcctgcccaacatcggccccagcctgcacctgtgggagggcagcccccgctacaactacctggccagcagatttgccagccggctgtacagcagccgcttctggtggtag

SEQ ID NO: 171117 - DNA, 7281 bp, Artificial Sequence
  Description of Artificial Sequence: Synthetic coding sequence
atggccaccaacatcgagcagatcttccgcagctttgtggtgtccaagttccgggagatccagcaggagctgagcagcggcagaaatgaaggccagctgaatggagagaccaacacccccatcgagggcaaccaggccggagatgctgctgccagcgcccggagcctgcccaatgaggagatcgtgcagaagattgaggaggtgctgagcggcgtgctggacacagagctgcgctacaagccagacctgaaggagggcagcaggaagagccgctgtgtgtctgtgcagacagaccccacagatgagatccccaccaagaagagcaagaagcacaagaagcacaagaacaagaagaagaagaagaagaaggagaaggagaagaagtacaagaggcagcctgaggagagcgagagcaagaccaagagccatgatgatggcaacatcgacctggagagtgacagcttcctgaagtttgacagcgagcccagcgctgtggccctggagctgcccacccgggccttcggccccagcgagaccaatgaatctccagctgtggtgctggagccccctgtggtgtccatggaggtgtctgagccccacatcctggagaccctgaagccagccaccaagacagctgagctgtctgtggtgtccaccagcgtcatcagcgagcagagcgagcagagcgtggccgtgatgcctgagcccagcatgaccaagatcctggacagctttgctgctgcccctgtgcccaccaccaccctggtgctgaagagcagcgagcctgtggtgaccatgtctgtggagtaccagatgaagtctgtgctgaagtctgtggagagcaccagccctgagcccagcaagatcatgctggtggagccccctgtggccaaggtgctggagcccagcgagaccctggtggtgagcagcgagacccccacagaggtgtacccagagcccagcaccagcaccaccatggacttccctgagagcagcgccatcgaggccctgcggctgcctgagcagcctgtggatgtgcccagcgagattgctgacagctccatgacccggccccaggagctgcctgagctgcccaagaccacagccctggagctgcaggagagctctgtggccagcgccatggagctgcccggccccccagccacctccatgcctgagctgcagggcccccctgtgacccctgtgctggagctgcccggccccagcgccacccctgtgcctgagctgcccggccccctgagcacccctgtgcctgagctgcccggccccccagccacagctgtgcctgagctgcccggccccagcgtgacccctgtgccccagctgagccaggagctgcccggcctgcctgcccccagcatgggcctggagcccccccaggaggtgcctgagccccctgtgatggcccaggagctgcccggcctgcccctggtgacagctgctgtggagctgcctgagcagcctgctgtgacagtggccatggagctgacagagcagcctgtgaccaccacagagctggagcagcctgtgggcatgaccaccgtggagcaccctggccaccctgaggtgaccacagccaccggcctgctgggccagcctgaggccaccatggtgctggagctgcccggccagcctgtggccaccacagccctggagctgcccggccagcccagcgtgactggagtgcctgagctgcccggcctgcccagcgccacccgggccctggagctgagcggccagcctgtggccactggagccctggagctgcccggccccctgatggctgctggggccctggagttcagcggccagagcggggctgctggggccctggagctgctgggccagcccctggccactggagtgctggagctgcccggccagcccggggcccctgagctgcccggccagcctgtggccaccgtggccctggagatctctgtgcagagcgtggtgaccaccagcgagctgagcaccatgacagtgtcccagagcctggaggtgcccagcaccacagccctggagagctacaacacagtggcccaggagctgcccaccaccctggtgggggagacctctgtgacagtgggcgtggaccccctgatggcccctgagagccacatcctggccagcaacaccatggagacccacatcctggccagcaacaccatggacagccagatgctggccagcaacaccatggacagccagatgctggccagcaacaccatggacagccagatgctggccagcagcaccatggacagccagatgctggccaccagctccatggacagccagatgctggccaccagctccatggacagccagatgctggccaccagcaccatggacagccagatgctggccaccagctccatggacagccagatgctggccaccagctccatggacagccagatgctggccaccagctccatggacagccagatgctggccaccagctccatggacagccagatgctggccaccagcaccatggacagccagatgctggccaccagcaccatggacagccagatgctggccaccagctccatggacagccagatgctggccagcggcaccatggacagccagatgctggccagcggcaccatggatgcccagatgctggccagcggcaccatggatgcccagatgctggccagcagcacccaggacagcgccatgctgggcagcaagagcccagacccctaccgcctggcccaggacccctaccgcctggcccaggacccctaccgcctgggccatgacccctaccgcctgggccatgatgcctaccgcctgggccaggacccctaccgcctgggccatgacccctaccgcctgaccccagacccctacaggatgagcccccggccctaccgcatcgcccccaggagctacagaattgccccccggccctaccgcctggccccccggcccctgatgctggccagccgccgctccatgatgatgtcctatgctgctgagaggtccatgatgagcagctatgaaagatccatgatgtcctatgaaagatccatgatgagccccatggccgagaggtccatgatgtctgcctatgaaagatccatgatgtctgcctatgaaagatccatgatgagccccatggccgagaggtccatgatgtctgcctatgaaagatccatgatgtctgcctatgaaagatccatgatgagccccatggctgaccgctccatgatgtccatgggcgctgaccgctccatgatgagcagctacagcgctgctgaccgctccatgatgagcagctacagcgctgctgaccgctccatgatgagcagctacacagctgaccgctccatgatgtccatggctgctgacagctacacagacagctacacagacacctacacagaggcctacatggtgccccccctgcccccagaggagccccccaccatgccacccctgcccccagaggagccccccatgaccccacccctgcccccagaggagcccccagagggccctgccctgcccacagagcagagcgccctgacagctgagaacacctggcccacagaggtgcccagcagccccagcgaggagagcgtgtcccagcctgagccccctgtgtcccagagcgagatcagcgagcccagcgctgtgcccacagactacagcgtgtctgccagtgaccccagcgtgctggtgtctgaggccgctgtgacagtgcctgagcccccacctgagcctgagagcagcatcaccctgacccctgtggagagcgctgtggtggccgaggagcacgaggtggtgcctgagaggcctgtgacctgcatggtgtctgagaccccagccatgtctgctgagcccaccgtgctggccagcgagccccctgtgatgtctgaaacagctgagacctttgacagcatgagggccagcggccacgtggccagcgaggtgtccaccagcctgctggtgcctgctgtgaccacccctgtgctggccgagagcatcctggagcccccagccatggccgcccctgagagcagcgccatggctgtgctggagagcagcgctgtgacagtgctggagagcagcacagtgacagtgctggagagcagcacagtgacagtgctggagcccagcgtggtgacagtgcctgagccccctgtggtggccgagccagactatgtgaccatccctgtgcctgtggtgtctgccctggagcccagcgtgcctgtgctggagcctgctgtgtctgtgctgcagcccagcatgattgtgtctgagcccagcgtgtctgtgcaggagagcacagtgacagtgtctgagcctgctgtgacagtgtctgagcagacccaggtgatccccacagaggtggccatcgagagcacccccatgatcctggagagcagcatcatgagcagccacgtgatgaagggcatcaacctgagcagcggggaccagaacctggcccctgagatcggcatgcaggagatcgccctgcacagcggggaggagccccatgctgaggagcacctgaagggggacttctatgagagcgagcacggcatcaacatcgacctgaacatcaacaaccacctgattgccaaggagatggagcacaacacagtgtgtgccgccggcaccagccctgtgggggagattggagaggagaagatcctgcccaccagcgagaccaagcagaggacagtgctggacacctacccaggagtgtctgaggctgatgctggggagaccctgagcagcacaggcccctttgccctggagccagatgccaccggcaccagcaagggcatcgagttcaccacagccagcaccctgagcctggtgaacaagtatgatgtggacctgagcctgaccacccaggacacagaacatgacatggtgatcagcaccagccccagcggcggcagcgaggccgacatcgagggccccctgcctgccaaggacatccacctggacctgcccagcaacaacaacctggtgtccaaggacacagaggagcccctgcctgtgaaggagagtgaccagaccctggccgccctgctgagccccaaggagagcagcggcggggagaaggaggtgcccccaccacccaaggagaccctgcctgattctggcttcagcgccaacatcgaggacatcaatgaagctgacctggtgcggcccctgctgcccaaggacatggagcggctgaccagcctgcgggccggcatcgagggccccctgctggccagtgatgtgggccgggacagatctgctgccagccctgtggtgtcctccatgcctgagcgggccagcgagagcagcagcgaggagaaggatgattatgagatctttgtgaaggtgaaggacacccatgagaagagcaagaagaacaagaacagagacaagggggagaaggagaagaagagggacagcagcctgcggagccgcagcaagaggagcaagagcagcgagcacaagagcaggaagaggaccagcgagagccgcagccgggccaggaagaggagcagcaagagcaagagccacaggagccagaccaggagccgcagccgcagcagaagaagaagaagaagcagccgcagccgcagcaagagccggggcagaagatctgtgtccaaggagaagaggaagaggagccccaagcacaggagcaagagccgggagaggaagaggaagaggagcagcagccgggacaacaggaagacagtgcgggcccggagcaggacccccagcagaagaagccgcagccacacccccagcagaagaagaagaagccgctctgtgggcagaagaagaagcttcagcatcagccccagcagaagaagcaggacccccagccgccgcagcaggacccccagcagaagaagcaggacccccagccgccgcagcaggacccccagcagaagaagcaggacccccagccgccgcagcaggacccccagcagaagaagaagaagccgctctgtggtgagaagaagaagcttcagcatcagccctgtgcggctgcggcgcagcaggacccccctgcggcggcgcttcagccgcagccccatccggaggaagaggagccgcagcagcgagcggggccgcagccccaagaggctgacagacctggacaaggcccagctgctggagatcgccaaggccaatgctgctgccatgtgtgccaaggccggcgtgcccctgccccccaacctgaagccagcccccccacccaccatcgaggagaaggtggccaagaagtctggaggagccaccatcgaggagctgacagagaagtgcaagcagatcgcccagagcaaagaagatgatgatgtgattgtgaacaagccccacgtgtctgatgaggaggaggaggagccccccttctaccaccaccccttcaagctgtctgagcccaagcccatcttcttcaacctgaacattgctgctgccaagcccaccccacccaagagccaggtgaccctgaccaaggagttccctgtgagcagcggcagccagcacaggaagaaggaggccgacagcgtgtatggagagtgggtgcctgtggagaagaatggagaggagaacaaggatgatgacaacgtgttcagcagcaacctgcccagcgagcctgtggacatcagcacagccatgtctgagcgggccctggcccagaagaggctgtctgaaaatgcctttgacctggaggccatgtccatgctgaacagagcccaggagagaattgatgcctgggcccagctgaacagcatccctggccagttcaccggcagcactggagtgcaggtgctgacccaggagcagctggccaacacaggagcccaggcctggatcaagaaggaccagttcctgcgggccgcccctgtgactggaggcatgggcgctgtgctgatgaggaagatgggctggagggagggggagggcctgggcaagaacaaggagggcaacaaggagcccatcctggtggacttcaagacagacaggaagggcctggtggccgtgggggagcgggcccagaagaggagcggcaacttctctgctgccatgaaggacctgagcggcaagcaccctgtgtctgccctgatggagatctgcaacaagaggcgctggcagcccccagagttcctgctggtgcatgacagcggccctgaccacaggaagcacttcctgttccgggtgctgagaaatggagccctgacccggcccaactgcatgttcttcctgaaccgctactag

SEQ ID NO: 171118 - DNA, 1584 bp, Artificial Sequence
  Description of Artificial Sequence: Synthetic coding sequence
atggcccctgagcggctgcggagccgggccctgagcgccttcaagctgcggggcctgctgctgcggggggaggccatcaagtacctgacagaggccctgcagagcatcagcgagctggagctggaggacaagctggagaagatcatcaatgctgtggagaagcagcccctgagcagcaacatgattgaaagatctgtggtggaggccgctgtgcaggagtgcagccagagcgtggatgagaccatcgagcacgtgttcaacatcattggagcctttgacatccccaggtttgtgtacaacagcgagaggaagaagttcctgcccctgctgatgaccaaccacccagcccccaacctgtttggcaccccccgggacaaggccgagatgttccgggagcgctacaccatcctgcaccagaggacccacagacatgagctgttcaccccacctgtgattggcagccacccagatgaaagtggcagcaagttccagctgaagaccatcgagaccctgctgggcagcaccaccaagattggagatgccatcgtgctgggcatgatcacccagctgaaggagggcaagttcttcctggaggaccccactggaacagtgcagctggacctgagcaaggcccagttccacagcggcctgtacacagaggcctgctttgtgctggccgagggctggtttgaggaccaggtgttccacgtgaatgccttcggcttccccccaacagagcccagcagcaccacccgggcctactacggcaacatcaacttctttggaggccccagcaacacctctgtgaagaccagcgccaagctgaagcagctggaggaggagaacaaggatgccatgtttgtgttcctgagtgatgtgtggctggaccaggtggaggtgctggagaagctgcgcatcatgtttgctggctacagccctgccccacccacctgcttcatcctgtgtggcaacttcagcagcgccccctacggcaagaaccaggtgcaggccctgaaggacagcctgaagaccctggccgacatcatctgtgagtacccagacatccaccagagcagcagatttgtgtttgtgcccggccctgaggaccccggcttcggcagcatcctgcccaggcctcccctggccgagagcatcaccaatgagttccggcagagggtgcccttcagcgtcttcaccaccaacccctgccgcatccagtactgcacccaggagatcaccgtcttccgggaggacctggtgaacaagatgtgcaggaactgtgtgcgcttccccagcagcaacctggccatccccaaccactttgtgaagaccatcctgagccagggccacctgacccccctgcccctgtatgtgtgccctgtgtactgggcctatgactatgccctgcgggtgtaccctgtgcctgacctgctggtgattgctgacaagtatgaccccttcaccaccaccaacacagaatgtctgtgcatcaaccctggcagcttccccaggagcggcttctccttcaaggtgttctaccccagcaacaagacagtggaggacagcaagctgcagggcttctag

SEQ ID NO: 171119 - DNA, 3900 bp, Artificial Sequence
  Description of Artificial Sequence: Synthetic coding sequence
atgcagcaggccccccagccctatgagttcttcagcgaggagaacagccccaagtggaggggcctgctggtgtctgccctgaggaaggtgcaggagcaggtgcaccccaccctgagcgccaatgaggagagcctgtactacatcgaggagctgatcttccagctgctgaacaagctgtgcatggcccagcccaggacagtgcaggatgtggaggagcgggtgcagaagaccttcccccaccccatcgacaagtgggccatcgcagatgcccagagcgccatcgagaagaggaagagaagaaaccccctgctgctgcctgtggacaagatccaccccagcctgaaggaggtgctgggctacaaggtggactaccacgtgtccctgtacatcgtggccgtgctggagtacatctctgctgacatcctgaagctggccggcaactacgtgttcaacatccgccactatgagatcagccagcaggacatcaaggtgtccatgtgtgccgacaaggtgctgatggacatgtttgaccaggatgacatcggcctggtgtccctgtgtgaagatgagcccagcagcagcggggagctgaactactatgacctggtgaggacagaaattgctgaggagcggcagtacctgcgggagctgaacatgatcatcaaggtgttccgggaggccttcctgagtgacaggaagctgttcaagcccagcgacatcgagaagatcttcagcaacatcagtgacatccacgagctgactgtgaagctgctgggcctgattgaggacacagtggagatgacagatgagagcagcccccaccccctggccggcagctgctttgaggacctggccgaggagcaggcctttgacccctatgagaccctgagccaggacatcctgagccctgagttccacgagcacttcaacaagctgatggcccggcctgctgtggccctgcacttccagcagctgaaggcctgcagcgaggagcaggaggaccgggagtgcctgaaccaggccatcacagccctgatgaacctgcagggctccatggaccgcatctacaagcagtacagccccaggagaagacctggggaccctgtgtgccccttctacagccaccagctgcggagcaagcacctggccatcaagaagatgaatgagatccagaagaacattgatggctgggagggcaaggacatcggccagtgctgcaatgagttcatcatggagggccccctgacccgcatcggggccaagcatgagcggcacatcttcctgtttgatggcctgatgatcagctgcaagcccaaccacggccagacccggctgcccggctacagcagcgctgagtaccgcctgaaggagaagtttgtgatgaggaagatccagatctgtgacaaggaggacacctgtgagcacaagcacgcctttgagctggtgtccaaggatgagaacagcatcatctttgctgccaagtctgctgaggagaagaacaactggatggccgccctgatcagcctgcactaccgcagcaccctggacaggatgctggacagcgtgctgctgaaggaggagaatgagcagcccctgcggctgcccagccctgaggtgtacagatttgtggtgaaggacagtgaagaaaatattgtgtttgaggacaacctgcagagccgcagcggcatccccatcatcaagggcggcaccgtggtgaagctgattgagcggctgacctaccacatgtatgctgaccccaactttgtgaggaccttcctgaccacctaccgctccttctgcaagccccaggagctgctgagcctgctgattgaaagatttgagatccctgagcctgagcccacagatgctgacaagctggccatcgagaagggggagcagcccatctctgctgacctgaagcgcttcaggaaggagtatgtgcagcctgtgcagctgcgcatcctgaatgtgttccgccactgggtggagcaccacttctatgactttgagcgggacctggagctgctggagcggctggagagcttcatcagctctgtgcggggcaaggccatgaagaagtgggtggagagcatcgccaagatcatccggaggaagaagcaggcccaggccaatggagtgagccacaacatcacctttgagagccccccaccacccatcgagtggcacatcagcaagccaggccagtttgagacctttgacctgatgaccctgcaccccattgaaattgcccggcagctgaccctgctggagagtgacctgtacaggaaggtgcagcccagcgagctggtgggctctgtgtggaccaaggaggacaaggagatcaacagccccaacctgctgaagatgatccgccacaccaccaacctgaccctgtggtttgagaagtgcatcgtggaggccgagaactttgaggagcgggtggccgtgctgagccgcatcatcgagatcctgcaggtgttccaggacctgaacaacttcaacggggtgctggagatcgtgtctgctgtgaacagcgtgtctgtgtaccgcctggaccacacctttgaggccctgcaggagaggaagaggaagatcctggatgaagctgtggagctgagccaggaccacttcaagaagtacctggtgaagctgaagagcatcaaccccccctgtgtgcccttcttcggcatctacctgaccaacatcctgaagacagaggagggcaacaatgacttcctgaagaagaagggcaaggacctgatcaacttcagcaagaggaggaaggtggccgagatcactggagagatccagcagtaccagaaccagccctactgcctgcgcatcgagccagacatgaggcgcttctttgagaacctgaaccccatgggcagcgccagcgagaaggagttcacagactacctgttcaacaagagcctggagattgagcccaggaactgcaagcagcccccacgcttccccaggaagagcaccttcagcctgaagagccctggcatccggcccaacacaggccgccacggcagcaccagcggcaccctgcggggccaccccacccccctggagcgggagccctgcaagatctccttcagcagaattgctgagacagagctggagagcacagtgtctgcccccaccagccccaacacccccagcaccccacctgtgtctgccagcagtgacctgagcgtcttcctggatgtggacctgaacagcagctgtggcagcaacagcatctttgcccctgtgctgctgccccacagcaagagcttcttcagcagctgtggcagcctgcacaagctgtctgaggagcccctcatccccccacccctgccccccaggaagaagtttgaccatgatgccagcaacagcaagggcaacatgaagagtgatgatgatcctccagccatccccccccggcagcccccaccacccaaggtgaagccccgggtgcctgtgcccaccggggcctttgatggccccctgcacagccccccacctcctccaccccgggaccccctgcctgacaccccacctcctgtgcccctgcggcccccagagcacttcatcaactgccccttcaacctgcagcccccacccctgggccacctgcaccgggacagcgactggctgcgggacatcagcacctgccccaacagccccagcaccccacccagcacccccagcccccgggtgccccggcgctgctacgtgctgagcagcagccagaacaacctggcccaccccccagcccctcctgtgcccccccggcagaacagcagcccccacctgcccaagctgccccccaagacctacaagcgggagctgagccacccccccctgtaccgcctgcccctgctggagaatgctgagaccccccagtag

SEQ ID NO: 171120 - DNA, 1389 bp, Artificial Sequence
  Description of Artificial Sequence: Synthetic coding sequence
atgctgctgctggcccgctgcctgctgctggtgctggtgagcagcctgctggtgtgcagcggcctggcctgtggccctggccggggctttgggaagagaagacaccccaagaagctgacccccctggcctacaagcagttcatccccaacgtggccgagaagaccctgggcgccagcggccgctatgagggcaagatcagcaggaacagcgagcgcttcaaggagctgacccccaactacaacccagacatcatcttcaaggatgaggagaacacaggagctgaccggctgatgacccagcgctgcaaggacaagctgaatgccctggccatctctgtgatgaaccagtggccaggagtgaagctgcgggtgacagagggctgggatgaagatggccaccacagcgaggagagcctgcactatgagggccgggctgtggacatcaccaccagtgaccgggacaggagcaaatatggcatgctggcccggctggccgtggaggccggctttgactgggtgtactatgagagcaaggcccacatccactgcagcgtgaaggccgagaacagcgtggccgccaagagcggcggctgcttccctggcagcgccaccgtgcacctggagcagggcggcaccaagctggtgaaggacctgagccctggggacagagtgctggccgcagatgaccagggccgcctgctgtacagcgacttcctgaccttcctggacagagatgatggagccaagaaggtgttctacgtgattgagacccgggagccccgggagcggctgctgctgacagctgcccacctgctgtttgtggccccccacaatgacagcgccaccggggagcctgaggccagcagcggcagcggccccccatctggaggagccctgggcccccgggccctgtttgccagccgggtgcggcccggccagagggtgtatgtggtggccgagagagatggagaccggcggctgctgcctgctgctgtgcacagcgtgaccctgtctgaggaggccgccggggcctatgcccccctgacagcccagggcaccatcctgatcaacagagtgctggccagctgctatgctgtgattgaggagcacagctgggcccaccgggcctttgcccccttccggctggcccacgccctgctggccgccctggccccagccaggacagaccggggcggggacagcggcggcggggacagaggaggcggcggcggccgggtggccctgacagcccctggagctgctgatgcccctggggccggggccacagctggcatccactggtacagccagctgctgtaccagatcggcacctggctgctggacagcgaggccctgcaccccctgggcatggctgtgaagagcagctag

SEQ ID NO: 171121 - DNA, 3456 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccaggatgccaccagcagcagcgctgcccagcctgaggtgattgtggtgcccctgtacctggtgaacacagaccggggccaggagggcacagcccggccccccacccccctgggccccctgggctgtgtgcccaccatcccagccacagccagcgctgccagccccctgaccttccccaccctggatgacttcatccccccccacctgcagcgctggccccaccacagccagcctgcccgggccagcggcagctttgcccccatcagccagaccccacccagcttcagccccccaccacccctggtgcccccagcccctgaggacctgcggcgggtgtctgagccagacctgaccggggctgtgagcagcacagacagcagccccctgctgaatgaggtgagcagcagcctcatcggcacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgagcggcgggtgggggagcaggacagcgcccccacccaggagaagcccaccagccctgggaaggccatcgagaagagggccaaggatgacagccggcgggtggtgaagagcacccaggacctgagtgatgtgtccatggatgaggtgggcatccccctgaggaacacagagaggagcaaggactggtacaagaccatgttcaagcagatccacaagctgaacagagacaccccagaggagaacccctacttccccacctacaagtttcctgagctgcctgagatccagcagaccagcgaggagaccaagagctgcagcgtgatgagcccccggctggagtgcagcggcaccgtgattgcccactgcagcctgaagctgctggacagcagcaacccccccaccagcgccagccaggtggccggcacagcagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccccacccaagaagatctgggactacacccctggggactgcagcatcctgccccgggaggacaggaagaccaacctggacaaggacctgagcctgtgccagacagagctggaggccgacctggagaagatggagaccctgaacaaggcccccagcgccaacgtgccccagagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagccctggagggaggagagcggccagtatgaaaggaaggccgagcggggggccggggagcggggccctgggggccccaagatcagcaagaagagctgcctgaagcccagtgatgtggtgcgctgcctgagcacagagcagaggctgagtgacctgaacaccccagaggagagcaggcctgggaagcccctgggcagcgccttccctggcagcgaggccgagcagacagagcggcacagaggaggagagcaggccggcaggaaggccgccaggagaggaggcagccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171122 - DNA, 2346 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccaggacagcagccccctgctgaatgaggtgagcagcagcctgattggaacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgaaagaagagtgggggagcaggacagcgcccccacccaggagaagcccaccagccctgggaaggccatcgagaagagggccaaggatgacagcagaagagtggtgaagagcacccaggacctgagtgatgtgtccatggatgaggtgggcatccccctgaggaacacagagaggagcaaggactggtacaagaccatgttcaagcagatccacaagctgaacagagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaacggggacacccaggtggagatgtccttcagaaaaggagagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171123 - DNA, 2541 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccagatgagtggaggctgagcagcagcgcagatgccaatggaaatgcccagcccagcagcctggccgccaagggctacagatctgtgcaccccaacctgcccagcgacaagagccaggacagcagccccctgctgaatgaggtgagcagcagcctcatcggcacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgagcggcgggtgggggagcaggacagcgcccccacccaggagaagcccaccagccctgggaaggccatcgagaagagggccaaggatgacagccggcgggtggtgaagagcacccaggacctgagtgatgtgtccatggatgaggtgggcatccccctgaggaacacagagaggagcaaggactggtacaagaccatgttcaagcagatccacaagctgaacagagacaccccagaggagaacccctacttccccacctacaagtttcctgagctgcctgagatccagcagaccagcgaggaggacaacccctacacccccacctaccagtttcctgccagcacccccagccccaagtcagaagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171124 - DNA, 2718 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccagcgctggccccaccacagccagcctgcccgggccagcggcagctttgcccccatcagccagaccccacccagcttcagccccccaccacccctggtgcccccagcccctgaggacctgcggcgggtgtctgagccagacctgactggagctgtgagcagcacagacagcagccccctgctgaatgaggtgagcagcagcctgattggaacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgaaagaagagtgggggagcaggacagcgcccccacccaggagaagcccaccagccctgggaaggccatcgagaagagggccaaggatgacagcagaagagtggtgaagagcacccaggacctgagtgatgtgtccatggatgaggtgggcatccccctgaggaacacagagaggagcaaggactggtacaagaccatgttcaagcagatccacaagctgaacagagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccccacccaagaagatctgggactacacccctggggactgcagcatcctgccccgggaggacaggaagagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaacggggacacccaggtggagatgtccttcagaaaaggagagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagctgagccaccacagcctgcgggccggccctgacctgacagaaagtgagaagagctatgtgcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171125 - DNA, 3015 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccagatgagtggaggctgagcagcagcgcagatgccaatggaaatgcccagcccagcagcctggccgccaagggctacagatctgtgcaccccaacctgcccagcgacaagagccaggatgccaccagcagcagcgctgcccagcctgaggtgattgtggtgcccctgtacctggtgaacacagaccggggccaggagggcacagcccggccccccacccccctgggccccctgggctgtgtgcccaccatcccagccacagccagcgctgccagccccctgaccttccccaccctggatgacttcatccccccccacctgcagcgctggccccaccacagccagcctgcccgggccagcggcagctttgcccccatcagccagaccccacccagcttcagccccccaccacccctggtgcccccagcccctgaggacctgcggcgggtgtctgagccagacctgactggagctgtgagcagcacagacagcagccccctgctgaatgaggtgagcagcagcctgattggaacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgaaagaagagtgggggagcaggacagcgcccccacccaggagaagcccaccagccctgggaaggccatcgagaagagggccaaggatgacagcagaagagtggtgaagagcacccaggacctgagtgatgtgtccatggatgaggtgggcatccccctgaggaacacagagaggagcaaggactggtacaagaccatgttcaagcagatccacaagctgaacagagacaccccagaggagaacccctacttccccacctacaagtttcctgagctgcctgagatccagcagaccagtgaagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccccacccaagaagatctgggactacacccctggggactgcagcatcctgccccgggaggacaggaagaccaacctggacaaggacctgagcctgtgccagacagagctggaggccgacctggagaagatggagaccctgaacaaggcccccagcgccaacgtgccccagagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171126 - DNA, 3879 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccaggatgccaccagcagcagcgctgcccagcctgaggtgattgtggtgcccctgtacctggtgaacacagaccggggccaggagggcacagcccggccccccacccccctgggccccctgggctgtgtgcccaccatcccagccacagccagcgctgccagccccctgaccttccccaccctggatgacttcatccccccccacctgcagcgctggccccaccacagccagcctgcccgggccagcggcagctttgcccccatcagccagaccccacccagcttcagccccccaccacccctggtgcccccagcccctgaggacctgcggcgggtgtctgagccagacctgaccggggctgtgagcagcacagacagcagccccctgctgaatgaggtgagcagcagcctcatcggcacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgagcggcgggtgggggagcaggacagcgcccccacccaggagaagcccaccagccctgggaaggccatcgagaagagggccaaggatgacagccggcgggtggtgaagagcacccaggacctgagtgatgtgtccatggatgaggtgggcatccccctgaggaacacagagaggagcaaggactggtacaagaccatgttcaagcagatccacaagctgaacagagacaccccagaggagaacccctacttccccacctacaagtttcctgagctgcctgagatccagcagaccagcgaggaggacaacccctacacccccacctaccagtttcctgccagcacccccagccccaagtcagaagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccccacccaagaagatctgggactacacccctggggactgcagcatcctgccccgggaggacaggaagaccaacctggacaaggacctgagcctgtgccagacagagctggaggccgacctggagaagatggagaccctgaacaaggcccccagcgccaacgtgccccagagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagttcagcagccacagcaagctgatcaccccagcccccagcagcctgccccacagccggcgggccctgagccctgagatgcatgctgtgaccagcgagtggatcagcctgactgtgggcgtgcccggccgccgcagcctggccctgaccccacccctgccccccctgcctgaggccagcatctacaacacagaccacctggccctgagcccccgggccagccccagcctgagcctgagcctgccccacctgtcctggagcgaccggcccacccccaggtctgtggccagccccctggccctgcccagcccccacaagacctacagcctggcccccaccagccaggccagcctgcacatgaatggagatggaggagtgcacacccccagcagcggcatccaccaggacagcttcctgcagctgcccctgggcagcagtgacagcgtcatcagccagctgagtgatgccttcagcagccagagcaagaggcagccctggagggaggagagcggccagtatgaaaggaaggccgagagaggagctggggagcggggccctgggggccccaagatcagcaagaagagctgcctgaagcccagtgatgtggtgcgctgcctgagcacagagcagaggctgagtgacctgaacaccccagaggagagcaggcctgggaagcccctgggcagcgccttccctggcagcgaggccgagcagacagagcggcaccggggcggggagcaggccggcaggaaggccgcccggcggggcggcagccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171127 - DNA, 3801 bp, Artificial Sequence
  Description of Artificial Sequence: Synthetic coding sequence
atgagcagtgaatgtgatggcggcagcaaggctgtgatgaatggcctggcccctggcagcaatggccaggacaaggccacagctgaccccctgcgggcccggagcatctctgctgtgaagatcatccctgtgaagacagtgaagaatgccagcggcctggtgctgcccacagacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccaggatgccaccagcagcagcgctgcccagcctgaggtgattgtggtgcccctgtacctggtgaacacagaccggggccaggagggcacagcccggccccccacccccctgggccccctgggctgtgtgcccaccatcccagccacagccagcgctgccagccccctgaccttccccaccctggatgacttcatccccccccacctgcagcgctggccccaccacagccagcctgcccgggccagcggcagctttgcccccatcagccagaccccacccagcttcagccccccaccacccctggtgcccccagcccctgaggacctgcggcgggtgtctgagccagacctgaccggggctgtgagcagcacagacagcagccccctgctgaatgaggtgagcagcagcctcatcggcacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgagcggcgggtgggggagcaggacagcgcccccacccaggagaagcccaccagccctgggaaggccatcgagaagagggccaaggatgacagccggcgggtggtgaagagcacccaggacctgagtgatgtgtccatggatgaggtgggcatccccctgaggaacacagagaggagcaaggactggtacaagaccatgttcaagcagatccacaagctgaacagagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccccacccaagaagatctgggactacacccctggggactgcagcatcctgccccgggaggacaggaagaccaacctggacaaggacctgagcctgtgccagacagagctggaggccgacctggagaagatggagaccctgaacaaggcccccagcgccaacgtgccccagagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagttcagcagccacagcaagctgatcaccccagcccccagcagcctgccccacagccggcgggccctgagccctgagatgcatgctgtgaccagcgagtggatcagcctgactgtgggcgtgcccggccgccgcagcctggccctgaccccacccctgccccccctgcctgaggccagcatctacaacacagaccacctggccctgagcccccgggccagccccagcctgagcctgagcctgccccacctgtcctggagcgaccggcccacccccaggtctgtggccagccccctggccctgcccagcccccacaagacctacagcctggcccccaccagccaggccagcctgcacatgaatggagatggaggagtgcacacccccagcagcggcatccaccaggacagcttcctgcagctgcccctgggcagcagtgacagcgtcatcagccagctgagtgatgccttcagcagccagagcaagaggcagccctggagggaggagagcggccagtatgaaaggaaggccgagagaggagctggggagcggggccctgggggccccaagatcagcaagaagagctgcctgaagcccagtgatgtggtgcgctgcctgagcacagagcagaggctgagtgacctgaacaccccagaggagagcaggcctgggaagcccctgggcagcgccttccctggcagcgaggccgagcagacagagcggcaccggggcggggagcaggccggcaggaaggccgcccggcggggcggcagccagctgagccaccacagcctgcgggccggccctgacctgacagagagcgagaagagctatgtgcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171128 - DNA, 2436 bp, Artificial Sequence
  Description of Artificial Sequence: Synthetic coding sequence
atgagcagtgaatgtgatggcggcagcaaggctgtgatgaatggcctggcccctggcagcaatggccaggacaaggacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccaggacagcagccccctgctgaatgaggtgagcagcagcctgattggaacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgaaagaagagtgggggagcaggacagcgcccccacccaggagaagcccaccagccctgggaaggccatcgagaagagggccaaggatgacagcagaagagtggtgaagagcacccaggacctgagtgatgtgtccatggatgaggtgggcatccccctgaggaacacagagaggagcaaggactggtacaagaccatgttcaagcagatccacaagctgaacagagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagccgggacatcagccctgaggagattgacctgaagaatgagccctggtacaagttcttcagcgagctggagtttgggaagcccaccaacctggacaaggacctgagcctgtgccagacagagctggaggccgacctggagaagatggagaccctgaacaaggcccccagcgccaacgtgccccagagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagaagctgctggccgaccagaggcggctgaagcgggagcaggaggaggccgacattgctgcccggcggcacactggagtcatccccacccaccaccagttcatcaccaatgaaagatttggagacctgctgaacattgatgacacagccaagaggaagagcggcagcgagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaacggggacacccaggtggagatgtccttcagaaaaggagagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171129 - DNA, 2055 bp, Artificial Sequence
  Description of Artificial Sequence: Synthetic coding sequence
atgagcagtgaatgtgatggcggcagcaaggctgtgatgaatggcctggcccctggcagcaatggccaggacaaggacatggacctgaccaagatctgcacaggaaaaggagctgtgaccctgcgggccagcagcagctaccgggagacccccagcagcagccctgccagcccccaggagacccggcagcacgagagcaagccagatgagtggaggctgagcagcagcgcagatgccaatggaaatgcccagcccagcagcctggccgccaagggctacagatctgtgcaccccaacctgcccagcgacaagagccaggacagcagccccctgctgaatgaggtgagcagcagcctcatcggcacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgagcggcgggtgggggagcaggacagcgcccccacccaggagaagcccaccagccctgggaaggccatcgagaagagggccaaggatgacagccggcgggtggtgaagagcacccaggacctgagtgatgtgtccatggatgaggtgggcatccccctgaggaacacagagaggagcaaggactggtacaagaccatgttcaagcagatccacaagctgaacagagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171130 - DNA, 2718 bp, Artificial Sequence; identical to SEQ ID NO: 171124
  Description of Artificial Sequence: Synthetic coding sequence

SEQ ID NO: 171131 - DNA, 3456 bp, Artificial Sequence; identical to SEQ ID NO: 171121
  Description of Artificial Sequence: Synthetic coding sequence

SEQ ID NO: 171132 - DNA, 3879 bp, Artificial Sequence; identical to SEQ ID NO: 171126
  Description of Artificial Sequence: Synthetic coding sequence

SEQ ID NO: 171133 - DNA, 2451 bp, Artificial Sequence
  Description of Artificial Sequence: Synthetic coding sequence
atgagcagtgaatgtgatggcggcagcaaggctgtgatgaatggcctggcccctggcagcaatggccaggacaaggacatggacctgaccaagatctgcacaggaaaaggagctgtgaccctgcgggccagcagcagctaccgggagacccccagcagcagccctgccagcccccaggagacccggcagcacgagagcaagccaggcctggagcctgagcccagcagcgcagatgagtggaggctgagcagcagcgcagatgccaatggaaatgcccagcccagcagcctggccgccaagggctacagatctgtgcaccccaacctgcccagcgacaagagccaggatgccaccagcagcagcgctgcccagcctgaggtgattgtggtgcccctgtacctggtgaacacagaccggggccaggagggcacagcccggccccccacccccctgggccccctgggctgtgtgcccaccatcccagccacagccagcgctgccagccccctgaccttccccaccctggatgacttcatccccccccacctgcagcgctggccccaccacagccagcctgcccgggccagcggcagctttgcccccatcagccagaccccacccagcttcagccccccaccacccctggtgcccccagcccctgaggacctgcggcgggtgtctgagccagacctgaccggggctgtgagcagcacagacagcagccccctgctgaatgaggtgagcagcagcctcatcggcacagacagccaggccttccccagcgtgtccaagcccagcagcgcctaccccagcaccaccatcgtgaaccccaccatcgtgctgctgcagcacaaccgggagcagcagaagaggctgagcagcctgagtgaccctgtgtctgagcggcgggtgggggagcaggacagcgcccccacccaggagaagcccaccagccctgggaaggccatcgagaagagggccaaggatgacagccggcgggtggtgaagagcacccaggacctgagtgatgtgtccatggatgaggtgggcatccccctgaggaacacagagaggagcaaggactggtacaagaccatgttcaagcagatccacaagctgaacagagatgatgacagcgacctgtacagcccccgctacagcttcagcgaggacaccaagagccccctgtctgtgcccaggagcaagtctgagatgagctacattgatggagagaaggtggtgaagaggtctgccaccctgcccctgcctgcccggagcagcagcctgaagagcagcagcgagagaaatgactgggagcccccagacaagaaggtggacaccaggaagtacagagctgagcccaagagcatctatgagtaccagcccgggaagagctctgtgctgaccaatgagaagatgagcagcgccatcagccccaccccagagatcagcagcgagaccccaggctacatctacagcagcaacttccacgctgtgaagcgggagagtgatggagcccctggggacctgaccagcctggagaatgaaaggcagatctacaagtctgtgctggagggcggggacatccccctgcagggcctgagcggcctgaagaggcccagcagcagcgccagcaccaaggacagcgagagccccaggcacttcatcccagctgactacctggagagcacagaggagttcatcagaagaagacatgatgacaaggagatgaggcctgcccgggccaagtttgacttcaaggcccagaccctgaaggagctgcccctgcagaagggggacatcgtgtacatctacaagcagattgaccagaactggtatgaaggagagcaccacggccgggtgggcatcttccccaggacctacatcgagctgctgcccccagctgagaaggcccagcccaagaagctgacccctgtgcaggtgctggagtatggagaggccatcgccaagttcaacttcaatggagacacccaggtggagatgtccttcaggaagggggagcgcatcaccctgctgcggcaggtggatgagaactggtatgagggccgcatccctggcaccagccggcagggcatcttccccatcacctacgtggatgtgatcaagaggcccctggtgaagaaccctgtggactacatggacctgcccttcagcagcagccccagccgcagcgccacagccagcccccagcagccccaggcccagcagaggagagtgaccccagacaggagccagaccagccaggacctcttctcctaccaggccctgtacagctacatcccccagaatgatgatgagctggagctgagagatggagacatcgtggatgtgatggagaagtgtgatgatggctggtttgtgggcaccagcaggaggaccaagcagtttggcaccttccctggcaactacgtgaagcccctgtacctgtag

SEQ ID NO: 171134 - DNA, 3015 bp, Artificial Sequence; identical to SEQ ID NO: 171125
  Description of Artificial Sequence: Synthetic coding sequence

SEQ ID NO: 171135 - DNA, 2016 bp, Artificial Sequence
  Description of Artificial Sequence: Synthetic coding sequence
atgcagggcccccccaggagcctgcgggccggcctgagcctggatgacttcatccctggccacctgcagagccacatcggcagcagcagccggggcaccagggtgcctgtgatcagaaatggaggcagcaacaccctgaacttccagttccatgaccctgcccccaggacagtgtgcaatggaggctacacccccaggagagatgccagccagcacccagaccctgcctggtaccagacctggccaggccctggcagcaagcccagcgccagcaccaagatcccagccagccagcacacccagaactggagcgccacctggaccaaggacagcaagagaagagacaagcgctgggtgaagtatgagggcatcggccctgtggatgagagcggcatgcccatcgcccccaggagctctgtggaccggccccgggactggtacagaaggatgttccagcagatccacaggaagatgccagacctgcagctggactggacctttgaggagcccccccgggaccccaggcacctgggcgcccagcagaggcctgcccacaggcctggccctgccaccagcagcagcggccgctcctgggaccacagcgaggagctgcccaggagcaccttcaactacagacctggggccttcagcacagtgctgcagcccagcaaccaggtgctgcggcggcgggagaaggtggacaacgtgtggacagaggagagctggaaccagttcctgcaggagctggagaccggccagaggcccaagaagcccctggtggatgatcctggagagaagcccagccagcccatcgaggtgctgctggagcgggagctggccgagctgtctgctgagctggacaaggacctgcgggccatcgagacccggctgcccagccccaagagcagccctgccccccggcgggcccctgagcagaggcccccagctggccctgccagcgcctggagcagcagctacccccacgccccctacctgggcagcgcccggagcctgagcccccacaagatggctgatggcggcagccccttcctgggcagaagagactttgtgtaccccagcagcacccgggaccccagcgccagcaatggaggcggcagccctgcccggcgggaggagaagaagaggaaggccgcccggctgaagtttgacttccaggcccagagccccaaggagctgaccctgcagaagggggacatcgtgtacatccacaaggaggtggacaagaactggctggagggggagcaccacggccgcctgggcatcttccctgccaactacgtggaggtgctgcctgcagatgagatccccaagcccatcaagccacccacctaccaggtgctggagtatggagaggccgtggcccagtacaccttcaagggggacctggaggtggagctgtccttcagaaaaggagagcacatctgcctgatcaggaaggtgaatgaaaactggtatgagggccgcatcactggaacaggccggcagggcatcttccctgccagctatgtgcaggtgtcccgggagccccggctgcggctgtgtgatgatggcccccagctgcccaccagcccccggctgacagctgctgcccggagcgcccggcaccccagcagccccagcgccctgcggagccctgctgaccccatcgacctgggcggccagaccagccccaggagaacaggcttctccttccccacccaggagccccggccccagacccagaacctgggcaccccaggccctgccctgagccacagccggggccccagccaccccctggacctgggcaccagcagccccaacaccagccagatccactggaccccctaccgggccatgtaccagtaccggccccagaatgaagatgagctggagctgcgggagggggacagagtggatgtgatgcagcagtgtgatgatggctggtttgtgggcgtgtccaggaggacccagaagtttggcaccttccctggcaactacgtggcccctgtgtag

SEQ ID NO: 171136 - DNA, 990 bp, Artificial Sequence
  Description of Artificial Sequence: Synthetic coding sequence
atggctgatggcggcagccccttcctgggcagaagagactttgtgtaccccagcagcacccgggaccccagcgccagcaatggaggcggcagccctgcccggcgggaggagaagaagaggaaggccgcccggctgaagtttgacttccaggcccagagccccaaggagctgaccctgcagaagggggacatcgtgtacatccacaaggaggtggacaagaactggctggagggggagcaccacggccgcctgggcatcttccctgccaactacgtggaggtgctgcctgcagatgagatccccaagcccatcaagccacccacctaccaggtgctggagtatggagaggccgtggcccagtacaccttcaagggggacctggaggtggagctgtccttcagaaaaggagagcacatctgcctgatcaggaaggtgaatgaaaactggtatgagggccgcatcactggaacaggccggcagggcatcttccctgccagctatgtgcaggtgtcccgggagccccggctgcggctgtgtgatgatggcccccagctgcccaccagcccccggctgacagctgctgcccggagcgcccggcaccccagcagccccagcgccctgcggagccctgctgaccccatcgacctgggcggccagaccagccccaggagaacaggcttctccttccccacccaggagccccggccccagacccagaacctgggcaccccaggccctgccctgagccacagccggggccccagccaccccctggacctgggcaccagcagccccaacaccagccagatccactggaccccctaccgggccatgtaccagtaccggccccagaatgaagatgagctggagctgcgggagggggacagagtggatgtgatgcagcagtgtgatgatggctggtttgtgggcgtgtccaggaggacccagaagtttggcaccttccctggcaactacgtggcccctgtgtag

SEQ ID NO: 171137 - DNA, 1074 bp, Artificial Sequence
  Description of Artificial Sequence: Synthetic coding sequence
atggctgctgctgccaagcccaacaacctgagcctggtggtgcacggccctggggacctgcggctggagaactaccccatccctgagcccggccccaatgaggtgctgctgaggatgcacagcgtgggcatctgtggcagtgatgtgcactactgggagtatggaagaattggcaacttcatcgtgaagaagcccatggtgctgggccacgaggccagcggcaccgtggagaaggtgggcagctctgtgaagcacctgaagccaggggacagagtggccatcgagcccggggcccccagagaaaatgatgagttctgcaagatgggccgctacaacctgagccccagcatcttcttctgtgccaccccaccagatgatggcaacctgtgccgcttctacaagcacaatgctgccttctgctacaagctgcctgacaacgtgacctttgaggagggcgccctgattgagcccctgtctgtgggcatccacgcctgccggcggggcggcgtgaccctgggccacaaggtgctggtgtgtggggccggccccatcggcatggtgaccctgctggtggccaaggccatgggcgccgcccaggtggtggtgacagacctgagcgccacccggctgagcaaggccaaggagatcggggctgacctggtgctgcagatcagcaaggagagcccccaggagatcgccaggaaggtggagggccagctgggctgcaagccagaggtgaccattgaatgtactggagctgaggccagcatccaggccggcatctatgccaccaggtctgggggcaacctggtgctggtgggcctgggcagcgagatgaccaccgtgcccctgctgcatgctgccatccgggaggtggacatcaagggcgtcttccgctactgcaacacctggcctgtggccatctccatgctggccagcaagtctgtgaatgtgaagcccctggtgacccaccgcttccccctggagaaggccctggaggcctttgagaccttcaagaagggcctgggcctgaagatcatgctgaagtgtgaccccagcgaccagaacccctag

SEQ ID NO: 171138 - DNA, 597 bp, Artificial Sequence
  Description of Artificial Sequence: Synthetic coding sequence
atggcctacccaggccaccctggagctgggggcggctactacccaggcggctacggcggggcccctgggggccctgccttccctggccagacccaggaccccctgtatggctactttgctgctgtggccggccaggacggccagattgatgctgatgagctgcagcgctgcctgacccagagcggcattgctgggggctacaagcccttcaacctggagacctgccgcctgatggtgtccatgctggaccgggacatgagcggcaccatgggcttcaatgagttcaaggagctgtgggccgtgctgaatggctggaggcagcacttcatcagctttgacacagacagaagtggcaccgtggacccccaggagctgcagaaggccctgaccaccatgggcttccggctgagcccccaggccgtgaacagcatcgccaagcgctacagcaccaacgggaagatcacctttgatgactacatcgcctgctgcgtgaagctgcgggccctgacagacagcttcagaagaagagacacagcccagcagggcgtggtgaacttcccctatgatgacttcatccagtgtgtgatgtctgtgtag

SEQ ID NO: 171139 - DNA, 552 bp, Artificial Sequence
  Description of Artificial Sequence: Synthetic coding sequence
atgcagtatggaggagcccctgggggccctgccttccctggccagacccaggaccccctgtatggctactttgctgctgtggccggccaggacggccagattgatgctgatgagctgcagcgctgcctgacccagagcggcattgctgggggctacaagcccttcaacctggagacctgccgcctgatggtgtccatgctggaccgggacatgagcggcaccatgggcttcaatgagttcaaggagctgtgggccgtgctgaatggctggaggcagcacttcatcagctttgacacagacaggagcggcaccgtggacccccaggagctgcagaaggccctgaccaccatgggcttccggctgagcccccaggccgtgaacagcatcgccaagcgctacagcaccaacgggaagatcacctttgatgactacatcgcctgctgcgtgaagctgcgggccctgacagacagcttcagaagaagagacacagcccagcagggcgtggtgaacttcccctatgatgacttcatccagtgtgtgatgtctgtgtag

SEQ ID NO: 171140 - DNA, 543 bp, Artificial Sequence
  Description of Artificial Sequence: Synthetic coding sequence
atgcagtatggaggagcccctgggggccctgccttccctggccagacccaggaccccctgtatggctactttgctgctgtggccggccaggacggccagattgatgctgatgagctgcagcgctgcctgacccagagcggcattgctgggggctacaagcccttcaacctggagacctgccgcctgatggtgtccatgctggaccgggacatgagcggcaccatgggcttcaatgagttcaaggagctgtgggccgtgctgaatggctggaggcagcacttcatcagctttgacacagacaggagcggcaccgtggacccccaggagctgcagaaggccctgaccaccatgggcttccggctgagcccccaggccgtgaacagcatcgccaagcgctacagcaccaacgggaagatcacctttgatgactacatcgcctgctgcgtgaagctgcgggccctgacagacagcttcagaagaagagacacagcccagcagggcgtggtgaacttcccctatgatgatgtgtccctgagaaattag

SEQ ID NO: 171141 - DNA, 6645 bp, Artificial Sequence
  Description of Artificial Sequence: Synthetic coding sequence
atggccaccaggagcagcagaagagagagccggctgcccttcctgttcaccctggtggccctgctgcccccaggggccctgtgtgaggtgtggacccagaggctgcacggcggcagcgcccccctgccccaggaccggggcttcctggtggtgcagggcgacccccgggagctgcggctgtgggcccggggagatgcccggggggccagcagagcagatgagaagcccctgcggaggaagaggtctgctgccctgcagcctgagcccatcaaggtgtatggccaggtgtccctgaatgacagccacaaccagatggtggtgcactgggccggggagaagagcaatgtgattgtggccctggcccgggacagcctggccctggcccggcccaagagcagtgatgtgtatgtgtcctatgactatggcaagagcttcaagaagatcagtgacaagctgaactttggcctgggcaacagaagtgaggccgtcatcgcccagttctaccacagccctgctgacaacaagcgctacatctttgctgatgcctatgcccagtacctgtggatcacctttgacttctgcaacaccctgcagggcttcagcatccccttccgggctgctgacctgctgctgcacagcaaggccagcaacctgctgctgggctttgacaggagccaccccaacaagcagctgtggaagagtgatgactttggccagacctggatcatgatccaggagcacgtgaagagcttctcctggggcatcgacccctatgacaagcccaacaccatctacatcgagagacatgagcccagcggctacagcaccgtcttccgcagcacagacttcttccagagccgggagaaccaggaggtgatcctggaggaggtgcgggacttccagctgcgggacaagtacatgtttgccaccaaggtggtgcacctgctgggcagcgagcagcagagctctgtgcagctgtgggtgtcctttggaaggaagcccatgagagctgcccagtttgtgaccaggcaccccatcaatgagtactacatcgcagatgccagcgaggaccaggtgtttgtgtgtgtgagccacagcaacaacagaaccaacctgtacatcagcgaggccgagggcctgaagttcagcctgagcctggagaatgtgctgtactacagccctgggggcgccggcagtgacaccctggtgcgctactttgccaatgagccctttgctgacttccaccgggtggagggcctgcagggcgtgtacatcgccaccctcatcaatggctccatgaatgaggagaacatgaggagcgtcatcacctttgacaagggcggcacctgggagttcctgcaggccccagccttcaccggctatggagagaagatcaactgtgagctgagccagggctgcagcctgcacctggcccagaggctgagccagctgctgaacctgcagctgcggaggatgcccatcctgagcaaggagagcgcccctggcctcatcatcgccactggatctgtgggcaagaacctggccagcaagaccaacgtgtacatcagcagcagcgctggggcccgctggagggaggccctgcccggcccccactactacacctggggagaccatggaggcatcatcacagccatcgcccagggcatggagaccaatgagctgaagtacagcaccaatgaaggagagacctggaagaccttcatcttcagcgagaagcctgtgtttgtgtatggcctgctgacagagcccggggagaagagcacagtgttcaccatcttcggcagcaacaaggaaaatgtgcacagctggctgatcctgcaggtgaatgccacagatgccctgggcgtgccctgcacagaaaatgactacaagctgtggagccccagtgatgaaagaggaaatgaatgtctgctgggccacaagacagtgttcaagaggaggacccctcatgccacctgcttcaacggggaggactttgacaggcctgtggtggtgagcaactgcagctgcacccgggaggactatgaatgtgactttggcttcaagatgtctgaggacctgagcctggaggtgtgtgtgcctgaccctgagttcagcggcaagagctacagcccccctgtgccctgccctgtgggcagcacctacagaaggacccggggctacaggaagatcagcggggacacctgcagcggaggagatgtggaggcccggctggagggggagctggtgccctgccccctggccgaggagaatgagttcatcctgtatgctgtgaggaagagcatctaccgctatgacctggccagcggggccacagagcagctgcccctgaccggcctgcgggctgctgtggccctggactttgattatgagcacaactgcctgtactggagcgacctggccctggatgtgatccagaggctgtgcctgaatggcagcacaggccaggaggtgatcatcaacagcggcctggagaccgtggaggccctggcctttgagcccctgagccagctgctgtactgggtggatgctggcttcaagaagattgaggtggccaacccagatggagacttccggctgaccatcgtgaacagctctgtgctggaccggccccgggccctggtgctggtgccccaggagggcgtgatgttctggacagactggggagacctgaagccaggcatctaccgcagcaacatggatggcagcgctgcctaccacctggtgtctgaagatgtgaagtggcccaacggcatctctgtggatgaccagtggatctactggacagatgcctacctggagtgcatcgagcgcatcaccttcagcggccagcagaggagcgtcatcctggacaacctgccccacccctatgccatcgctgtgttcaagaatgagatctactgggatgactggagccagctgagcatcttccgggccagcaagtacagcggcagccagatggagatcctggccaaccagctgaccggcctgatggacatgaagatcttctacaagggcaagaacacaggcagcaatgcctgtgtgccccggccctgcagcctgctgtgcctgcccaaggccaacaacagccgcagctgccgctgcccagaagatgtgagcagctctgtgctgcccagcggggacctgatgtgtgactgcccccagggctaccagctgaagaacaacacctgtgtgaagcaggagaacacctgcctgaggaaccagtaccgctgcagcaatggaaactgcatcaacagcatctggtggtgtgactttgacaatgactgtggggacatgtctgatgagaggaactgccccaccaccatctgtgacctggacacccagttccgctgccaggagagcggcacctgcatccccctgagctacaagtgtgacctggaggatgactgtggggacaacagtgatgagagccactgtgagatgcaccagtgccgcagtgatgagtacaactgcagcagcggcatgtgcatccgcagctcctgggtgtgtgatggagacaatgactgccgggactggagcgatgaggccaactgcacagccatctaccacacctgtgaggccagcaacttccagtgcagaaatggccactgcatcccccagcgctgggcctgtgatggagacacagactgccaggacggcagtgatgaggaccctgtgaactgtgagaagaagtgcaatggcttccgctgccccaacggcacctgcatccccagcagcaagcactgtgatggcctgcgggactgcagtgatggcagtgatgagcagcactgtgagcccctgtgcacccacttcatggactttgtgtgcaagaaccggcagcagtgcctcttccacagcatggtgtgtgatggcatcatccagtgcagagatggcagtgatgaagatgctgcctttgctggctgcagccaggaccctgagttccacaaggtgtgtgatgaatttggcttccagtgccagaatggagtgtgcatcagcctcatctggaagtgtgatggcatggatgactgtggggactacagtgatgaggccaactgtgagaaccccacagaggcccccaactgcagccgctacttccagttccgctgtgaaaatggccactgcatccccaaccgctggaagtgtgacagagaaaatgactgtggggactggagcgatgagaaggactgtggggacagccacatcctgcccttcagcaccccaggccccagcacctgcctgcccaactactaccgctgcagcagcggcacctgtgtgatggacacctgggtgtgtgatggctacagagactgtgctgatggcagtgatgaggaggcctgccccctgctggccaacgtgacagctgccagcacccccacccagctgggccgctgtgacagatttgaatttgagtgccaccagcccaagacctgcatccccaactggaagagatgtgatggccaccaggactgccaggacggcagagatgaggccaactgccccacccacagcaccctgacctgcatgagccgggagttccagtgtgaagatggagaggcctgcatcgtgctgtctgagcgctgtgatggcttcctggactgcagtgatgaaagtgatgagaaggcctgcagtgatgagctgactgtgtacaaggtgcagaacctgcagtggacagctgacttctctggagatgtgaccctgacctggatgaggcccaagaagatgcccagcgccagctgtgtgtacaacgtgtactacagagtggtgggggagagcatctggaagaccctggagacccacagcaacaagaccaacacagtgctgaaggtgctgaagccagacaccacctaccaggtgaaggtgcaggtgcagtgcctgagcaaggcccacaacaccaatgactttgtgaccctgcggaccccagagggcctgcctgatgcccccaggaacctgcagctgagcctgccccgggaggccgagggcgtgattgtgggccactgggccccacccatccacacccacggcctcatccgggagtacatcgtggagtacagccgcagcggcagcaagatgtgggccagccagagagctgccagcaacttcacagagatcaagaacctgctggtgaacaccctgtacacagtgcgggtggccgctgtgaccagccggggcatcggcaactggagcgacagcaagagcatcaccaccatcaagggcaaggtgattcctcctccagacatccacatcgacagctatggagagaactacctgtccttcaccctgaccatggagagtgacatcaaggtgaatggctacgtggtgaacctcttctgggcctttgacacccacaagcaggagaggaggaccctgaacttccggggcagcatcctgagccacaaggtgggcaacctgacagcccacaccagctatgagatcagcgcctgggccaagacagacctgggggacagccccctggcctttgaacatgtgatgacccggggcgtgcggcccccagcccccagcctgaaggccaaggccatcaaccagacagctgtggagtgcacctggacaggccccagaaatgtggtgtatggcatcttctacgccaccagcttcctggacctgtacagaaaccccaagagcctgaccaccagcctgcacaacaagacagtcatcgtgtccaaggatgagcagtacctgttcctggtgcgggtggtggtgccctaccagggccccagcagtgactatgtggtggtgaagatgatcccagacagccggctgccccccaggcacctgcacgtggtgcacacaggcaagacctctgtggtgatcaagtgggagagcccctatgacagcccagaccaggacctgctgtatgctgtggccgtgaaggacctgatcaggaagacagacaggagctacaaggtgaagagcaggaacagcacagtggagtacaccctgaacaagctggagcccggcggcaagtaccacatcatcgtgcagctgggcaacatgagcaaggacagcagcatcaagatcaccaccgtgtccctgagcgccccagatgccctgaagatcatcacagaaaatgaccacgtgctgctcttctggaagagcctggccctgaaggagaagcacttcaatgaaagccggggctatgagatccacatgtttgacagcgccatgaacatcacagcctacctgggcaacaccacagacaacttcttcaagatcagcaacctgaagatgggccacaactacaccttcaccgtgcaggcccgctgcctgtttggaaaccagatctgtggggagcccgccatcctgctgtatgatgagctgggcagcggggctgatgccagcgccacccaggccgcccggagcacagatgtggccgctgtggtggtgcccatcctcttcctgatcctgctgagcctgggcgtgggctttgccatcctgtacaccaagcaccggcggctgcagagcagcttcaccgcctttgccaacagccactacagcagccggctgggcagcgccatcttcagcagtggagatgacctgggggaggatgatgaagatgcccccatgatcaccggcttcagtgatgatgtgcccatggtgattgcctag

SEQ ID NO: 171142 - DNA, 3507 bp, Artificial Sequence
  Description of Artificial Sequence: Synthetic coding sequence
atgggcaaggtgggcgctgggggcggcagccaggcccggctgagcgccctgctggccggggccggcctgctgatcctgtgtgcccctggggtgtgtggcggcggcagctgctgccccagcccccaccccagcagcgcccccaggtctgccagcaccccccggggcttcagccaccagggccggcccggccgggccccagccacccccctgcccctggtggtgcggcccctcttctctgtggcccctggggaccgggccctgagcctggagcgggcccggggcactggagcctccatggctgtggccgcccggtctggaagaagaagaagaagtggagctgaccaggagaaggccgagcggggggagggcgccagccgcagcccccggggcgtgctgagagatggcggccagcaggagcccggcacccgggagcgggaccctgacaaggccacccgcttcaggatggaggagctgcggctgaccagcaccacctttgccctgaccggggacagcgcccacaaccaggccatggtgcactggagcggccacaacagcagcgtcatcctgatcctgaccaagctgtatgactacaacctgggcagcatcacagagagcagcctgtggaggagcacagattatggcaccacctatgagaagctgaatgacaaggtgggcctgaagaccatcctgagctacctgtatgtgtgccccaccaacaagaggaagatcatgctgctgacagatcctgagattgagagcagcctgctgatcagcagtgatgagggcgccacctaccagaagtaccgcctgaacttctacatccagagcctgctcttccaccccaagcaggaggactggatcctggcctacagccaggaccagaagctgtacagcagcgctgagtttggccgccgctggcagctgatccaggagggcgtggtgcccaaccgcttctactggagcgtgatgggcagcaacaaggagccagacctggtgcacctggaggccaggacagtggatggccacagccactacctgacctgcaggatgcagaactgcacagaggccaacagaaaccagcccttccctggctacatcgaccctgacagcctcatcgtgcaggaccactacgtgtttgtgcagctgaccagcggcggccggccccactactacgtgtcctacagaagaaatgcctttgcccagatgaagctgcccaagtatgccctgcccaaggacatgcacgtgatcagcacagatgagaaccaggtgtttgctgctgtgcaggagtggaaccagaatgacacctacaacctgtacatcagtgacacccggggcgtgtacttcaccctggccctggagaatgtgcagagcagccggggccctgagggcaacatcatgattgacctgtatgaggtggccggcatcaagggcatgttcctggccaacaagaagattgacaaccaggtgaagaccttcatcacctacaacaagggccgggactggaggctgctgcaggccccagacacagacctgcggggggaccctgtgcactgcctgctgccctactgcagcctgcacctgcacctgaaggtgtctgagaacccctacaccagcggcatcatcgccagcaaggacacagcccccagcatcatcgtggccagcggcaacatcggcagcgagctgagtgacacagacatctccatgtttgtgtccagtgatgctggcaacacctggaggcagatctttgaggaggagcacagcgtgctgtacctggaccagggcggcgtgctggtggccatgaagcacaccagcctgcccatccgccacctgtggctgagctttgatgagggccgctcctggagcaagtacagcttcaccagcatccccctgtttgtggatggagtgctgggggagcctggagaggagaccctcatcatgacagtgtttggccacttcagccacaggtctgagtggcagctggtgaaggtggactacaagagcatctttgacagaagatgtgccgaggaggactaccggccctggcagctgcacagccagggcgaggcctgcatcatgggcgccaagaggatctacaagaagaggaagtctgagaggaagtgcatgcagggcaagtatgctggggccatggagagcgagccctgtgtgtgcacagaggccgactttgactgtgactatggctatgaaagacacagcaatggccagtgcctgcctgccttctggttcaaccccagcagcctgagcaaggactgcagcctgggccagagctacctgaacagcacaggctacaggaaggtggtgagcaacaactgcacagatggagtgcgggagcagtacacagccaagccccagaagtgccctgggaaggccccccggggcctgcgcatcgtgacagcagatggcaagctgacagctgagcagggccacaacgtgaccctgatggtgcagctggaggagggagatgtgcagaggaccctcatccaggtggactttggagatggcattgctgtgtcctatgtgaacctgagctccatggaggatggcatcaagcacgtgtaccagaatgtgggcatcttccgggtgacagtgcaggtggacaacagcctgggcagtgacagcgctgtgctgtacctgcacgtgacctgccccctggagcacgtgcacctgagcctgccctttgtgaccaccaagaacaaggaggtgaatgccacagctgtgctgtggcccagccaggtgggcaccctgacctacgtgtggtggtacggcaacaacacagagcccctcatcaccctggagggcagcatctccttccgcttcaccagcgagggcatgaacaccatcaccgtgcaggtgtctgctggaaatgccatcctgcaggacaccaagaccatcgctgtgtatgaggagttccgcagcctgcggctgtccttcagccccaacctggatgactacaacccagacatccctgagtggaggcgggacatcggccgggtcatcaagaagagcctggtggaggccactggagtgcccggccagcacatcctggtggccgtgctgcccggcctgcccaccacagctgagctgtttgtgctgccctaccaggaccctgctggggagaacaagaggagcacagatgacctggagcagatcagcgagctgctgatccacaccctgaaccagaacagcgtgcactttgagctgaagccaggagtgcgggtgctggtgcatgctgcccacctgacagctgcccccctggtggacctgacccccacccacagcggcagcgccatgctgatgctgctgtctgtggtgtttgtgggcctggccgtgtttgtgatctacaagttcaagagaagagtggccctgcccagcccccccagccccagcacccagcccggggacagcagcctgcggctgcagagggcccggcatgccaccccacccagcacccccaagaggggcagcgctggggcccagtatgccatctag

SEQ ID NO: 171143 - DNA, 3597 bp, Artificial Sequence
  Description of Artificial Sequence: Synthetic coding sequence
atgggcaaggtgggcgctgggggcggcagccaggcccggctgagcgccctgctggccggggccggcctgctgatcctgtgtgcccctggggtgtgtggcggcggcagctgctgccccagcccccaccccagcagcgcccccaggtctgccagcaccccccggggcttcagccaccagggccggcccggccgggccccagccacccccctgcccctggtggtgcggcccctcttctctgtggcccctggggaccgggccctgagcctggagcgggcccggggcactggagcctccatggctgtggccgcccggtctggaagaagaagaagaagtggagctgaccaggagaaggccgagcggggggagggcgccagccgcagcccccggggcgtgctgagagatggcggccagcaggagcccggcacccgggagcgggaccctgacaaggccacccgcttcaggatggaggagctgcggctgaccagcaccacctttgccctgaccggggacagcgcccacaaccaggccatggtgcactggagcggccacaacagcagcgtcatcctgatcctgaccaagctgtatgactacaacctgggcagcatcacagagagcagcctgtggaggagcacagattatggcaccacctatgagaagctgaatgacaaggtgggcctgaagaccatcctgagctacctgtatgtgtgccccaccaacaagaggaagatcatgctgctgacagatcctgagattgagagcagcctgctgatcagcagtgatgagggcgccacctaccagaagtaccgcctgaacttctacatccagagcctgctcttccaccccaagcaggaggactggatcctggcctacagccaggaccagaagctgtacagcagcgctgagtttggccgccgctggcagctgatccaggagggcgtggtgcccaaccgcttctactggagcgtgatgggcagcaacaaggagccagacctggtgcacctggaggccaggacagtggatggccacagccactacctgacctgcaggatgcagaactgcacagaggccaacagaaaccagcccttccctggctacatcgaccctgacagcctcatcgtgcaggaccactacgtgtttgtgcagctgaccagcggcggccggccccactactacgtgtcctacagaagaaatgcctttgcccagatgaagctgcccaagtatgccctgcccaaggacatgcacgtgatcagcacagatgagaaccaggtgtttgctgctgtgcaggagtggaaccagaatgacacctacaacctgtacatcagtgacacccggggcgtgtacttcaccctggccctggagaatgtgcagagcagccggggccctgagggcaacatcatgattgacctgtatgaggtggccggcatcaagggcatgttcctggccaacaagaagattgacaaccaggtgaagaccttcatcacctacaacaagggccgggactggaggctgctgcaggccccagacacagacctgcggggggaccctgtgcactgcctgctgccctactgcagcctgcacctgcacctgaaggtgtctgagaacccctacaccagcggcatcatcgccagcaaggacacagcccccagcatcatcgtggccagcggcaacatcggcagcgagctgagtgacacagacatctccatgtttgtgtccagtgatgctggcaacacctggaggcagatctttgaggaggagcacagcgtgctgtacctggaccagggcggcgtgctggtggccatgaagcacaccagcctgcccatccgccacctgtggctgagctttgatgagggccgctcctggagcaagtacagcttcaccagcatccccctgtttgtggatggagtgctgggggagcctggagaggagaccctcatcatgacagtgtttggccacttcagccacaggtctgagtggcagctggtgaaggtggactacaagagcatctttgacagaagatgtgccgaggaggactaccggccctggcagctgcacagccagggcgaggcctgcatcatgggcgccaagaggatctacaagaagaggaagtctgagaggaagtgcatgcagggcaagtatgctggggccatggagagcgagccctgtgtgtgcacagaggccgactttgactgtgactatggctatgaaagacacagcaatggccagtgcctgcctgccttctggttcaaccccagcagcctgagcaaggactgcagcctgggccagagctacctgaacagcacaggctacaggaaggtggtgagcaacaactgcacagatggagtgcgggagcagtacacagccaagccccagaagtgccctgggaaggccccccggggcctgcgcatcgtgacagcagatggcaagctgacagctgagcagggccacaacgtgaccctgatggtgcagctggaggagggagatgtgcagaggaccctcatccaggtggactttggagatggcattgctgtgtcctatgtgaacctgagctccatggaggatggcatcaagcacgtgtaccagaatgtgggcatcttccgggtgacagtgcaggtggacaacagcctgggcagtgacagcgctgtgctgtacctgcacgtgacctgccccctggagcacgtgcacctgagcctgccctttgtgaccaccaagaacaaggaggtgaatgccacagctgtgctgtggcccagccaggtgggcaccctgacctacgtgtggtggtacggcaacaacacagagcccctcatcaccctggagggcagcatctccttccgcttcaccagcgagggcatgaacaccatcaccgtgcaggtgtctgctggaaatgccatcctgcaggacaccaagaccatcgctgtgtatgaggagttccgcagcctgcggctgtccttcagccccaacctggatgactacaacccagacatccctgagtggaggcgggacatcggccgggtcatcaagaagagcctggtggaggccactggagtgcccggccagcacatcctggtggccgtgctgcccggcctgcccaccacagctgagctgtttgtgctgccctaccaggaccctgctggggagaacaagaggagcacagatgacctggagcagatcagcgagctgctgatccacaccctgaaccagaacagcgtgcactttgagctgaagccaggagtgcgggtgctggtgcatgctgcccacctgacagctgcccccctggtggacctgacccccacccacagcggcagcgccatgctgatgctgctgtctgtggtgtttgtgggcctggccgtgtttgtgatctacaagttcaagaggaagatccctggcatcaacgtgtatgcccagatgcagaatgagaaggagcaggagatgatcagccctgtgagccacagcgagagccggcccaacgtgccccagacagagctgcggcggcccggccagctgattgatgagaaggtggagagccagctgattggcagcatcagcatcgtggccgagaaccagagcaccaaggagatccccacctacgtgaatgtgtag

SEQ ID NO: 171144 - DNA, 2145 bp, Artificial Sequence
  Description of Artificial Sequence: Synthetic coding sequence
atgattgacctgtatgaggtggccggcatcaagggcatgttcctggccaacaagaagattgacaaccaggtgaagaccttcatcacctacaacaagggccgggactggaggctgctgcaggccccagacacagacctgcggggggaccctgtgcactgcctgctgccctactgcagcctgcacctgcacctgaaggtgtctgagaacccctacaccagcggcatcatcgccagcaaggacacagcccccagcatcatcgtggccagcggcaacatcggcagcgagctgagtgacacagacatctccatgtttgtgtccagtgatgctggcaacacctggaggcagatctttgaggaggagcacagcgtgctgtacctggaccagggcggcgtgctggtggccatgaagcacaccagcctgcccatccgccacctgtggctgagctttgatgagggccgctcctggagcaagtacagcttcaccagcatccccctgtttgtggatggagtgctgggggagcccggggaggagaccctcatcatgacagtgtttggccacttcagccacaggtctgagtggcagctggtgaaggtggactacaagagcatctttgaccggcgctgtgccgaggaggactaccggccctggcagctgcacagccagggcgaggcctgcatcatgggcgccaagaggatctacaagaagaggaagtctgagaggaagtgcatgcagggcaagtatgctggggccatggagagcgagccctgtgtgtgcacagaagctgactttgactgtgactatggctatgagcggcacagcaatggccagtgcctgcctgccttctggttcaaccccagcagcctgagcaaggactgcagcctgggccagagctacctgaacagcacaggctacaggaaggtggtgagcaacaactgcacagatggagtgcgggagcagtacacagccaagccccagaagtgccctgggaaggccccccggggcctgagaattgtgacagcagatggcaagctgacagctgagcagggccacaacgtgaccctgatggtgcagctggaggagggagatgtgcagaggaccctcatccaggtggactttggagatggcattgctgtgtcctatgtgaacctgagctccatggaggatggcatcaagcacgtgtaccagaatgtgggcatcttccgggtgacagtgcaggtggacaacagcctgggcagtgacagcgctgtgctgtacctgcacgtgacctgccccctggagcacgtgcacctgagcctgccctttgtgaccaccaagaacaaggaggtgaatgccacagctgtgctgtggcccagccaggtgggcaccctgacctacgtgtggtggtacggcaacaacacagagcccctcatcaccctggagggcagcatctccttccgcttcaccagcgagggcatgaacaccatcaccgtgcaggtgtctgctggaaatgccatcctgcaggacaccaagaccatcgctgtgtatgaggagttccgcagcctgcggctgtccttcagccccaacctggatgactacaacccagacatccctgagtggaggcgggacatcggccgggtcatcaagaagagcctggtggaggccaccggggtgcccggccagcacatcctggtggccgtgctgcccggcctgcccaccacagctgagctgtttgtgctgccctaccaggaccctgctggggagaacaagaggagcacagatgacctggagcagatcagcgagctgctgatccacaccctgaaccagaacagcgtgcactttgagctgaagccaggagtgcgggtgctggtgcacgccgcccacctgacagctgcccccctggtggacctgacccccacccacagcggcagcgccatgctgatgctgctgtctgtggtgtttgtgggcctggccgtgtttgtgatctacaagttcaagaggaagatccctggcatcaacgtgtatgcccagatgcagaatgagaaggagcaggagatgatcagccctgtgagccacagcgagagccggcccaacgtgccccagacagagctgcggcggcccggccagctgattgatgagaaggtggagagccagctgattggagagtag

SEQ ID NO: 171145 - DNA, 642 bp, Artificial Sequence
  Description of Artificial Sequence: Synthetic coding sequence
tgactggatgactacaacccagacatccctgagtggaggcgggacatcggccgggtcatcaagaagagcctggtggaggccaccggggtgcccggccagcacatcctggtggccgtgctgcccggcctgcccaccacagctgagctgtttgtgctgccctaccaggaccctgctggggagaacaagaggagcacagatgacctggagcagatcagcgagctgctgatccacaccctgaaccagaacagcgtgcactttgagctgaagccaggagtgcgggtgctggtgcacgccgcccacctgacagctgcccccctggtggacctgacccccacccacagcggcagcgccatgctgatgctgctgtctgtggtgtttgtgggcctggccgtgtttgtgatctacaagttcaagaggaagatccctggcatcaacgtgtatgcccagatgcagaatgagaaggagcaggagatgatcagccctgtgagccacagcgagagccggcccaacgtgccccagacagagctgcggcggcccggccagctgattgatgagaaggtggagagccagctgattggcagcatcagcatcgtggccgagaaccagagcaccaaggagatccccacctacgtgaatgtgtag

SEQ ID NO: 171146 - DNA, 3009 bp, Artificial Sequence
  Description of Artificial Sequence: Synthetic coding sequence
atgggcaaggtgctggagagcagcctgtggaggagcagtgactttggcaccagctacaccaagctgaccctgcagcccggggtgaccaccgtcatcgacaacttctacatctgccccaccaacaagaggaaggtgatcctggtgagcagcagcctgagtgaccgggaccagagcctcttcctgtctgcagatgagggcgccaccttccagaagcagcccatccccttctttgtggagaccctcatcttccaccccaaggaggaggacaaggtgctggcctacaccaaggagagcaagctgtatgtgtccagtgacctgggcaagaagtggaccctgctgcaggagcgggtgaccaaggaccacgtgttctggagcgtgtctggagtggatgctgaccctgacctggtgcacgtggaggcccaggacctgggcggggacttccgctacgtgacctgtgccatccacaactgcagcgagaagatgctgacagccccctttgctggccccatcgaccacggcagcctgactgtgcaggatgactacatcttcttcaaggccaccagcgccaaccagaccaagtactacgtgtcctacagaagaaatgaatttgtgctgatgaagctgcccaagtatgccctgcccaaggacctgcagatcatcagcacagatgagagccaggtgtttgtggccgtgcaggagtggtaccagatggacacctacaacctgtaccagagcgacccccggggcgtgcgctatgccctggtgctgcaggatgtgcgcagcagccggcaggccgaggagagcgtgctgattgacatcctggaggtgcggggcgtgaagggcgtcttcctggccaaccagaagattgatggcaaggtgatgaccctcatcacctacaacaagggccgggactgggactacctgcggccccccagcatggacatgaatggcaagcccaccaactgcaagcccccagactgccacctgcacctgcacctgcgctgggccgacaacccctacgtgtctggcaccgtgcacaccaaggacacagcccctggcctcatcatgggcgccggcaacctgggcagccagctggtggagtacaaggaggagatgtacatcaccagtgactgtggccacacctggaggcaggtgtttgaggaggagcaccacatcctgtacctggaccatggaggagtgattgtggccatcaaggacaccagcatccccctgaagatcctgaagttctctgtggatgagggcctgacctggagcacccacaacttcaccagcacctctgtgtttgtggatggcctgctgtctgagcctggagatgagaccctggtgatgacagtgtttggccacatctccttcagaagtgactgggagctggtgaaggtggacttccggcccagcttcagccggcagtgtggggaggaggactacagctcctgggagctgagcaacctgcagggcgaccgctgcatcatgggccagcagaggagcttcaggaagaggaagagcacctcctggtgcatcaagggccgctccttcaccagcgccctgaccagccgggtgtgtgagtgccgggacagcgacttcctgtgtgactatggctttgagaggagcagcagcagcgagagcagcaccaacaagtgcagcgccaacttctggttcaaccccctgagccccccagatgactgtgccctgggccagacctacaccagcagcctgggctacaggaaggtggtgtccaatgtgtgtgagggcggcgtggacatgcagcagagccaggtgcagctgcagtgccccctgaccccaccccggggcctgcaggtgtccatccagggcgaggccgtggccgtgcggcctggagaagatgtgctgtttgtggtgcggcaggagcagggagatgtgctgaccaccaagtaccaggtggacctgggagatggcttcaaggccatgtatgtgaacctgaccctgaccggggagcccatccgccacagatatgagagccctggcatctacagagtgtctgtgcgggcagaaaatacagctggccatgatgaagctgtgctgtttgtgcaggtgaacagccccctgcaggccctgtacctggaggtggtgcctgtgattggcctgaaccaggaggtgaacctgacagctgtgctgctgcccctgaaccccaacctgaccgtcttctactggtggattggccacagcctgcagcccctgctgagcctggacaacagcgtgaccacccgcttcagtgacacaggagatgtgcgggtgacagtgcaggccgcctgtggcaacagcgtgctgcaggacagccgggtgctgcgggtgctggaccagttccaggtgatgcccctgcagttcagcaaggagctggatgcctacaaccccaacaccccagagtggagagaagatgtgggcctggtggtgacccggctgctgagcaaggagacctctgtgccccaggagctgctggtgacagtggtgaagccaggcctgcccaccctggccgacctgtatgtgctgctgcccccaccccggcccaccaggaagaggagcctgagcagtgacaagaggctggccgccatccagcaggtgctgaatgcccagaagatctccttcctgctgcggggcggcgtgcgggtgctggtggccctgcgggacacaggaactggagctgagcagctgggcggcggcggcggctactgggccgtggtggtgctgtttgtgattggcctgtttgctgctggggccttcatcctgtacaagttcaagagcaggaagaggcctggccgcacagtgtatgcccagatgcacaatgagaaggagcaggagatgaccagccctgtgagccacagtgaagatgtgcagggcgctgtgcagggcgaggagttcattgatgatgacctggacagccagaccctgggcaaccacagcggcgtggtgctgagcatcaacagccgggagatgcacagctacctggtgtcctag

SEQ ID NO: 171147 - DNA, 3480 bp, Artificial Sequence
  Description of Artificial Sequence: Synthetic coding sequence
atggcccaccggggccccagccgggccagcaaaggacctggccccacagcccgggcccccagccctggggcccctcctccacccaggagccccaggagccggcccctgctgctgctgctgctgctgctgggcgcctgtggggctgctggccgcagccctgagcccggccgcctgggcccccacgcccagctgaccagggtgcccaggagccccccagctggccgggcagagcccggcggcggggaggaccggcaggcccggggcacagagcccggggcccctggccccagccctggccctgcccctggccctggagaagatggagccccagctgctggctaccgccgctgggagcgggccgcccccctggccggcgtggccagccgggcccaggtgtccctcatcagcaccagctttgtgctgaagggagatgccacccacaaccaggccatggtgcactggacaggagagaacagcagcgtcatcctgatcctgaccaagtactaccacgccgacatgggcaaggtgctggagagcagcctgtggaggagcagtgactttggcaccagctacaccaagctgaccctgcagcccggggtgaccaccgtcatcgacaacttctacatctgccccaccaacaagaggaaggtgatcctggtgagcagcagcctgagtgaccgggaccagagcctcttcctgtctgcagatgagggcgccaccttccagaagcagcccatccccttctttgtggagaccctcatcttccaccccaaggaggaggacaaggtgctggcctacaccaaggagagcaagctgtatgtgtccagtgacctgggcaagaagtggaccctgctgcaggagcgggtgaccaaggaccacgtgttctggagcgtgtctggagtggatgctgaccctgacctggtgcacgtggaggcccaggacctgggcggggacttccgctacgtgacctgtgccatccacaactgcagcgagaagatgctgacagccccctttgctggccccatcgaccacggcagcctgactgtgcaggatgactacatcttcttcaaggccaccagcgccaaccagaccaagtactacgtgtcctacagaagaaatgaatttgtgctgatgaagctgcccaagtatgccctgcccaaggacctgcagatcatcagcacagatgagagccaggtgtttgtggccgtgcaggagtggtaccagatggacacctacaacctgtaccagagcgacccccggggcgtgcgctatgccctggtgctgcaggatgtgcgcagcagccggcaggccgaggagagcgtgctgattgacatcctggaggtgcggggcgtgaagggcgtcttcctggccaaccagaagattgatggcaaggtgatgaccctcatcacctacaacaagggccgggactgggactacctgcggccccccagcatggacatgaatggcaagcccaccaactgcaagcccccagactgccacctgcacctgcacctgcgctgggccgacaacccctacgtgtctggcaccgtgcacaccaaggacacagcccctggcctcatcatgggcgccggcaacctgggcagccagctggtggagtacaaggaggagatgtacatcaccagtgactgtggccacacctggaggcaggtgtttgaggaggagcaccacatcctgtacctggaccatggaggagtgattgtggccatcaaggacaccagcatccccctgaagatcctgaagttctctgtggatgagggcctgacctggagcacccacaacttcaccagcacctctgtgtttgtggatggcctgctgtctgagcctggagatgagaccctggtgatgacagtgtttggccacatctccttcagaagtgactgggagctggtgaaggtggacttccggcccagcttcagccggcagtgtggggaggaggactacagctcctgggagctgagcaacctgcagggcgaccgctgcatcatgggccagcagaggagcttcaggaagaggaagagcacctcctggtgcatcaagggccgctccttcaccagcgccctgaccagccgggtgtgtgagtgccgggacagcgacttcctgtgtgactatggctttgagaggagcagcagcagcgagagcagcaccaacaagtgcagcgccaacttctggttcaaccccctgagccccccagatgactgtgccctgggccagacctacaccagcagcctgggctacaggaaggtggtgtccaatgtgtgtgagggcggcgtggacatgcagcagagccaggtgcagctgcagtgccccctgaccccaccccggggcctgcaggtgtccatccagggcgaggccgtggccgtgcggcctggagaagatgtgctgtttgtggtgcggcaggagcagggagatgtgctgaccaccaagtaccaggtggacctgggagatggcttcaaggccatgtatgtgaacctgaccctgaccggggagcccatccgccacagatatgagagccctggcatctacagagtgtctgtgcgggcagaaaatacagctggccatgatgaagctgtgctgtttgtgcaggtgaacagccccctgcaggccctgtacctggaggtggtgcctgtgattggcctgaaccaggaggtgaacctgacagctgtgctgctgcccctgaaccccaacctgaccgtcttctactggtggattggccacagcctgcagcccctgctgagcctggacaacagcgtgaccacccgcttcagtgacacaggagatgtgcgggtgacagtgcaggccgcctgtggcaacagcgtgctgcaggacagccgggtgctgcgggtgctggaccagttccaggtgatgcccctgcagttcagcaaggagctggatgcctacaaccccaacaccccagagtggagagaagatgtgggcctggtggtgacccggctgctgagcaaggagacctctgtgccccaggagctgctggtgacagtggtgaagccaggcctgcccaccctggccgacctgtatgtgctgctgcccccaccccggcccaccaggaagaggagcctgagcagtgacaagaggctggccgccatccagcaggtgctgaatgcccagaagatctccttcctgctgcggggcggcgtgcgggtgctggtggccctgcgggacacaggaactggagctgagcagctgggcggcggcggcggctactgggccgtggtggtgctgtttgtgattggcctgtttgctgctggggccttcatcctgtacaagttcaagaggaagaggcctggccgcacagtgtatgcccagatgcacaatgagaaggagcaggagatgaccagccctgtgagccacagtgaagatgtgcagggcgctgtgcagggcaaccacagcggcgtggtgctgagcatcaacagccgggagatgcacagctacctggtgtcctag

SEQ ID NO: 171148 - DNA, 594 bp, Artificial Sequence
  Description of Artificial Sequence: Synthetic coding sequence
atgggagagaggaagatcttcaagaagaggaagccaggggcccagtgtgccctgggccgggaccacagcggctctgtggtgtctgagccctgtgtgtgtgccaactgggactttgaatgtgactatggctatgaaagacatggagagagccagtgtgtgcctgccttctggtacaacccagccagccccagcaaggactgcagcctgggccagagctacctgaacagcacaggctaccgccgcatcgtgagcaacaactgcacagatggcctgcgggagaagtacacagccaaggcccagatgtgccctgggaaggccccccggggcctgcacgtggtgaccacagatggccgcctggtggccgagcagggccacaatgccaccttcatcatcctgatggaggagggggacctgcagaggaccaacatccagctggactttggagatggcattgctgtgtcctatgccaacttcagccccattgaagatggcatcaagcacgtgtacaagtctgctggcatcttccaggtgacagcctatgcagagaacaacctgggcagtgacacagctgtgctcttcctgcacgtggtgtag

SEQ ID NO: 171149 - DNA, 3669 bp, Artificial Sequence
  Description of Artificial Sequence: Synthetic coding sequence
atggaggccgccaggacagagaggcctgctggccggcctggggcccccctggtgaggacaggcctgctgctgctgagcacctgggtgctggccggggctgagatcacctgggatgccaccggcggccctggccggcctgctgccccagccagccggcccccagccctgagccccctgagccccagggctgtggccagccagtggccagaggagctggccagcgcccggcgggctgctgtgctgggcagaagagctggccctgagctgctgccccagcagggcggcggccggggcggggagatgcaggtggaggccggcggcaccagccctgctggggagcggcggggccggggcatcccagccccagccaagctgggcggggcccggcgcagccggcgggcccagccccccatcacccaggagagaggagatgcctgggccacagccccagcagatggcagccggggcagccggcccctggccaagggcagccgggaggaggtgaaggcccccagggctgggggcagcgctgctgaggacctgcggctgcccagcaccagctttgccctgactggagacagcgcccacaaccaggccatggtgcactggagcggccacaacagcagcgtcatcctgatcctgaccaagctgtatgacttcaacctgggctctgtgacagagagcagcctgtggaggagcacagattatggcaccacctatgagaagctgaatgacaaggtgggcctgaagacagtgctgagctacctgtatgtgaaccccaccaacaagaggaagatcatgctgctgagtgaccctgagatggagagcagcatcctgatcagcagtgatgaaggagccacctaccagaagtaccgcctgaccttctacatccagagcctgctcttccaccccaagcaggaggactgggtgctggcctacagcctggaccagaagctgtacagctccatggactttggaagacgctggcagctgatgcatgagcgcatcacccccaaccgcttctactggagcgtggccggcctggacaaggaggccgacctggtgcacatggaggtgaggaccacagatggctacgcccactacctgacctgccgcatccaggagtgtgccgagaccaccaggagcggcccctttgcccggagcattgacatcagcagcctggtggtgcaggatgagtacatcttcatccaggtgaccaccagcggccgggccagctactacgtgtcctaccgccgggaggcctttgcccagatcaagctgcccaagtacagcctgcccaaggacatgcacatcatcagcacagatgagaaccaggtgtttgctgctgtgcaggagtggaaccagaatgacacctacaacctgtacatcagtgacacccggggcatctacttcaccctggccatggagaacatcaagagcagccggggcctgatgggcaacatcatcatcgagctgtatgaggtggccggcatcaagggcatcttcctggccaacaagaaggtggatgaccaggtgaagacctacatcacctacaacaagggccgggactggaggctgctgcaggccccagatgtggacctgcggggcagccctgtgcactgcctgctgcccttctgcagcctgcacctgcacctgcagctgtctgagaacccctacagcagcggccgcatcagcagcaaggagacagcccctggcctggtggtggccactggaaacatcggccctgagctgagctacacagacattggagtcttcatcagcagtgatggcggcaacacctggaggcagatctttgatgaggagtacaacgtgtggttcctggactggggcggggccctggtggccatgaagcacacccccctgcctgtgcgccacctgtgggtgtcctttgatgagggccacagctgggacaagtatggcttcacctctgtgcccctgtttgtggatggagccctggtggaggccggcatggagacccacatcatgacagtgtttggccacttcagcctgcggtctgagtggcagctggtgaaggtggactacaagagcatcttcagccgccactgcaccaaggaggactaccagacctggcacctgctgaaccagggcgagccctgtgtgatgggagagaggaagatcttcaagaagaggaagccaggggcccagtgtgccctgggccgggaccacagcggctctgtggtgtctgagccctgtgtgtgtgccaactgggactttgaatgtgactatggctatgaaagacatggagagagccagtgtgtgcctgccttctggtacaacccagccagccccagcaaggactgcagcctgggccagagctacctgaacagcacaggctaccgccgcatcgtgagcaacaactgcacagatggcctgcgggagaagtacacagccaaggcccagatgtgccctgggaaggccccccggggcctgcacgtggtgaccacagatggccgcctggtggccgagcagggccacaatgccaccttcatcatcctgatggaggagggggacctgcagaggaccaacatccagctggactttggagatggcattgctgtgtcctatgccaacttcagccccattgaagatggcatcaagcacgtgtacaagtctgctggcatcttccaggtgacagcctatgcagagaacaacctgggcagtgacacagctgtgctcttcctgcacgtggtgtgccctgtggagcacgtgcacctgcgggtgccctttgtggccatccggaacaaggaggtgaacatctctgctgtggtgtggcccagccagctgggcaccctgacctacttctggtggtttggaaacagcaccaagcccctcatcaccctggacagcagcatctccttcaccttcctggccgagggcacagacaccatcaccgtgcaggtggccgctggaaatgccctgatccaggacaccaaggagattgctgtgcatgagtacttccagagccagctgctgtccttcagccccaacctggactaccacaacccagacatccctgagtggaggaaggacattggaaatgtcatcaagagggccctggtgaaggtgacctctgtgcctgaggaccagatcctgattgctgtgtttcctggcctgcccaccagcgctgagctgttcatcctgccccccaagaacctgacagaaagaagaaaaggaaatgaaggagacctggagcagatcgtggagaccctcttcaatgccctgaaccagaacctggtgcagtttgagctgaagccaggagtgcaggtgattgtgtatgtgacccagctgaccctggcccccctggtggacagcagcgctggccacagcagcagcgccatgctgatgctgctgtctgtggtgtttgtgggcctggccgtgttcctgatctacaagttcaagaggaagatcccctggatcaacatctatgcccaggtgcagcacgacaaggagcaggagatgattggctctgtgtcccagagtgaaaatgcccccaagatcaccctgagtgacttcacagagcctgaggagctgctggacaaggagctggacaccagggtgattggaggcatcgccaccatcgccaacagcgagagcaccaaggagatccccaactgcacctctgtgtag

SEQ ID NO: 171150 - DNA, 462 bp, Artificial Sequence
  Description of Artificial Sequence: Synthetic coding sequence
gaaaacccctacagcagcggccgcatcagcagcaaggagacagcccctggcctggtggtggccaccggcaacatcggccctgagctgagctacacagacatcggggtcttcatcagcagtgatggcggcaacacctggaggcagatctttgatgaggagtacaacgtgtggttcctggactggggcggggccctggtggccatgaagcacacccccctgcctgtgcgccacctgtgggtgtcctttgatgagggccacagctgggacaagtatggcttcacctctgtgcccctgtttgtggatggagccctggtggaggccggcatggagacccacatcatgacagattatggctatgagcggcacggggagagccagtgtgtgcctgccttctggtacaacccagccagccccagcaaggactgcagcctgggccagagctacctgaacagcactggatag

SEQ ID NO: 171151 - DNA, 1410 bp, Artificial Sequence
  Description of Artificial Sequence: Synthetic coding sequence
atgggcaccgtgcacgcccggagcctggagcccctgcccagcagcggccctgactttggaggcctgggggaggaggccgagtttgtggaggtggagcctgaggccaagcaggagatcctggagaacaaggatgtggtggtgcagcacgtgcactttgatggcctgggccgcaccaaggatgacatcatcatctgtgaaattggagatgtgttcaaggccaagaacctgattgaggtgatgaggaagagccatgaggcccgggagaagctgctgcggctgggcatcttccggcaggtggatgtgctgattgacacctgccagggagatgatgccctgcccaacggcctggatgtgacctttgaggtgacagagctgcggcggctgaccggcagctacaacaccatggtgggcaacaatgaaggctccatggtgctgggcctgaagctgcccaacctgctgggccgggcagagaaggtgaccttccagttctcctatggcaccaaggagaccagctatggcctgtccttcttcaagcccaggcctggcaactttgagaggaacttctctgtgaacctgtacaaggtgacaggccagttcccctggagcagcctgcgggagacagaccggggcatgtctgctgagtacagcttccccatctggaagaccagccacacagtgaagtgggagggcgtgtggagggagctgggctgcctgagcaggacagccagctttgctgtgaggaaggagagcggccacagcctgaagagcagcctgagccacgccatggtgattgacagcaggaacagcagcatcctgccccggcggggggccctgctgaaggtgaaccaggagctggccggctacacaggaggagatgtgtccttcatcaaggaggactttgagctgcagctgaacaagcagctgatctttgacagcgtcttcagcgccagcttctggggcggcatgctggtgcccatcggggacaagcccagcagcattgctgaccgcttctacctgggcggccccaccagcatccggggcttctccatgcacagcatcggcccccagagcgagggggactacctgggcggggaggcctactgggccggcggcctgcacctgtacacccccctgcccttccggcccggccagggcggctttggagagctgttccgcacccacttcttcctgaatgccggcaacctgtgcaacctgaactatggagagggccccaaggcccacatcaggaagctggccgagtgcatccgctggagctatggagctggcatcgtgctgcggctgggcaacatcgcccggctggagctgaactactgtgtgcccatgggcgtgcagacaggagaccgcatctgtgatggagtgcagtttggagctggcatccgcttcctgtag

SEQ ID NO: 171152 - DNA, 780 bp, Artificial Sequence
  Description of Artificial Sequence: Synthetic coding sequence
atgtctgctgagtacagcttccccatctggaagaccagccacacagtgaagtgggagggcgtgtggagggagctgggctgcctgagcaggacagccagctttgctgtgaggaaggagagcggccacagcctgaagagcagcctgagccacgccatggtgattgacagcaggaacagcagcatcctgccccggcggggggccctgctgaaggtgaaccaggagctggccggctacacaggaggagatgtgtccttcatcaaggaggactttgagctgcagctgaacaagcagctgatctttgacagcgtcttcagcgccagcttctggggcggcatgctggtgcccatcggggacaagcccagcagcattgctgaccgcttctacctgggcggccccaccagcatccggggcttctccatgcacagcatcggcccccagagcgagggggactacctgggcggggaggcctactgggccggcggcctgcacctgtacacccccctgcccttccggcccggccagggcggctttggagagctgttccgcacccacttcttcctgaatgccggcaacctgtgcaacctgaactatggagagggccccaaggcccacatcaggaagctggccgagtgcatccgctggagctatggagctggcatcgtgctgcggctgggcaacatcgcccggctggagctgaactactgtgtgcccatgggcgtgcagacaggagaccgcatctgtgatggagtgcagtttggagctggcatccgcttcctgtag

SEQ ID NO: 171153 - DNA, 1425 bp, Artificial Sequence
  Description of Artificial Sequence: Synthetic coding sequence
atggccagcggcggcggcggctgcagcgccagcgagcggctgcccccacccttccctggcctggagcctgagagcgagggcgctgctgggggcagcgagcctgaggccggggacagcgacacagaaggagaggacatcttcaccggggctgctgtggtgtccaagcaccagagccccaagatcaccaccagcctgctgcccatcaacaacggcagcaaagaaaatggcatccacgaggagcaggaccaggagccccaggacctgtttgctgatgccaccgtggagctgagcctggacagcacccagaacaaccagaagaaggtgctggccaagaccctcatcagcctgcccccccaggaggccaccaacagcagcaagccccagcccacctatgaggagctggaggaggaggagcaggaggaccagtttgacctgactgtgggcatcacagatcctgagaagattggagatggcatgaatgcctacgtggcctacaaggtgaccacccagaccagcctgcccctcttccgcagcaagcagtttgctgtgaagaggcgcttcagtgacttcctgggcctgtatgagaagctgtctgagaagcacagccagaatggcttcatcgtgcccccacctcctgagaagagcctgattggcatgaccaaggtgaaggtgggcaaggaggacagcagcagcgctgagttcctggagaagaggcgggccgccctggagcgctacctgcagagaattgtgaaccaccccaccatgctgcaggaccctgatgtgcgggagttcctggagaaggaggagctgcccagggctgtgggcacccagaccctgagcggggccggcctgctgaagatgttcaacaaggccacagatgctgtgtccaagatgaccatcaagatgaatgaaagtgacatctggtttgaggagaagctgcaggaggtggagtgtgaggagcagaggctgaggaagctgcatgctgtggtggagaccctggtgaaccacaggaaggagctggccctgaacacagcccagtttgccaagagcctggccatgctgggcagcagcgaggacaacacagccctgagccgggccctgagccagctggccgaggtggaggagaagattgagcagctgcaccaggagcaggccaacaatgacttcttcctgctggccgagctgctgagtgactacatccggctgctggccatcgtgcgctgggagagccgggtgacccagtatgagcgggactttgagcgcatcagcacagtggtgaggaaggaggtgatccgctttgagaaggagaagagcaaggacttcaagaaccacgtgatcaagtacctggagaccctgctgtacagccagcagcagctggccaagtactgggaggccttcctgcctgaggccaaggccatctcctag

SEQ ID NO: 171154 - DNA, 1569 bp, Artificial Sequence
  Description of Artificial Sequence: Synthetic coding sequence
atggccagcggcggcggcggctgcagcgccagcgagcggctgcccccacccttccctggcctggagcctgagagcgagggcgctgctgggggcagcgagcctgaggccggggacagcgacacagaaggagaggacatcttcaccggggctgctgtggtgtccaagcaccagagccccaagatcaccaccagcctgctgcccatcaacaacggcagcaaagaaaatggcatccacgaggagcaggaccaggagccccaggacctgtttgctgatgccaccgtggagctgagcctggacagcacccagaacaaccagaagaaggtgctggccaagaccctcatcagcctgcccccccaggaggccaccaacagcagcaagccccagcccacctatgaggagctggaggaggaggagcaggaggaccagtttgacctgactgtgggcatcacagatcctgagaagattggagatggcatgaatgcctacgtggcctacaaggtgaccacccagaccagcctgcccctcttccgcagcaagcagtttgctgtgaagaggcgcttcagtgacttcctgggcctgtatgagaagctgtctgagaagcacagccagaatggcttcatcgtgcccccacctcctgagaagagcctgattggcatgaccaaggtgaaggtgggcaaggaggacagcagcagcgctgagttcctggagaagaggcgggccgccctggagcgctacctgcagagaattgtgaaccaccccaccatgctgcaggaccctgatgtgcgggagttcctggagaaggaggagctgcccagggctgtgggcacccagaccctgagcggggccggcctgctgaagatgttcaacaaggccacagatgctgtgtccaagatgaccatcaagatgaatgaaagtgacatctggtttgaggagaagctgcaggaggtggagtgtgaggagcagaggctgaggaagctgcatgctgtggtggagaccctggtgaaccacaggaaggagctggccctgaacacagcccagtttgccaagagcctggccatgctgggcagcagcgaggacaacacagccctgagccgggccctgagccagctggccgaggtggaggagaagattgagcagctgcaccaggagcaggccaacaatgacttcttcctgctggccgagctgctgagtgactacatccggctgctggccatcgtgcgggccgcctttgaccagaggatgaagacctggcagcgctggcaggatgcccaggccaccctgcagaagaagcgggaggccgaggcccggctgctgtgggccaacaagccagacaagctgcagcaggccaaggatgagatcctggagtgggagagccgggtgacccagtatgagcgggactttgagcgcatcagcacagtggtgaggaaggaggtgatccgctttgagaaggagaagagcaaggacttcaagaaccacgtgatcaagtacctggagaccctgctgtacagccagcagcagctggccaagtactgggaggccttcctgcctgaggccaaggccatctcctag

SEQ ID NO: 171155 - DNA, 1374 bp, Artificial Sequence
  Description of Artificial Sequence: Synthetic coding sequence
atggccagcggcggcggcggctgcagcgccagcgagcggctgcccccacccttccctggcctggagcctgagagcgagggcgctgctgggggcagcgagcctgaggccggggacagcgacacagaaggagaggacatcttcaccggggctgctgtggtgtccaagcaccagagccccaagatcaccaccagcctgctgcccatcaacaacggcagcaaagaaaatggcatccacgaggagcaggaccaggagccccaggacctgtttgctggagatggcatgaatgcctacgtggcctacaaggtgaccacccagaccagcctgcccctcttccgcagcaagcagtttgctgtgaagaggcgcttcagtgacttcctgggcctgtatgagaagctgtctgagaagcacagccagaatggcttcatcgtgcccccacctcctgagaagagcctcatcggcatgaccaaggtgaaggtgggcaaggaggacagcagcagcgctgagttcctggagaagagaagagctgccctggagcgctacctgcagagaattgtgaaccaccccaccatgctgcaggaccctgatgtgcgggagttcctggagaaggaggagctgcccagggctgtgggcacccagaccctgtctggagctggcctgctgaagatgttcaacaaggccacagatgctgtgtccaagatgaccatcaagatgaatgaaagtgacatctggtttgaggagaagctgcaggaggtggagtgtgaggagcagaggctgaggaagctgcatgctgtggtggagaccctggtgaaccacaggaaggagctggccctgaacacagcccagtttgccaagagcctggccatgctgggcagcagcgaggacaacacagccctgagccgggccctgagccagctggccgaggtggaggagaagattgagcagctgcaccaggagcaggccaacaatgacttcttcctgctggccgagctgctgagtgactacatccggctgctggccatcgtgcgggccgcctttgaccagaggatgaagacctggcagcgctggcaggatgcccaggccaccctgcagaagaagcgggaggccgaggcccggctgctgtgggccaacaagccagacaagctgcagcaggccaaggatgagatcctggagtgggagagccgggtgacccagtatgaaagagactttgagcgcatcagcacagtggtgaggaaggaggtgatccgctttgagaaggagaagagcaaggacttcaagaaccacgtgatcaagtacctggagaccctgctgtacagccagcagcagctggccaagtactgggaggccttcctgcctgaggccaaggccatctcctag

SEQ ID NO: 171156 - DNA, 1374 bp, Artificial Sequence; identical to SEQ ID NO: 171155
  Description of Artificial Sequence: Synthetic coding sequence

SEQ ID NO: 171157 - DNA, 3018 bp, Artificial Sequence
  Description of Artificial Sequence: Synthetic coding sequence
atggccgcccggcccagccgggccaccggcccccggggcggccagaggagccgggtgaagcccccacctggaagaaggctgaaggagcagctgccccccctggccgccgcccgggctgtgtttgctgctgccacagctgtgatcatgctgacagaggccagcctgagcatctggggctggggcagcctgggcatcgtgctcttcctgatcaccttcggcccctttgtgatcttctacctgaccttctacatcctgtgctttgtgggcggcggcctggtggtgaccctgctgtttgggaagaccaacagcgagaagtacctggagcagtgtgagcacagcttcctgccccccaccagccctggggtgcccaagtgcctggaggagatgaagcgggaggcccggaccatcaagattgaccggcggctgactggagccaacatcattgatgagcccctgcagcaggtgatccagttcagcctgcgggactatgtgcagtactggtactacaccctgagtgatgatgagagcttcctgctggagatccggcagaccctgcagaatgccctgatccagtttgccaccaggagcaaggagattgactggcagccctacttcaccaccagaattgtggatgactttggcacccacctgcgggtcttcaggaaggcccagcagaagatcacagagaaggatgaccaggtgaagggcacagctgaggacctggtggacaccttctttgaggtggaggtggagatggagaaggaggtgtgccgggacctggtgtgcaccagccccaaggatgaggagggcttcctgcgggacctgtgtgaggtgctgctgtacctgctgctgcccccaggggacttccagaacaagatcatgagatactttgtgcgggagatcctggcccggggcatcctgctgcccctcatcaaccagctgagtgaccctgactacatcaaccagtatgtgatctggatgatccgggacagcaactgcaactatgaggccttcatgaacatcatcaagctgagtgacaacatcggggagctggaggccgtgcgggacaaggctgctgaggagctgcagtacctgcggagcctggacacagctggagatgacatcaacaccatcaagaaccagatcaacagcctgctgtttgtgaagaaggtgtgtgacagccgcatccagaggctgcagagcggcaaggagatcaacacagtgaagctggccgccaactttgggaagctgtgcaccgtgcccctggacagcatcctggtggacaacgtggccctgcagttcttcatggactacatgcagcagacaggaggccaggcccacctgttcttctggatgacagtggagggctacagagtgacagcccagcagcagctggaggtgctgctgagccggcagagagatggcaagcaccagaccaaccagaccaagggcctgctgcgggctgctgctgtgggcatctatgagcagtacctgtctgagaaggccagcccccgggtgacagtggatgactacctggtggccaagctggccgacaccctgaaccacgaggaccccaccccagagatctttgatgacatccagaggaaggtgtatgagctgatgctgagagatgagcgcttctaccccagcttccggcagaatgccctgtatgtgaggatgctggccgagctggacatgctgaaggaccccagcttccggggcagtgatgatggagatggagagagcttcaacggcagccccaccggcagcatcaacctgagcctggatgacctgagcaatgtgtccagtgatgacagcgtgcagctgcacgcctacatcagtgacaccggggtgtgcaatgaccacggcaagacctacgccctgtatgccatcaccgtgcacagaagaaacctgaacagcgaggagatgtggaagacctaccgccgctacagcgacttccatgacttccacatgaggatcacagagcagtttgagagcctgagcagcatcctgaagctgcccgggaagaagaccttcaacaacatggaccgggacttcctggagaagaggaagaaggacctgaatgcctacctgcagctgctgctggcccctgagatgatgaaggccagccctgccctggcccactacgtgtatgacttcctggagaacaaggcctacagcaagggcaagggggactttgccaggaagatggacacctttgtgaaccccctgagaaattccatgagaaatgtgtccaatgctgtgaagagcctgcctgacagcctggccgagggcatgaccaagatgtctgacaacatgggcaagatgtctgagcggctgggccaggacatcaagcagagcttcttcaaggtgcccccactcatccccaagacagacagcgaccctgagcacagaagagtgtctgcccagctggatgacaacgtggatgacaacatccccctgcgggtgatgctgctgctgatggatgaggtgtttgacctgaaggagaggaaccagtggctgcggaggaacatcaagaacctgctgcagcagctgatccgggccacctatggagacaccatcaacaggaagatcgtggaccacgtggactggatgaccagccctgagcaggtggccgacagcgtgaagcgcttcagagatgccttctggcccaacggcatcctggccgaggccgtgccctgccgggacaagagcatccgcatgaggaccagggtggccggcaagaccaagctgctggccatcatgccagatgagctgaagcacatcatcggggctgagaccaccaggaagggcatcctgcgggtgtttgagatgttccagcacaaccagctgaacagaaggatggtgtatgtgttcctggagggcttcctggagaccctcttcccccagtacaagttccgggagctgttcaacaagctgcacagccgcagcaagcagatgcagaagtacaagcagaagctgcagaccacccaggcccccagcctgcagaagaggtag

SEQ ID NO: 171158 - DNA, 2874 bp, Artificial Sequence
  Description of Artificial Sequence: Synthetic coding sequence
atgctgacagaggccagcctgagcatctggggctggggcagcctgggcatcgtgctcttcctgatcaccttcggcccctttgtgatcttctacctgaccttctacatcctgtgctttgtgggcggcggcctggtggtgaccctgctgtttgggaagaccaacagcgagaagtacctggagcagtgtgagcacagcttcctgccccccaccagccctggggtgcccaagtgcctggaggagatgaagcgggaggcccggaccatcaagattgaccggcggctgactggagccaacatcattgatgagcccctgcagcaggtgatccagttcagcctgcgggactatgtgcagtactggtactacaccctgagtgatgatgagagcttcctgctggagatccggcagaccctgcagaatgccctgatccagtttgccaccaggagcaaggagattgactggcagccctacttcaccaccagaattgtggatgactttggcacccacctgcgggtcttcaggaaggcccagcagaagatcacagagaaggatgaccaggtgaagggcacagctgaggacctggtggacaccttctttgaggtggaggtggagatggagaaggaggtgtgccgggacctggtgtgcaccagccccaaggatgaggagggcttcctgcgggacctgtgtgaggtgctgctgtacctgctgctgcccccaggggacttccagaacaagatcatgagatactttgtgcgggagatcctggcccggggcatcctgctgcccctcatcaaccagctgagtgaccctgactacatcaaccagtatgtgatctggatgatccgggacagcaactgcaactatgaggccttcatgaacatcatcaagctgagtgacaacatcggggagctggaggccgtgcgggacaaggctgctgaggagctgcagtacctgcggagcctggacacagctggagatgacatcaacaccatcaagaaccagatcaacagcctgctgtttgtgaagaaggtgtgtgacagccgcatccagaggctgcagagcggcaaggagatcaacacagtgaagctggccgccaactttgggaagctgtgcaccgtgcccctggacagcatcctggtggacaacgtggccctgcagttcttcatggactacatgcagcagacaggaggccaggcccacctgttcttctggatgacagtggagggctacagagtgacagcccagcagcagctggaggtgctgctgagccggcagagagatggcaagcaccagaccaaccagaccaagggcctgctgcgggctgctgctgtgggcatctatgagcagtacctgtctgagaaggccagcccccgggtgacagtggatgactacctggtggccaagctggccgacaccctgaaccacgaggaccccaccccagagatctttgatgacatccagaggaaggtgtatgagctgatgctgagagatgagcgcttctaccccagcttccggcagaatgccctgtatgtgaggatgctggccgagctggacatgctgaaggaccccagcttccggggcagtgatgatggagatggagagagcttcaacggcagccccaccggcagcatcaacctgagcctggatgacctgagcaatgtgtccagtgatgacagcgtgcagctgcacgcctacatcagtgacaccggggtgtgcaatgaccacggcaagacctacgccctgtatgccatcaccgtgcacagaagaaacctgaacagcgaggagatgtggaagacctaccgccgctacagcgacttccatgacttccacatgaggatcacagagcagtttgagagcctgagcagcatcctgaagctgcccgggaagaagaccttcaacaacatggaccgggacttcctggagaagaggaagaaggacctgaatgcctacctgcagctgctgctggcccctgagatgatgaaggccagccctgccctggcccactacgtgtatgacttcctggagaacaaggcctacagcaagggcaagggggactttgccaggaagatggacacctttgtgaaccccctgagaaattccatgagaaatgtgtccaatgctgtgaagagcctgcctgacagcctggccgagggcatgaccaagatgtctgacaacatgggcaagatgtctgagcggctgggccaggacatcaagcagagcttcttcaaggtgcccccactcatccccaagacagacagcgaccctgagcacagaagagtgtctgcccagctggatgacaacgtggatgacaacatccccctgcgggtgatgctgctgctgatggatgaggtgtttgacctgaaggagaggaaccagtggctgcggaggaacatcaagaacctgctgcagcagctgatccgggccacctatggagacaccatcaacaggaagatcgtggaccacgtggactggatgaccagccctgagcaggtggccgacagcgtgaagcgcttcagagatgccttctggcccaacggcatcctggccgaggccgtgccctgccgggacaagagcatccgcatgaggaccagggtggccggcaagaccaagctgctggccatcatgccagatgagctgaagcacatcatcggggctgagaccaccaggaagggcatcctgcgggtgtttgagatgttccagcacaaccagctgaacagaaggatggtgtatgtgttcctggagggcttcctggagaccctcttcccccagtacaagttccgggagctgttcaacaagctgcacagccgcagcaagcagatgcagaagtacaagcagaagctgcagaccacccaggcccccagcctgcagaagaggtag

SEQ ID NO: 171159 - DNA, 771 bp, Artificial Sequence
  Description of Artificial Sequence: Synthetic coding sequence
atgagccggcaggccaaggatgacttcctgcggcactacacagtgtctgaccccaggacccaccccaagggctacacagagtacaaggtgacagcccagttcatcagcaagaaggaccctgaagatgtgaaggaggtggtggtgtggaagcgctacagcgacttcaggaagctgcatggagacctggcctacacccacaggaacctcttccggcggctggaggagttccctgccttcccccgggcccaggtgtttggccgctttgaggcctctgtgattgaggagaggaggaaaggagctgaggacctgctgcgcttcaccgtgcacatcccagccctgaacaacagcccccagctgaaggagttcttccggggcggggaggtgacccggcccctggaggtgtcccgggacctgcacatcctgcccccacccctcatccccaccccacctccagatgacccccggctgagccagctgctgcctgctgagcggcggggcctggaggagctggaggtgcctgtggaccccccacccagcagccctgcccaggaggccctggacctgctcttcaactgtgagagcacagaggaggccagcggcagccctgcccggggccccctgacagaggccgagctggccctgtttgaccccttcagcaaggagggggaccccctgcctgcccggcaggagggcgtgaagaagaaggctgctgagtacctgaagagagctgaggagatcctgcggctgcacctgagccagctgcccccatag

SEQ ID NO: 171160 - DNA, 1029 bp, Artificial Sequence
  Description of Artificial Sequence: Synthetic coding sequence
atgagccggcaggccaaggatgacttcctgcggcactacacagtgtctgaccccaggacccaccccaagggctacacagagtacaaggtgacagcccagttcatcagcaagaaggaccctgaagatgtgaaggaggtggtggtgtggaagcgctacagcgacttcaggaagctgcatggagacctggcctacacccacaggaacctcttccggcggctggaggagttccctgccttcccccgggcccaggtgtttggccgctttgaggcctctgtgattgaggagaggaggaaaggagctgaggacctgctgcgcttcaccgtgcacatcccagccctgaacaacagcccccagctgaaggagttcttccggggcggggaggtgacccggcccctggaggtgtcccgggacctgcacatcctgcccccacccctcatccccaccccacctccagatgacccccggctgagccagctgctgcctgctgagcggcggggcctggaggagctggaggtgcctgtggaccccccacccagcagccctgcccaggaggccctggacctgctcttcaactgtgagagcacagaggaggccagcggcagccctgcccggggccccctgacagaggccgagctggccctgtttgaccccttcagcaaggaggagggcgccgcccccagccccacccacgtggccgagctggccaccatggaggtggagagcgcccggctggaccaggagccctgggagcccggcggccaggaggaggaggaggatggagagggcggccccaccccagcctacctgagccaggccacagagctgatcacccaggccctgagagatgagaaggccggggcctatgctgctgccctgcagggctacagagatggagtgcacgtgctgctgcagggcgtgcccagcgaccccctgcctgcccggcaggagggcgtgaagaagaaggctgctgagtacctgaagagagctgaggagatcctgcggctgcacctgagccagctgcccccatag

SEQ ID NO: 171161 - DNA, 1608 bp, Artificial Sequence
  Description of Artificial Sequence: Synthetic coding sequence
atgtctgagggggagagccagacagtgctgagcagcggcagtgaccccaaggtggagagcagcagcagcgcccctggcctgacctctgtgagcccccctgtgaccagcaccaccagcgctgccagccctgaggaggaggaggagagtgaagatgaaagtgagatcctggaggagagcccctgtggccgctggcagaagagaagagaggaggtgaaccagagaaatgtgcccggcattgattctgcctacctggccatggacacagaggagggcgtggaggtggtgtggaatgaggtgcagttcagcgagaggaagaactacaagctgcaggaggagaaggtgcgggctgtgtttgacaacctgatccagctggagcacctgaacatcgtgaagttccacaagtactgggccgacatcaaggagaacaaggcccgggtcatcttcatcacagagtacatgagcagcggcagcctgaagcagttcctgaagaagaccaagaagaaccacaagaccatgaatgagaaggcctggaagcgctggtgcacccagatcctgagcgccctgagctacctgcacagctgtgacccccccatcatccacggcaacctgacctgtgacaccatcttcatccagcacaacggcctcatcaagattggctctgtggccccagacaccatcaacaaccacgtgaagacctgccgggaggagcagaagaacctgcacttctttgccccagaatatggagaggtgaccaacgtgaccacagctgtggacatctacagctttggcatgtgtgccctggagatggctgtgctggagatccagggcaatggagagagcagctatgtgccccaggaggccatcagcagcgccatccagctgctggaggaccccctgcagcgggagttcatccagaagtgcctgcagagcgagcccgcccggcggcccacagcccgggagctgctcttccacccagccctgtttgaggtgcccagcctgaagctgctggccgcccactgcatcgtgggccaccagcacatgatcccagaaaatgccctggaggagatcaccaagaacatggacaccagcgctgtgctggccgagatcccagctggccctggccgggagcctgtgcagaccctgtacagccagagccctgccctggagctggacaagttcctggaggatgtgagaaatggcatctaccccctgacagccttcggcctgccccggccccagcagccccagcaggaggaggtgaccagccctgtggtgccccccagcgtgaagacccccaccccagagcctgctgaggtggagaccaggaaggtggtgctgatgcagtgcaacattgaatctgtggaggagggcgtgaagcaccacctgaccctgctgctgaagctggaggacaagctgaacagacacctgagctgtgacctgatgcccaatgaaaacatccctgagctggccgctgagctggtgcagctgggcttcatcagcgaggccgaccagagccggctgaccagcctgctggaggagaccctgaacaagttcaactttgccaggaacagcaccctgaacagcgctgctgtgacagtgagcagctag

SEQ ID NO: 171162 - DNA, 1338 bp, Artificial Sequence
  Description of Artificial Sequence: Synthetic coding sequence
atgcacttcagcatccctgagacagagagccgcagcggggacagcggcggcagcgcctacgtgctgaggaaggagtatggagccaacgtgctgcctgccttcccccccaagaagctgttcagcctgaccccagctgaggtggagcagaggcgggagcagctggagaagtacatgcaggccgtgcggcaggaccccctgctgggcagcagcgagaccttcaacagcttcctgcggcgggcccagcaggagacccagcaggtgcccacagaggaggtgtccctggaggtgctgctgagcaatggccagaaggtgctggtgaatgtgctgaccagtgaccagacagaagatgtgctggaggccgtggccgccaagctggacctgcctgatgacctgattggctacttcagcctcttcctggtgcgggagaaggaggatggagccttctcctttgtgaggaagctgcaggagtttgagctgccctacgtgtctgtgaccagcctgcggagccaggagtacaagatcgtgctgaggaagagctactgggacagcgcctatgatgatgatgtgatggagaacagagtgggcctgaacctgctgtatgcccagacagtgtctgacatcgagcggggctggatcctggtgaccaaggagcagcaccggcagctgaagagcctgcaggagaaggtgtccaagaaggagttcctgcggctggcccagaccctgcggcactacggctacctgcgctttgatgcctgtgtggccgacttccctgagaaggactgccctgtggtggtgtctgctggcaacagcgagctgagcctgcagctgcggctgcccggccagcagctgcgggagggcagcttccgggtgaccaggatgcgctgctggagggtgaccagctctgtgcccctgcccagcggcagcaccagcagccctggccggggccgcggggaggtgcggctggagctggcctttgagtacctgatgagcaaggaccggctgcagtgggtgaccatcaccagcccccaggccatcatgatgagcatctgcctgcagagcatggtggatgagctgatggtgaagaagagcggcggcagcatcaggaagatgctgcggaggagagtgggcggcaccctgcggcggagtgacagccagcaggccgtgaagagcccccccctgctggagagcccagatgccacccgggagagcatggtgaagctgagcagcaagctgtctgctgtgtccctgcggggcatcggcagccccagcacagatgccagcgccagtgatgtgcacggcaactttgcctttgagggcattggagatgaggacctgtag

SEQ ID NO: 171163 - DNA, 771 bp, Artificial Sequence
  Description of Artificial Sequence: Synthetic coding sequence
atggagaacagagtgggcctgaacctgctgtatgcccagacagtgtctgacatcgagcggggctggatcctggtgaccaaggagcagcaccggcagctgaagagcctgcaggagaaggtgtccaagaaggagttcctgcggctggcccagaccctgcggcactacggctacctgcgctttgatgcctgtgtggccgacttccctgagaaggactgccctgtggtggtgtctgctggcaacagcgagctgagcctgcagctgcggctgcccggccagcagctgcgggagggcagcttccgggtgaccaggatgcgctgctggagggtgaccagctctgtgcccctgcccagcggcagcaccagcagccctggccggggccgcggggaggtgcggctggagctggcctttgagtacctgatgagcaaggaccggctgcagtgggtgaccatcaccagcccccaggccatcatgatgagcatctgcctgcagagcatggtggatgagctgatggtgaagaagagcggcggcagcatcaggaagatgctgcggcggcgggtgggcggcaccctgcggcggagtgacagccagcaggccgtgaagagcccccccctgctggagagcccagatgccacccgggagagcatggtgaagctgagcagcaagctgtctgctgtgtccctgcggggcatcggcagccccagcacagatgccagcgccagtgatgtgcacggcaactttgcctttgagggcattggagatgaggacctgtag

SEQ ID NO: 171164 - DNA, 771 bp, Artificial Sequence; identical to SEQ ID NO: 171163
  Description of Artificial Sequence: Synthetic coding sequence

SEQ ID NO: 171165 - DNA, 1560 bp, Artificial Sequence
  Description of Artificial Sequence: Synthetic coding sequence
atggctgctgagcgggagcccccacccctgggagatggcaagcccacagactttgaggacctggaggatggagaagatctcttcaccagcacagtgtccaccctggagagcagccccagcagccctgagcccgccagcctgcctgctgaggacatcagcgccaacagcaatggccccaagcccacagaggtggtgctggatgatgaccgggaggacctgtttgctgaggccacagaggaggtgtccctggacagccctgagcgggagcccatcctgagcagcgagcccagccctgctgtgacccctgtgacccccaccaccctgattgcccccagaattgagagcaagtccatgtctgcccctgtgatctttgacaggagccgggaggagattgaggaggaggccaacggggacatctttgacatcgagattggagtgtctgaccctgagaaggtgggagatggcatgaatgcctacatggcctacagagtgaccaccaagaccagcctgtccatgttcagcaagtctgagttctctgtgaagaggcgcttcagtgacttcctgggcctgcacagcaagctggccagcaagtacctgcacgtgggctacatcgtgcccccagcccctgagaagagcatcgtgggcatgaccaaggtgaaggtgggcaaggaggacagcagcagcacagaatttgtggagaagagaagagctgccctggagcgctacctgcagaggacagtgaagcaccccaccctgctgcaggaccctgacctgcggcagttcctggagagcagcgagctgcccagggctgtgaacacccaggccctgtctggagctggcatcctgaggatggtgaacaaggctgctgatgctgtgaacaagatgaccatcaagatgaatgaaagtgatgcctggtttgaggagaagcagcagcagtttgagaacctggaccagcagctgaggaagctgcacgtgtctgtggaggccctggtgtgccacaggaaggagctgagcgccaacacagctgcctttgccaagtctgctgccatgctgggcaacagcgaggaccacacagccctgagccgggccctgagccagctggccgaggtggaggagaagattgaccagctgcaccaggagcaggcctttgctgacttctacatgttcagcgagctgctgagtgactacatccggctgattgctgctgtgaagggcgtgtttgaccacaggatgaagtgctggcagaagtgggaggatgcccagatcaccctgctgaagaagcgggaggccgaggccaagatgatggtggccaacaagccagacaagatccagcaggccaagaatgagatccgggagtgggaggccaaggtgcagcagggcgagcgggactttgagcagatcagcaagaccatcaggaaggaggtgggccgctttgagaaggagcgggtgaaggacttcaagacagtcatcatcaagtacctggagagcctggtgcagacccagcagcagctgatcaagtactgggaggccttcctgcctgaggccaaggccatcgcctag

SEQ ID NO: 171166 - DNA, 390 bp, Artificial Sequence
  Description of Artificial Sequence: Synthetic coding sequence
atggccagccctgagcaccctggcagccctggctgcatgggccccatcacccagtgcacagcccggacccagcaggaggccccagccaccggccctgacctgccccaccctggcccagatggccacctggacacccacagcggcctgagcagcaacagctccatgaccacccgggagctgcagcagtactggcagaaccagaagtgccgctggaagcacgtgaagctgctgtttgagatcgccagcgccagaattgaggagaggaaggtgtccaagtttgtgatgggcaagagcaggcctggagagatgacctacccaggcagcagaggagagaccggcacagcccctgagccagacccccgctgcccccggcagagcgacatgctgtag

SEQ ID NO: 171167 - DNA, 951 bp, Artificial Sequence
  Description of Artificial Sequence: Synthetic coding sequence
atggccagccctgagcaccctggcagccctggctgcatgggccccatcacccagtgcacagcccggacccagcaggaggccccagccaccggccctgacctgccccaccctggcccagatggccacctggacacccacagcggcctgagcagcaacagctccatgaccacccgggagctgcagcagtactggcagaaccagaagtgccgctggaagcacgtgaagctgctgtttgagatcgccagcgccagaattgaggagaggaaggtgtccaagtttgtggtgtaccagatcatcgtcatccagacaggcagctttgacaacaacaaggctgtgctggagcggcgctacagcgactttgccaagctgcagaaggccctgctgaagaccttccgggaggagattgaagatgtggagttccccaggaagcacctgaccggcaactttgctgaggagatgatctgtgaaagaagaagagccctgcaggagtacctgggcctgctgtatgccatccgctgtgtgagaagaagccgggagttcctggacttcctgaccaggcctgagctgcgggaggccttcggctgcctgcgggccggccagtacccccgggccctggagctgctgctgcgggtgctgcccctgcaggagaagctgacagcccactgcccagctgctgctgtgcctgccctgtgtgctgtgctgctgtgccaccgggacctggacaggcctgctgaggcctttgctgctggggagcgggccctgcagaggctgcaggcccgggagggccaccgctactatgcccccctgctggatgccatggtgcggctggcctatgccctgggcaaggactttgtgaccctgcaggagcggctggaggagagccagctgcggcggcccaccccccggggcatcaccctgaaggagctgactgtgcgggagtacctgcactag

SEQ ID NO: 171168 - DNA, 459 bp, Artificial Sequence
  Description of Artificial Sequence: Synthetic coding sequence
atggccagccctgagcaccctggcagccctggctgcatgggccccatcacccagtgcacagcccggacccagcaggaggccccagccaccggccctgacctgccccaccctggcccagatggccacctggacacccacagcggcctgagcagcaacagctccatgaccacccgggagctgcagcagtactggcagaaccagaagtgccgctggaagcacgtgaagctgctgtttgagatcgccagcgccagaattgaggagaggaaggtgtccaagtttgtggtgtaccagatcatcgtcatccagacaggcagctttgacaacaacaaggctgtgctggagcggcgctacagcgactttgtgaccctgcaggagcggctggaggagagccagctgcggcggcccaccccccggggcatcaccctgaaggagctgactgtgcgggagtacctgcactag

SEQ ID NO: 171169 - DNA, 309 bp, Artificial Sequence
  Description of Artificial Sequence: Synthetic coding sequence
atggccagccctgagcaccctggcagccctggctgcatgggccccatcacccagtgcacagcccggacccagcaggaggccccagccaccggccctgacctgccccaccctggcccagatggccacctggacacccacagcggcctgagcagcaacagctccatgaccacccgggagctgcagcagtactggcagaaccagaagtgccgctggaagcacgtgaagctgctgtttgagatcgccagcgccagaattgaggagaggaaggtgtccaagtttgtggccccagccccagatgccaccccctag

SEQ ID NO: 171170 - DNA, 807 bp, Artificial Sequence
  Description of Artificial Sequence: Synthetic coding sequence
atgcagcagatccggccccccttcatccggggccccccccaccacgccagcaaccccaacagccccctgagcaaccccatgctgcccggcatcggccccccacctgggggccccaggaacctgggccccaccagcagccccatgcaccggcccatgctgagcccccacatccacccccccagcacccccaccatgcctggcaaccccccaggcctgctgcccccacctcctcctggggcccccctgcccagcctgcccttcccccctgtgtccatgatgcccaacggccccatgcctgtgccccagatgatgaactttggcctgcccagcctggcccccctggtgcccccacccaccctgctggtgccctaccctgtgattgtgcccctgcctgtgcccatccccatccccatccccatcccccacgtgtctgacagcaagccacccaagaagctgctgagccctgaggagcctgctgtgtctgagctggagagcgtgaaggagaacaactgtgccagcaactgccacctggatggagaggccgccaagaagctgatgggagaggaggccctggccggcggggacaagagtgaccccaacctgaacaacccagcagatgaagatcatgcctatgccctgaggatgctgcccaagacaggctgtgtgatccagcctgtgcccaagccagctgagaaggccgccatggccccctgcatcatcagcagccccatgctgtctgctggccctgaggacctggagccccccctgaagaggcgctgcctgcgcatccggaaccagaacaagtag

SEQ ID NO: 171171 - DNA, 423 bp, Artificial Sequence
  Description of Artificial Sequence: Synthetic coding sequence
atggccgagaccgtggccgacaccaggaggctcatcaccaagccccagaacctgaatgatgcctacggcccccccagcaacttcctggagattgacaccaacctgcccatcttcaagctgaaggagagcacagtgagaagacgctacagcgactttgagtggctgcggtctgagctggagcgggagagcaaggtggtggtgccccccctgcccgggaaggccttcctgcggcagctgcccttcagaggagatgatggcatctttgatgacaacttcatcgaggagaggaagcagggcctggagcagttcatcaacaaggtggccggccaccccctggcccagaatgaacgctgcctgcacatgttcctgcaggatgagatcatcgacaagagctacacccccagcaagatcagacatgcctag

SEQ ID NO: 171172 - DNA, 342 bp, Artificial Sequence
  Description of Artificial Sequence: Synthetic coding sequence
atggccgagaccgtggccgacaccaggaggctcatcaccaagccccagaacctgaatgatgcctacggcccccccagcaacttcctggagattgatgtgagcaacccccagacagtgggcgtgggccggggccgcttcaccacctatgagatccgggtgaagaccaacctgcccatcttcaagctgaaggagagcacagtgagaagacgctacagcgactttgagtggctgcggtctgagctggagcgggagagcaagccctgcctgaggatgaccagcgaggcccggagccacggccgcacctggtgtgcccagaatgatgagaagctgttctgtgactag

SEQ ID NO: 171173 - DNA, 393 bp, Artificial Sequence
  Description of Artificial Sequence: Synthetic coding sequence
atggccgagaccgtggccgacaccaggaggctcatcaccaagccccagaacctgaatgatgcctacggcccccccagcaacttcctggagattgatgtgagcaacccccagacagtgggcgtgggccggggccgcttcaccacctatgagatccgggtgaaggtggtggtgccccccctgcccgggaaggccttcctgcggcagctgcccttcagaggagatgatggcatctttgatgacaacttcatcgaggagaggaagcagggcctggagcagttcatcaacaaggtggccggccaccccctggcccagaatgaacgctgcctgcacatgttcctgcaggatgagatcatcgacaagagctacacccccagcaagatcagacatgcctag

SEQ ID NO: 171174 - DNA, 1353 bp, Artificial Sequence
  Description of Artificial Sequence: Synthetic coding sequence
atggagcaggcccccccagaccctgagcggcagctgcagcctgcccccctggagcccctgggcagcccagatgctggcctgggcgctgctgtgggcaaggaggccgagggcgctggggaggagagcagtggagtggacaccatgacccacaacaacttctggctgaagaagattgagatctctgtgtctgaggccgagaagaggactggaagaaatgccatgaacatgcaggagacctacacagcctacctgattgagaccaggtctgtggagcacacagatggccagagcgtgctgacagacagcctgtggaggcgctacagcgagtttgagctgctgcggagctacctgctggtgtactacccccacatcgtggtgccccccctgcctgagaagagagctgagtttgtgtggcacaagctgtctgctgacaacatggaccctgactttgtggagcggcggcgcatcggcctggagaacttcctgctgagaattgccagccaccccatcctgtgccgggacaagatcttctacctgttcctgacccaggagggcaactggaaggagaccgtgaatgagaccggcttccagctgaaggctgacagccggctgaaggccctgaatgccaccttccgggtgaagaacccagacaagcgcttcacagacctgaagcactacagtgatgagctgcagagcgtcatcagccacctgctgcgggtgcgggcccgggtggccgaccggctgtatggagtgtacaaggtgcacggcaactacggccgggtcttcagcgagtggagcgccatcgagaaggagatgggagatggcctgcagagcgctggccaccacatggatgtgtatgccagcagcattgatgacatcctggaggatgaggagcactatgctgaccagctgaaggagtacctgttctatgcagaggccctgcgggctgtgtgcaggaagcatgagctgatgcagtatgacctggagatggccgcccaggacctggccagcaagaagcagcagtgtgaggagctggtgactggaacagtgaggaccttcagcctgaagggcatgaccaccaagctgtttggccaggagaccccagagcagcgggaggcccgcatcaaggtgctggaggagcagatcaatgaaggagagcagcagctgaagagcaagaacctggagggccgggagtttgtgaagaatgcctgggccgacatcgagcgcttcaaggagcagaagaacagagacctgaaggaggccctgatctcctatgctgtgatgcagatctccatgtgcaagaagggcatccaggtgtggaccaatgccaaggagtgcttcagcaagatgtag

SEQ ID NO: 171175 - DNA, 918 bp, Artificial Sequence
  Description of Artificial Sequence: Synthetic coding sequence
atggaccctgactttgtggagaggagaagaattggcctggagaacttcctgctgcgcatcgccagccaccccatcctgtgccgggacaagatcttctacctgttcctgacccaggagggcaactggaaggagaccgtgaatgaaacaggcttccagctgaaggctgacagccggctgaaggccctgaatgccaccttccgggtgaagaacccagacaagcgcttcacagacctgaagcactacagtgatgagctgcagagcgtcatcagccacctgctgcgggtgcgggcccgggtggccgaccggctgtatggagtgtacaaggtgcacggcaactacggccgggtcttcagcgagtggagcgccatcgagaaggagatgggagatggcctgcagagcgctggccaccacatggatgtgtatgccagcagcattgatgacatcctggaggatgaggagcactacgccgaccagctgaaggagtacctgttctacgccgaggccctgcgggctgtgtgcaggaagcatgagctgatgcagtatgacctggagatggccgcccaggacctggccagcaagaagcagcagtgtgaggagctggtgacaggcaccgtgaggaccttcagcctgaagggcatgaccaccaagctgtttggccaggagaccccagagcagcgggaggcccgcatcaaggtgctggaggagcagatcaatgaaggagagcagcagctgaagagcaagaacctggagggccgggagtttgtgaagaatgcctgggccgacatcgagcgcttcaaggagcagaagaacagagacctgaaggaggccctgatctcctatgctgtgatgcagatctccatgtgcaagaagggcatccaggtgtggaccaatgccaaggagtgcttcagcaagatgtag

SEQ ID NO: 171176 - DNA, 1215 bp, Artificial Sequence
  Description of Artificial Sequence: Synthetic coding sequence
atggctgctgtgcctgagctgctgcagcagcaggaggaggacaggagcaagctgcggtctgtgtctgtggacctgaatgtggaccccagcctgcagattgacatcccagatgccctgtctgagcgggacaaggtgaagttcaccgtgcacaccaagaccaccctgcccaccttccagagccctgagttctctgtgacccggcagcacgaggactttgtgtggctgcatgacaccctcatcgagaccacagattatgccggcctcatcatccccccagcccccaccaagccagactttgatggcccccgggagaagatgcagaagctgggggagggggagggctccatgaccaaggaggagtttgccaagatgaagcaggagctggaggccgagtacctggccgtgttcaagaagacagtgagcagccatgaggtgttcctgcagaggctgagcagccaccctgtgctgagcaaggacaggaacttccacgtgttcctggagtatgaccaggacctgtctgtgcggaggaagaacaccaaggagatgtttggaggcttcttcaagtctgtggtgaagtctgcagatgaggtgctcttcaccggggtgaaggaggtggatgacttctttgagcaggagaagaacttcctgatcaactactacaaccgcatcaaggacagctgtgtgaaggctgacaagatgaccaggagccacaagaatgtggctgatgactacatccacacagctgcctgcctgcacagcctggccctggaggagcccaccgtcatcaagaagtacctgctgaaggtggccgagctgtttgagaagctgaggaaggtggagggccgggtgtccagtgatgaggacctgaagctgacagagctgctgcgctactacatgctgaacatcgaggccgccaaggacctgctgtacagaaggaccaaggccctgattgattatgagaacagcaacaaggccctggacaaggcccggctgaagagcaaggatgtgaagctggccgaggcccaccagcaggagtgctgccagaagtttgagcagctgtctgagagcgccaaggaggagctgatcaacttcaagaggaagagggtggccgccttcaggaagaacctgattgagatgtctgagctggagatcaagcacgccaggaacaacgtgtccctgctgcagagctgcatcgacctcttcaagaacaactag

SEQ ID NO: 171177 - DNA, 1215 bp, Artificial Sequence; identical to SEQ ID NO: 171176
  Description of Artificial Sequence: Synthetic coding sequence

SEQ ID NO: 171178 - DNA, 687 bp, Artificial Sequence
  Description of Artificial Sequence: Synthetic coding sequence
atggctgctgtgcctgagctgctgcagcagcaggaggaggacaggagcaagaccaccctgcccaccttccagagccctgagttctctgtgacccggcagcatgaagattttgtgtggctgcatgacaccctgattgagaccacagattatgccggcctcatcatccccccagcccccaccaagccagactttgatggcccccgggagaagatgcagaagctgggggagggggagggctccatgaccaaggaggagtttgccaagatgaagcaggagctggaggccgagtacctggccgtgttcaagaagacagtgagcagccatgaggtgttcctgcagaggctgagcagccaccctgtgctgagcaaggacaggaacttccacgtgttcctggagtatgaccaggacctgtctgtgcggaggaagaacaccaaggagatgtttggaggcttcttcaagtctgtggtgaagtctgcagatgaggtgctcttcaccggggtgaaggaggtggatgacttctttgagcaggagaagaacttcctgatcaactactacaaccgcatcaaggacagctgtgtgaaggctgacaagatgaccaggagccacaagaatgtggctgatgactacatccacacagctgcctgcctgcacagcctggccctggaggagcccaccgtcatcaagtag

SEQ ID NO: 171179 - DNA, 810 bp, Artificial Sequence
  Description of Artificial Sequence: Synthetic coding sequence
atggctgctgtgcctgagctgctgcagcagcaggaggaggacaggagcaagctgcggtctgtgtctgtggacctgaatgtggaccccagcctgcagattgacatcccagatgccctgtctgagcgggacaaggtgaagttcaccgtgcacaccaagatccccccagcccccaccaagccagactttgatggcccccgggagaagatgcagaagctgggggagggggagggctccatgaccaaggaggagtttgccaagatgaagcaggagctggaggccgagtacctggccgtgttcaagaagacagtgagcagccatgaggtgttcctgcagaggctgagcagccaccctgtgctgagcaaggacaggaacttccacgtgttcctggagtatgaccaggacctgtctgtgcggaggaagaacaccaaggagatgtttggaggcttcttcaagtctgtggtgaagtctgcagatgaggtgctcttcaccggggtgaaggaggtggatgacttctttgagcaggagaagaacttcctgatcaactactacaaccgcatcaaggacagctgtgtgaaggctgacaagatgaccaggagccacaagaatgtggctgatgactacatccacacagctgcctgcctgcacagcctggccctggaggagcccaccgtcatcaagaagtacctgctgaaggtggccgagctgtttgagaagctgaggaaggtggagggccgggtgtccagtgatgaggacctgaagctgacagagctgctgcgctactacatgctgaacattgaagctgccaagtag

SEQ ID NO: 171180 - DNA, 885 bp, Artificial Sequence
  Description of Artificial Sequence: Synthetic coding sequence
atgaccaccctgacagagatcaagctgctgcccagcctggtgctgctggtgtgctgtgagtacctggccatcttcaagaagacagtggccatgcatgaggtgttcctgtgccgggtggccgcccaccccatcctgcggcgggacctgaacttccacgtgttcctggagtacaaccaggacctgtctgtgcggggcaagaacaagaaggagaagctggaggacttcttcaagaacatggtgaagtctgcagatggagtgattgtgtctggagtgaaggatgtggatgacttctttgagcacgagaggaccttcctgctggagtaccacaacagagtgaaggatgccagcgccaagagtgacaggatgaccaggagccacaagtctgctgctgatgactacaaccgcatcggcagcagcctgtatgccctgggcacccaggacagcacagacatctgcaagttcttcctgaaggtgtctgagctgtttgacaagaccaggaagattgaggcccgggtgtctgcagatgaggacctgaagctgagtgacctgctgaagtactacctgcgggagagccaggccgccaaggacctgctgtaccgccgcagccgcagcctggtggactatgaaaatgccaacaaggccctggacaaggcccgggccaagaacaaggatgtgctgcaggccgagaccagccagcagctgtgctgccagaagtttgagaagatcagcgagagcgccaagcaggagctgattgacttcaagacccggcgggtggccgccttcaggaagaacctggtggagctggccgagctggagctgaagcacgccaagggcaacctgcagctgctgcagaactgcctggccgtgctgaatggagacacctag

SEQ ID NO: 171181 - DNA, 1257 bp, Artificial Sequence
  Description of Artificial Sequence: Synthetic coding sequence
atgagggcctgtgccggcccccggctgggcgccgccatgatggagggcctggatgatggccctgacttcctgtctgaagaagatcggggcctgaaggccatcaacgtggacctgcagagtgatgctgccctgcaggtggacatcagtgatgccctgtctgagcgggacaaggtgaagttcaccgtgcacaccaagagcagcctgcccaacttcaagcagaatgagttctctgtggtgcggcagcacgaggagttcatctggctgcatgacagctttgtggagaatgaagattatgccggctacatcatccccccagccccacccaggccagactttgatgccagccgggagaagctgcagaagctgggggagggggagggctccatgaccaaggaggagttcaccaagatgaagcaggagctggaggccgagtacctggccatcttcaagaagacagtggccatgcatgaggtgttcctgtgccgggtggccgcccaccccatcctgcggcgggacctgaacttccacgtgttcctggagtacaaccaggacctgtctgtgcggggcaagaacaagaaggagaagctggaggacttcttcaagaacatggtgaagtctgcagatggagtgattgtgtctggagtgaaggatgtggatgacttctttgagcacgagaggaccttcctgctggagtaccacaacagagtgaaggatgccagcgccaagagtgacaggatgaccaggagccacaagtctgctgctgatgactacaaccgcatcggcagcagcctgtatgccctgggcacccaggacagcacagacatctgcaagttcttcctgaaggtgtctgagctgtttgacaagaccaggaagattgaggcccgggtgtctgcagatgaggacctgaagctgagtgacctgctgaagtactacctgcgggagagccaggccgccaaggacctgctgtaccgccgcagccgcagcctggtggactatgaaaatgccaacaaggccctggacaaggcccgggccaagaacaaggatgtgctgcaggccgagaccagccagcagctgtgctgccagaagtttgagaagatcagcgagagcgccaagcaggagctgattgacttcaagacccggcgggtggccgccttcaggaagaacctggtggagctggccgagctggagctgaagcacgccaagggcaacctgcagctgctgcagaactgcctggccgtgctgaatggagacacctag

SEQ ID NO: 171182 - DNA, 873 bp, Artificial Sequence
  Description of Artificial Sequence: Synthetic coding sequence
atgaccaaggaggagttcaccaagatgaagcaggagctggaggccgagtacctggccatcttcaagaagacagtggccatgcatgaggtgttcctgtgccgggtggccgcccaccccatcctgcggcgggacctgaacttccacgtgttcctggagtacaaccaggacctgtctgtgcggggcaagaacaagaaggagaagctggaggacttcttcaagaacatggtgaagtctgcagatggagtgattgtgtctggagtgaaggatgtggatgacttctttgagcacgagaggaccttcctgctggagtaccacaacagagtgaaggatgccagcgccaagagtgacaggatgaccaggagccacaagtctgctgctgatgactacaaccgcatcggcagcagcctgtatgccctgggcacccaggacagcacagacatctgcaagttcttcctgaaggtgtctgagctgtttgacaagaccaggaagattgaggcccgggtgtctgcagatgaggacctgaagctgagtgacctgctgaagtactacctgcgggagagccaggccgccaaggacctgctgtaccgccgcagccgcagcctggtggactatgaaaatgccaacaaggccctggacaaggcccgggccaagaacaaggatgtgctgcaggccgagaccagccagcagctgtgctgccagaagtttgagaagatcagcgagagcgccaagcaggagctgattgacttcaagacccggcgggtggccgccttcaggaagaacctggtggagctggccgagctggagctgaagcacgccaagggcaacctgcagctgctgcagaactgcctggccgtgctgaatggagacacctag

SEQ ID NO: 171183 - DNA, 873 bp, Artificial Sequence; identical to SEQ ID NO: 171182
  Description of Artificial Sequence: Synthetic coding sequence

SEQ ID NO: 171184 - DNA, 1188 bp, Artificial Sequence
  Description of Artificial Sequence: Synthetic coding sequence
atgaagatccccctgaacaagtttcctggctttgccaagccaggcacagagcagtacctgctggccaagcagctggccaagcccaaggagaagatccccatcatcgtgggggactatggccccatgtgggtgtaccccaccagcacctttgactgtgtggtggccgaccccaggaagggcagcaagatgtatggcctgaagagctacatcgagtaccagctgacccccaccaacaccaacagatctgtgaaccaccgctacaagcactttgactggctgtatgaaaggctgctggtgaagtttggaagtgccatccccatccccagcctgcctgacaagcaggtgacaggccgctttgaggaggagttcatcaagatgaggatggagcggctgcaggcctggatgaccaggatgtgccgccaccctgtgatcagcgagagcgaggtgttccagcagttcctgaacttcagagatgagaaggagtggaagacaggcaagaggaaggccgagagagatgagctggccggcgtgatgatcttcagcaccatggagcctgaggccccagacctggacctggtggagattgagcagaagtgtgaggccgtgggcaagttcaccaaggccatggatgatggagtgaaggagctgctgactgtgggccaggagcactggaagcgctgcaccggccccctgcccaaggagtaccagaagattggcaaggccctgcagagcctggccaccgtcttcagcagcagcggctaccagggcgagacagacctgaatgatgccatcacagaagctgggaagacctatgaggagatcgccagcctggtggccgagcagcccaagaaggacctgcacttcctgatggagtgcaaccacgagtacaagggcttcctgggctgcttcccagacatcatcggcacccacaagggggccatcgagaaggtgaaggagagtgacaagctggtggccaccagcaagatcaccctgcaggacaagcagaacatggtgaagagggtgtccatcatgtcctatgccctgcaggccgagatgaaccacttccacagcaaccgcatctatgactacaacagcgtcatccggctgtacctggagcagcaggtgcagttctatgagaccatcgccgagaagctgcggcaggccctgagccgcttccctgtgatgtag

SEQ ID NO: 171185 - DNA, 1788 bp, Artificial Sequence
  Description of Artificial Sequence: Synthetic coding sequence
atggccaccaaggcccgggtgatgtatgactttgctgctgagcccggcaacaatgagctgactgtgaatgaaggagagatcatcaccatcaccaacccagatgtgggcggcggctggctggagggcaggaacatcaagggggagcggggcctggtgcccacagattatgtggagatcctgcccagtgatggcaaggaccagttcagctgtggcaacagcgtggccgaccaggccttcctggacagcctgagcgccagcacagcccaggccagcagcagcgctgccagcaacaaccaccaggtgggcagcggaaatgacccctggagcgcctggagcgccagcaagagcggcaactgggagagcagcgagggctggggcgcccagcctgagggcgctggggcccagaggaacaccaacacccccaacaactgggacacagccttcggccacccccaggcctaccagggccctgccactggagatgatgatgactgggatgaggactgggatggccccaagagcagcagctacttcaaggacagcgagagcgcagatgctgggggcgcccagaggggcaacagccgggccagcagcagctccatgaagatccccctgaacaagtttcctggctttgccaagccaggcacagagcagtacctgctggccaagcagctggccaagcccaaggagaagatccccatcatcgtgggggactatggccccatgtgggtgtaccccaccagcacctttgactgtgtggtggccgaccccaggaagggcagcaagatgtatggcctgaagagctacatcgagtaccagctgacccccaccaacaccaacagatctgtgaaccaccgctacaagcactttgactggctgtatgaaaggctgctggtgaagtttggaagtgccatccccatccccagcctgcctgacaagcaggtgacaggccgctttgaggaggagttcatcaagatgaggatggagcggctgcaggcctggatgaccaggatgtgccgccaccctgtgatcagcgagagcgaggtgttccagcagttcctgaacttcagagatgagaaggagtggaagacaggcaagaggaaggccgagagagatgagctggccggcgtgatgatcttcagcaccatggagcctgaggccccagacctggacctggtggagattgagcagaagtgtgaggccgtgggcaagttcaccaaggccatggatgatggagtgaaggagctgctgactgtgggccaggagcactggaagcgctgcaccggccccctgcccaaggagtaccagaagattggcaaggccctgcagagcctggccaccgtcttcagcagcagcggctaccagggcgagacagacctgaatgatgccatcacagaagctgggaagacctatgaggagatcgccagcctggtggccgagcagcccaagaaggacctgcacttcctgatggagtgcaaccacgagtacaagggcttcctgggctgcttcccagacatcatcggcacccacaagggggccatcgagaaggtgaaggagagtgacaagctggtggccaccagcaagatcaccctgcaggacaagcagaacatggtgaagagggtgtccatcatgtcctatgccctgcaggccgagatgaaccacttccacagcaaccgcatctatgactacaacagcgtcatccggctgtacctggagcagcaggtgcagttctatgagaccatcgccgagaagctgcggcaggccctgagccgcttccctgtgatgtag

SEQ ID NO: 171186 - DNA, 1788 bp, Artificial Sequence; identical to SEQ ID NO: 171185
  Description of Artificial Sequence: Synthetic coding sequence

SEQ ID NO: 171187 - DNA, 1308 bp, Artificial Sequence
  Description of Artificial Sequence: Synthetic coding sequence
atgggcctgtccttcagcctcttccccctgagaaatcatgtgaatgtggagggcgccacccacaagcaggtggtggacctgatccgggccggggagaaggagctgatcctgactgtgctgtctgtgccccctcatgaagctgacaacctggaccccagtgatgacagcctgggccagagcttctatgactacacagagaagcaggccgtgcccatctctgtgccccgctacaagcacgtggagcagaatggagagaagtttgtggtgtacaacgtgtacatggccggccggcagctgtgcagcaagcgctaccgggagtttgccatcctgcaccagaacctgaagcgggagtttgccaacttcaccttcccccggctgcccgggaagtggcccttcagcctgtctgagcagcagctggatgccaggagaagaggcctggaggagtacctggagaaggtgtgcagcatccgggtgattggagagagtgacatcatgcaggagttcctgtctgagagtgatgagaactacaatggagtgtctgatgtggagctgcgggtggccctgcctgatggcaccaccgtgacagtgcgggtgaagaagaacagcaccacagaccaggtgtaccaggccatcgccgccaaggtgggcatggacagcaccaccgtgaactactttgccctgtttgaggtgatcagccacagctttgtgaggaagctggccccaaatgagttcccccacaagctgtacatccagaactacaccagcgctgtgcccggcacctgcctgaccatcaggaagtggctgttcaccacagaggaggagatcctgctgaatgacaatgacctggccgtgacctacttcttccaccaggccgtggatgatgtgaagaagggctacatcaaggccgaggagaagagctaccagctgcagaagctgtatgagcagaggaagatggtgatgtacctgaacatgctgcggacctgtgagggctacaatgagatcatcttcccccactgtgcctgtgacagcaggaggaagggccacgtgatcacagccatcagcatcacccacttcaagctgcacgcctgcacagaggagggccagctggagaaccaggtgattgcctttgagtgggatgagatgcagcgctgggacacagatgaggagggcatggccttctgctttgaatatgcccggggggagaagaagccccgctgggtgaagatcttcaccccctacttcaactacatgcatgaatgttttgagagggtcttctgtgagctgaagtggaggaaggaggagtactag

SEQ ID NO: 171188 - DNA, 1587 bp, Artificial Sequence
  Description of Artificial Sequence: Synthetic coding sequence
atggctgatgaagatggagagggcatccaccccagcgccccccacagaaatggaggcggcggcggcggcggcggcagcggcctgcactgtgctggaaatggaggcggcggcggcggcggcccccgggtggtgcgcatcgtgaagtctgagagcggctacggcttcaacgtgcggggccaggtgtctgagggcggccagctgcggagcatcaatggagagctgtatgcccccctgcagcacgtgtctgctgtgctgcccggcggcgctgctgacagagctggggtgaggaaaggagaccgcatcctggaggtgaaccacgtgaatgtggagggcgccacccacaagcaggtggtggacctgatccgggccggggagaaggagctgatcctgactgtgctgtctgtgccccctcatgaggccgacaacctggaccccagtgatgacagcctgggccagagcttctatgactacacagagaagcaggccgtgcccatctctgtgccccgctacaagcacgtggagcagaatggagagaagtttgtggtgtacaacgtgtacatggccggccggcagctgtgcagcaagcgctaccgggagtttgccatcctgcaccagaacctgaagcgggagtttgccaacttcaccttcccccggctgcccgggaagtggcccttcagcctgtctgagcagcagctggatgcccggcggcggggcctggaggagtacctggagaaggtgtgcagcatccgggtcatcggggagagtgacatcatgcaggagttcctgtctgagagtgatgagaactacaacggggtgtctgatgtggagctgcgggtggccctgcctgatggcaccaccgtgacagtgcgggtgaagaagaacagcaccacagaccaggtgtaccaggccatcgccgccaaggtgggcatggacagcaccaccgtgaactactttgccctgtttgaagtcatcagccacagctttgtgaggaagctggccccaaatgagttcccccacaagctgtacatccagaactacaccagcgctgtgcccggcacctgcctgaccatcaggaagtggctgttcaccacagaggaggagatcctgctgaatgacaatgacctggccgtgacctacttcttccaccaggccgtggatgatgtgaagaagggctacatcaaggccgaggagaagagctaccagctgcagaagctgtatgagcagaggaagatggtgatgtacctgaacatgctgcggacctgtgagggctacaatgagatcatcttcccccactgtgcctgtgacagcagaagaaaaggacatgtgatcacagccatcagcatcacccacttcaagctgcacgcctgcacagaggagggccagctggagaaccaggtgattgcctttgagtgggatgagatgcagcgctgggacacagatgaggagggcatggccttctgctttgaatatgcccggggggagaagaagccccgctgggtgaagatcttcaccccctacttcaactacatgcatgagtgctttgagagggtcttctgtgagctgaagtggaggaaggaggagtactag

SEQ ID NO: 171189 - DNA, 1626 bp, Artificial Sequence
  Description of Artificial Sequence: Synthetic coding sequence
atggctgatgaagatggagagggcatccaccccagcgccccccacagaaatggaggcggcggcggcggcggcggcagcggcctgcactgtgctggaaatggaggcggcggcggcggcggcccccgggtggtgcgcatcgtgaagtctgagagcggctacggcttcaacgtgcggggccaggtgtctgagggcggccagctgcggagcatcaatggagagctgtatgcccccctgcagcacgtgtctgctgtgctgcccggcggcgctgctgacagagctggggtgaggaaaggagaccgcatcctggaggtgaaccacgtgaatgtggagggcgccacccacaagcaggtggtggacctgatccgggccggggagaaggagctgatcctgactgtgctgtctgtgccccctcatgaggccgacaacctggaccccagtgatgacagcctgggccagagcttctatgactacacagagaagcaggccgtgcccatctctgtgccccgctacaagcacgtggagcagaatggagagaagtttgtggtgtacaacgtgtacatggccggccggcagctgtgcagcaagcgctaccgggagtttgccatcctgcaccagaacctgaagcgggagtttgccaacttcaccttcccccggctgcccgggaagtggcccttcagcctgtctgagcagcagctggatgcccggcggcggggcctggaggagtacctggagaaggtgtgcagcatccgggtcatcggggagagtgacatcatgcaggagttcctgtctgagagtgatgagaactacaacggggtgtctgatgtggagctgcgggtggccctgcctgatggcaccaccgtgacagtgcgggtgaagaagaacagcaccacagaccaggtgtaccaggccatcgccgccaaggtgggcatggacagcaccaccgtgaactactttgccctgtttgaagtcatcagccacagctttgtgaggaagctggccccaaatgagttcccccacaagctgtacatccagaactacaccagcgctgtgcccggcacctgcctgaccatcaggaagtggctgttcaccacagaggaggagatcctgctgaatgacaatgacctggccgtgacctacttcttccaccaggccgtggatgatgtgaagaagggctacatcaaggccgaggagaagagctaccagctgcagaagctgtatgagcagaggaagatggtgatgtacctgaacatgctgcggacctgtgagggctacaatgagatcatcttcccccactgtgcctgtgacagcagaagaaaaggacatgtgatcacagccatcagcatcacccacttcaagctgcacgcctgcacagaggagggccagctggagaaccaggtgattgcctttgagtgggatgagatgcagcgctgggacacagatgaggagggcatggccttctgctttgaatatgcccggggggagaagaagccccgctgggtgaagatcttcaccccctacttcaactacatgcatgagtgctttgagagggtcttctgtgagctgaagtggaggaaggagaacatcttccagatggcccggagccagcagagagatgtggccacctag

SEQ ID NO: 171190 - DNA, 2640 bp, Artificial Sequence
  Description of Artificial Sequence: Synthetic coding sequence
atggccggcggcggcggggacctgagcacccggcggctgaatgaatgcatcagccctgtggccaatgagatgaaccacctgcctgcccacagccatgacctgcagaggatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcaccggggagaacagcttccgcagcctgacctggcccccatctggcagccccagccatgctggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagtgaagattctgagggcagcacagatgtggatgagcccctggaggtgttcatcagcgcccccaggtctgagcccgtcatcaacaatgacaaccccctggagagcaatgatgagaaggagggccaggaggccacctgcagccggccccagatcgtgcctgagcccatggacttcaggaagctgagcaccttccgggagagcttcaagaagagggtcatcggccaggaccatgacttcagcgagagcagcgaggaggaggccccagctgaggccagcagcggggccctgcggagcaagcatggagagaaggcccccatgaccagccgcagcaccagcacctggaggatccccagcaggaagaggcgcttcagcagcagtgacttcagtgacctgagcaatggagaggagctgcaggagacctgcagcagcagcctgcggcggggcagcggcagccagccccaggagcctgagaacaagaagtgcagctgtgtgatgtgcttccccaagggcgtgcccaggagccaggaggccaggacagagagcagccaggccagtgacatgatggacaccatggatgtggagaacaacagcaccctggagaagcacagcggcaagaggaggaagaagagaagacacaggagcaaggtgaatggcctgcagaggggcaggaagaaggaccggcccaggaagcacctgaccctgaacaacaaggtgcagaagaagcgctggcagcagaggggcaggaaggccaacacccggcccctgaagagaagaaggaagaggggcccccgcatccccaaggatgagaacatcaacttcaagcagagcgagctgcctgtgacctgtggggaggtgaagggcaccctgtacaaggagcgcttcaagcagggcaccagcaagaagtgcatccagagcgaggacaagaagtggttcaccccccgggagtttgaaattgaaggagacagaggagccagcaagaactggaagctgagcatccgctgtggcggctacaccctgaaggtgctgatggagaacaagttcctgcctgagccccccagcaccaggaagaagaggatcctggagagccacaacaacaccctggtggacccctgtgaggagcacaagaagaagaacccagatgcctctgtgaagttcagcgagttcctgaagaagtgcagcgagacctggaagaccatctttgccaaggagaagggcaagtttgaggacatggccaaggctgacaaggcccactatgagcgggagatgaagacctacatcccccccaagggggagaagaagaagaagttcaaggaccccaatgcccccaagaggcctcccctggccttcttcctgttctgcagcgagtaccggcccaagatcaagggggagcaccctggcctgagcattgatgatgtggtgaagaagctggccggcatgtggaacaacacagctgctgctgacaagcagttctatgagaagaaggccgccaagctgaaggagaagtacaagaaggacattgctgcctaccgggccaagggcaagcccaacagcgccaagaagagggtggtgaaggccgagaagagcaagaagaagaaggaggaggaggaggatgaggaggatgagcaggaggaggagaatgaagaagatgatgacaagtag

SEQ ID NO: 171191 - DNA, 2658 bp, Artificial Sequence
  Description of Artificial Sequence: Synthetic coding sequence
atggccggcggcggcggggacctgagcacccggcggctgaatgaatgcatcagccctgtggccaatgagatgaaccacctgcctgcccacagccatgacctgcagaggatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcaccggggagaacagcttccgcagcctgacctggcccccatctggcagccccagccatgctggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagtgaagattctgagggcagcacagatgtggatgagcccctggaggtgttcatcagcgcccccaggtctgagcccgtcatcaacaatgacaaccccctggagagcaatgatgagaaggagggccaggaggccacctgcagccggccccagatcgtgcctgagcccatggacttcaggaagctgagcaccttccgggagagcttcaagaagagggtcatcggccaggaccatgacttcagcgagagcagcgaggaggaggccccagctgaggccagcagcggggccctgcggagcaagcatggagagaaggcccccatgaccagccgcagcaccagcacctggaggatccccagcaggaagaggcgcttcagcagcagtgacttcagtgacctgagcaatggagaggagctgcaggagacctgcagcagcagcctgcggcggggcagcggcagccagccccaggagcctgagaacaagaagtgcagctgtgtgatgtgcttccccaagggcgtgcccaggagccaggaggccaggacagagagcagccaggccagtgacatgatggacaccatggatgtggagaacaacagcaccctggagaagcacagcggcaagaggaggaagaagagaagacacaggagcaaggtgaatggcctgcagaggggcaggaagaaggaccggcccaggaagcacctgaccctgaacaacaaggtgcagaagaagcgctggcagcagaggggcaggaaggccaacacccggcccctgaagagaagaaggaagaggggcccccgcatccccaaggatgagaacatcaacttcaagcagagcgagctgcctgtgacctgtggggaggtgaagggcaccctgtacaaggagcgcttcaagcagggcaccagcaagaagtgcatccagagcgaggacaagaagtggttcaccccccgggagtttgaaattgaaggagacagaggagccagcaagaactggaagctgagcatccgctgtggcggctacaccctgaaggtgctgatggagaacaagttcctgcctgagccccccagcaccaggaagaagaggatcctggagagccacaacaacaccctggtggacccctgcccagagaacagcaacatctgtgaggtgtgcaacaagtggggccgcctcttctgctgtgacacctgccccaggagcttccacgagcactgccacatccccagcgtggaggccaacaagaacccctggagctgcatcttctgccgcatcaagaccatccaggagcgctgcccagagagccagagcggccaccaggagagcgaggtgctgatgaggcagatgctgcctgaggagcagctgaagtgtgagttcctgctgctgaaggtgtactgtgacagcaagagctgcttctttgccagcgagccctactacaaccgggagggcagccagggcccccagaagcccatgtggctgaacaaggtgaagaccagcctgaatgagcagatgtacaccagggtggagggctttgtgcaggacatgaggctcatcttccacaaccacaaggagttctaccgggaggacaagttcacccggctgggcatccaggtgcaggacatctttgagaagaacttcaggaacatctttgccatccaggagaccagcaagaacatcatcatgttcatctag

SEQ ID NO: 171192 - DNA, 1422 bp, Artificial Sequence
  Description of Artificial Sequence: Synthetic coding sequence
atggccggcggcggcggggacctgagcacccggcggctgaatgaatgcatcagccctgtggccaatgagatgaaccacctgcctgcccacagccatgacctgcagaggatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcaccggggagaacagcttccgcagcctgacctggcccccatctggcagccccagccatgctggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagtgaagattctgagggcagcacagatgtggatgagcccctggaggtgttcatcagcgcccccaggtctgagcccgtcatcaacaatgacaaccccctggagagcaatgatgagaaggagggccaggaggccacctgcagccggccccagatcgtgcctgagcccatggacttcaggaagctgagcaccttccgggagagcttcaagaagagggtcatcggccaggaccatgacttcagcgagagcagcgaggaggaggccccagctgaggccagcagcggggccctgcggagcaagcatggagagaaggcccccatgaccagccgcagcaccagcacctggaggatccccagcaggaagaggcagctgaagaagaagaagaagaagaagcagtgccacccccagccccagccccagaggggcctgctggagcagagctag

SEQ ID NO: 171193 - DNA, 2067 bp, Artificial Sequence
  Description of Artificial Sequence: Synthetic coding sequence
atggccggcggcggcggggacctgagcacccggcggctgaatgaatgcatcagccctgtggccaatgagatgaaccacctgcctgcccacagccatgacctgcagaggatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcaccggggagaacagcttccgcagcctgacctggcccccatctggcagccccagccatgctggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagtgaagattctgagggcagcacagatgtggatgagcccctggaggtgttcatcagcgcccccaggtctgagcccgtcatcaacaatgacaaccccctggagagcaatgatgagaaggagggccaggaggccacctgcagccggccccagatcgtgcctgagcccatggacttcaggaagctgagcaccttccgggagagcttcaagaagagggtcatcggccaggaccatgacttcagcgagagcagcgaggaggaggccccagctgaggccagcagcggggccctgcggagcaagcatggagagaaggcccccatgaccagccgcagcaccagcacctggaggatccccagcaggaagaggcgcttcagcagcagtgacttcagtgacctgagcaatggagaggagctgcaggagacctgcagcagcagcctgcggcggggcagcggcagccagccccaggagcctgagaacaagaagtgcagctgtgtgatgtgcttccccaagggcgtgcccaggagccaggaggccaggacagagagcagccaggccagtgacatgatggacaccatggatgtggagaacaacagcaccctggagaagcacagcggcaagaggaggaagaagagaagacacaggagcaaggtgaatggcctgcagaggggcaggaagaaggaccggcccaggaagcacctgaccctgaacaacaaggtgcagaagaagcgctggcagcagaggggcaggaaggccaacacccggcccctgaagagaagaaggaagaggggcccccgcatccccaaggatgagaacatcaacttcaagcagagcgagctgcctgtgacctgtggggaggtgaagggcaccctgtacaaggagcgcttcaagcagggcaccagcaagaagtgcatccagagcgaggacaagaagtggttcaccccccgggagtttgaaattgaaggagacagaggagccagcaagaactggaagctgagcatccgctgtggcggctacaccctgaaggtgctgatggagaacaagttcctgcctgagccccccagcaccaggaagaaggtgatgatcaagtag

SEQ ID NO: 171194 - DNA, 1443 bp, Artificial Sequence
  Description of Artificial Sequence: Synthetic coding sequence
atggccggcggcggcggggacctgagcacccggcggctgaatgaatgcatcagccctgtggccaatgagatgaaccacctgcctgcccacagccatgacctgcagaggatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcaccggggagaacagcttccgcagcctgacctggcccccatctggcagccccagccatgctggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagtgaagattctgagggcagcacagatgtggatgagcccctggaggtgttcatcagcgcccccaggtctgagcccgtcatcaacaatgacaaccccctggagagcaatgatgagaaggagggccaggaggccacctgcagccggccccagatcgtgcctgagcccatggacttcaggaagctgagcaccttccgggagagcttcaagaagagggtcatcggccaggaccatgacttcagcgagagcagcgaggaggaggccccagctgaggccagcagcggggccctgcggagcaagcatggagagaaggcccccatgaccagccgcagcaccagcacctggaggatccccagcaggaagaggcgcttcagcagcagtgacttcagtgacctgagcaatggagaggagctgcaggagacctgcagcagcagcctgcggcggggcagcggcaaggaggactag

SEQ ID NO: 171195 - DNA, 1068 bp, Artificial Sequence
  Description of Artificial Sequence: Synthetic coding sequence
atggatgtggagaacaacagcaccctggagaagcacagcggcaagaggaggaagaagaggaggcacaggagcaaggtgaatggcctgcagaggggcaggaagaaggaccggcccaggaagcacctgaccctgaacaacaaggtgcagaagaagcgctggcagcagaggggcaggaaggccaacacccggcccctgaagagaagaaggaagaggggcccccgcatccccaaggatgagaacatcaacttcaagcagagcgagctgcctgtgacctgtggggaggtgaagggcaccctgtacaaggagcgcttcaagcagggcaccagcaagaagtgcatccagagcgaggacaagaagtggttcaccccccgggagtttgaaattgaaggagacagaggagccagcaagaactggaagctgagcatccgctgtggcggctacaccctgaaggtgctgatggagcgcatcctggagagccacaacaacaccctggtggacccctgcccagagaacagcaacatctgtgaggtgtgcaacaagtggggccgcctcttctgctgtgacacctgccccaggagcttccacgagcactgccacatccccagcgtggaggccaacaagaacccctggagctgcatcttctgccgcatcaagaccatccaggagcgctgcccagagagccagagcggccaccaggagagcgaggtgctgatgaggcagatgctgcctgaggagcagctgaagtgtgagttcctgctgctgaaggtgtactgtgacagcaagagctgcttctttgccagcgagccctactacaaccgggagggcagccagggcccccagaagcccatgtggctgaacaaggtgaagaccagcctgaatgagcagatgtacaccagggtggagggctttgtgcaggacatgaggctcatcttccacaaccacaaggagttctaccgggaggacaagttcacccggctgggcatccaggtgcaggacatctttgagaagaacttcaggaacatctttgccatccaggagaccagcaagaacatcatcatgttcatctag

SEQ ID NO: 171196 - DNA, 1359 bp, Artificial Sequence
  Description of Artificial Sequence: Synthetic coding sequence
atggccggcggcggcggggacctgagcaccaggatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcactggagaaaattccttccgcagcctgacctggccacccagcggcagccccagccacgccggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagcgaggacagcgagggcagcacagatgtggatgagcccctggaggtgttcatcagcgcccccaggtctgagcctgtgatcaacaatgacaaccccctggagagcaatgatgagaaggagggccaggaggccacctgcagccggccccagatcgtgcctgagcccatggacttcaggaagctgagcaccttccgggagagcttcaagaagagggtgattggccaggaccatgacttcagcgagagcagcgaggaggaggccccagctgaggccagcagcggggccctgcggagcaagcacgcccccatgaccagccgcagcaccagcacctggaggatccccagcaggaagaggcgcttcagcagcagtgacttcagtgacctgagcaatggagaggagctgcaggagacctgcagcagcagcctgcggcggggcagcggcaaggaggactag

SEQ ID NO: 171197 - DNA, 1338 bp, Artificial Sequence
  Description of Artificial Sequence: Synthetic coding sequence
atgatgttcacagaggaccagggcgtggatgaccggctgctgtatgacatcgtgttcaagcacttcaagaggaacaaggtggagatcagcaatgccatcaagaagaccttccccttcctggagggcctgcgggaccgggacctgatcaccaacaagatgtttgaggacagccaggacagctgcaggaacctggtgcctgtgcagagggtggtgtacaacgtgctgtctgagctggagaagaccttcaacctgcctgtgctggaggccctcttcagtgatgtgaacatgcaggagtacccagacctgatccacatctacaagggctttgaaaatgtcatccatgacaagctgcccctgcaggagagcgaggaggaggagcgggaggagaggagcggcctgcagctgagcctggagcagggcactggagaaaattccttccgcagcctgacctggccacccagcggcagccccagccacgccggcaccaccccaccagaaaatggcctgtctgagcacccctgtgaaacagagcagatcaatgccaagaggaaggacaccaccagtgacaaggatgacagcctgggcagccagcagaccaatgagcagtgtgcccagaaggccgagcccacagagagctgtgagcagattgctgtgcaggtgaacaatggagatgctggccgggagatgccctgccccctgccctgtgatgaggagagccctgaggccgagctgcacaaccacggcatccagatcaacagctgcagcgtgcggctggtggacatcaagaaggagaagcccttcagcaacagcaaggtggagtgccaggcccaggcccggacccaccacaaccaggccagtgacatcatcgtcatcagcagcgaggacagcgagggcagcacagatgtggatgagcccctggaggtgttcatcagcgcccccaggtctgagcctgtgatcaacaatgacaaccccctggagagcaatgatgagaaggagggccaggaggccacctgcagccggccccagatcgtgcctgagcccatggacttcaggaagctgagcaccttccgggagagcttcaagaagagggtgattggccaggaccatgacttcagcgagagcagcgaggaggaggccccagctgaggccagcagcggggccctgcggagcaagcacggggagaaggcccccatgaccagccgcagcaccagcacctggaggatccccagcaggaagaggcgcttcagcagcagtgacttcagtgacctgagcaatggagaggagctgcaggagacctgcagcagcagcctgcggcggggcagcggcaaggaggactag

SEQ ID NO: 171198 - DNA, 2142 bp, Artificial Sequence
  Description of Artificial Sequence: Synthetic coding sequence
atgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctaccgctccttcaagagggtgggcgccagctatgagtggcagagccgggacacccccatcctgctggaggcccccaccggcctggccgagggcagcagcctgcacacccccctggccctgcccccaccccagcccccccagcccagctgcagcccctgtgccccccgggtgtctgagcccggcaccagcagccagcagagtgatgagatcctgtctgagagccccagccccagcgaccctgtgctgcccctgcctgccctgatccaggagggccgcagcacctctgtgaccaatgacaagctgaccagcaagatgaatgctgaggaggacagcgaggagatgcccagcctgctgaccagcacagtgcaggtggccagtgacaacctgatcccccagatccgggacaaggaggacccccaggagatgccccacagccccctgggctccatgcctgagatccgggacaacagccctgagcccaatgaccctgaggagccccaggaggtgagcagcacccccagcgacaagaagggcaagaagaggaagcgctgcatctggagcacccccaagaggaggcacaagaagaagagcctgcccggcggcacagccagcagccgccacggcatccagaagaagctgaagagggtggaccaggtgccccagaagaaggatgacagcacctgcaacagcacagtggagacccgggcccagaaggccaggacagaatgtgccaggaagagccgctctgaggagatcattgatggcaccagcgagatgaatgaaggcaagaggagccagaagacccccagcaccccccggcgggtgacccagggcgccgccagccctggccacggcatccaggagaagctgcaggtggtggacaaggtgacccagaggaaggatgacagcacctggaacagcgaggtgatgatgagggtgcagaaggcccggaccaagtgtgccaggaagagccggctgaaggagaagaagaaggagaaggacatctgcagcagcagcaagaggcgcttccagaagaacatccaccggcggggcaagcccaagagtgacacagtggacttccactgcagcaagctgcctgtgacctgtggggaggccaagggcatcctgtacaagaagaagatgaagcacggcagctctgtgaagtgcatcagaaatgaagatggcacctggctgaccccaaatgaatttgaggtggagggcaaaggaagaaatgccaagaactggaagaggaacatccgctgtgagggcatgaccctgggggagctgctgaagaggaagaacagtgatgaatgtgaggtgtgctgccagggcggccagctgctgtgctgcggcacctgccccagggtcttccacgaggactgccacatcccccctgtggaggccaagaggatgctgtggagctgcaccttctgcaggatgaagaggagcagcggcagccagcagtgccaccacgtgtccaagaccctggagcggcagatgcagccccaggaccagctgaagtgtgagttcctgctgctgaaggcctactgccacccccagagcagcttcttcaccggcatccccttcaacatccgggactatggagagcccttccaggaggccatgtggctggacctggtgaaggagcggctcatcacagagatgtacacagtggcctggtttgtgcgggacatgaggctgatgttcaggaaccacaagaccttctacaaggccagtgactttggccaggtgggcctggacctggaggccgagtttgagaaggacctgaaggatgtgctgggcttccacgaggccaatgatggcggcttctggaccctgccctag

SEQ ID NO: 171199 - DNA, 1650 bp, Artificial Sequence
  Description of Artificial Sequence: Synthetic coding sequence
atgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctaccgctccttcaagagggtgggcgccagctatgagtggcagagccgggacacccccatcctgctggaggcccccaccggcctggccgagggcagcagcctgcacacccccctggccctgcccccaccccagcccccccagcccagctgcagcccctgtgccccccgggtgtctgagcccggcaccagcagccagcagagtgatgagatcctgtctgagagccccagccccagcgaccctgtgctgcccctgcctgccctgatccaggagggccgcagcacctctgtgaccaatgacaagctgaccagcaagatgaatgctgaggaggacagcgaggagatgcccagcctgctgaccagcacagtgcaggtggccagtgacaacctgatcccccagatccgggacaaggaggacccccaggagatgccccacagccccctgggctccatgcctgagatccgggacaacagccctgagcccaatgaccctgaggagccccaggaggtgagcagcacccccagcgacaagaagggcaagaagaggaagcgctgcatctggagcacccccaagaggaggcacaagaagaagagcctgcccggcggcacagccagcagccgccacggcatccagaagaagctgaagagggtggaccaggtgccccagaagaaggatgacagcacctgcaacagcacagtggagacccgggcccagaaggccaggacagaatgtgccaggaagagccgctctgaggagatcattgatggcaccagcgagatgaatgaaggcaagaggagccagaagacccccagcaccccccggcgggtgacccagggcgccgccagccctggccacggcatccaggagaagctgcaggtggtggacaaggtgacccagaggaaggatgacagcacctggaacagcgaggtgatgatgagggtgcagaaggcccggaccaagtgtgccaggaagagccggctgaaggagaagaagaaggagaaggacatctgcagcagcagcaagaggcgcttccagaagaacatccaccggcggggcaagcccaagagtgacacagtggacttccactgcagcaagctgcctgtgacctgtggggaggccaagggcatcctgtacaagaagaagatgaagcacggcagctctgtgaagtgcatcagaaatgaagatggcacctggctgaccccaaatgaatttgaggtggagggcaaaggaagaaatgccaagaactggaagaggaacatccgctgtgagggcatgaccctgggggagctgctgaagagcggcctgctgctgtgccccccacgcatcaacctgaagcgggagctgaacagcaagtag

SEQ ID NO: 171200 - DNA, 756 bp, Artificial Sequence
  Description of Artificial Sequence: Synthetic coding sequence
atgcctgagatccgggacaacagccctgagcccaatgaccctgaggagccccaggaggtgagcagcacccccagcgacaagaagggcaagaagaggaagcgctgcatctggagcacccccaagaggaggcacaagaagaagagcctgcccggggagatcattgatggcaccagcgagatgaatgaaggcaagaggagccagaagacccccagcaccccccggcgggtgacccagggcgccgccagccctggccacggcatccaggagaagctgcaggtggtggacaaggtgacccagaggaaggatgacagcacctggaacagcgaggtgatgatgagggtgcagaaggcccggaccaagtgtgccaggaagagccggctgaaggagaagaagaaggagaaggacatctgcagcagcagcaagaggcgcttccagaagaacatccaccggcggggcaagcccaagagtgacacagtggacttccactgcagcaagctgcctgtgacctgtggggaggccaagggcatcctgtacaagaagaagatgaagcacggcagctctgtgaagtgcatcagaaatgaagatggcacctggctgaccccaaatgaatttgaggtggagggcaaaggaagaaatgccaagaactggaagaggaacatccgctgtgagggcatgaccctgggggagctgctgaagagcggcctgctgctgtgccccccacgcatcaacctgaagcgggagctgaacagcaagtag

SEQ ID NO: 171201 - DNA, 2070 bp, Artificial Sequence
  Description of Artificial Sequence: Synthetic coding sequence
atgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctaccgctccttcaagagggtgggcgccagctatgagtggcagagccgggacacccccatcctgctggaggcccccaccggcctggccgagggcagcagcctgcacacccccctggccctgcccccaccccagcccccccagcccagctgcagcccctgtgccccccgggtgtctgagcccggcaccagcagccagcagagtgatgagatcctgtctgagagccccagccccagcgaccctgtgctgcccctgcctgccctgatccaggagggccgcagcacctctgtgaccaatgacaagctgaccagcaagatgaatgctgaggaggacagcgaggagatgcccagcctgctgaccagcacagtgcaggtggccagtgacaacctgatcccccagatccgggacaaggaggacccccaggagatgccccacagccccctgggctccatgcctgagatccgggacaacagccctgagcccaatgaccctgaggagccccaggaggtgagcagcacccccagcgacaagaagggcaagaagaggaagcgctgcatctggagcacccccaagaggaggcacaagaagaagagcctgcccggcggcacagccagcagccgccacggcatccagaagaagctgaagagggtggaccaggtgccccagaagaaggatgacagcacctgcaacagcacagtggagacccgggcccagaaggccaggacagaatgtgccaggaagagccgctctgaggagatcattgatggcaccagcgagatgaatgaaggcaagaggagccagaagacccccagcaccccccggcgggtgacccagggcgccgccagccctggccacggcatccaggagaagctgcaggtggtggacaaggtgacccagaggaaggatgacagcacctggaacagcgaggtgatgatgagggtgcagaaggcccggaccaagtgtgccaggaagagccggctgaaggagaagaagaaggagaaggacatctgcagcagcagcaagaggcgcttccagaagaacatccaccggcggggcaagcccaagagtgacacagtggacttccactgcagcaagctgcctgtgacctgtggggaggccaagggcatcctgtacaagaagaagatgaagcacggcagctctgtgaagtgcatcagaaatgaagatggcacctggctgaccccaaatgaatttgaggtggagggcaaaggaagaaatgccaagaactggaagaggaacatccgctgtgagggcatgaccctgggggagctgctgaagaggaagaacagtgatgaatgtgaggtgtgctgccagggcggccagctgctgtgctgcggcacctgccccagggtcttccacgaggactgccacatcccccctgtggaggccaagaggatgctgtggagctgcaccttctgcaggatgaagaggagcagcggcagccagcagtgccaccacgtgtccaagaccctggagcggcagatgcagccccaggaccagctgatccgggactatggagagcccttccaggaggccatgtggctggacctggtgaaggagcggctcatcacagagatgtacacagtggcctggtttgtgcgggacatgaggctgatgttcaggaaccacaagaccttctacaaggccagtgactttggccaggtgggcctggacctggaggccgagtttgagaaggacctgaaggatgtgctgggcttccacgaggccaatgatggcggcttctggaccctgccctag

SEQ ID NO: 171202 - DNA, 1644 bp, Artificial Sequence
  Description of Artificial Sequence: Synthetic coding sequence
atgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctaccgctccttcaagagggtgggcgccagctatgagtggcagagccgggacacccccatcctgctggaggcccccaccggcctggccgagggcagcagcctgcacacccccctggccctgcccccaccccagcccccccagcccagctgcagcccctgtgccccccgggtgtctgagcccggcaccagcagccagcagagtgatgagatcctgtctgagagccccagccccagcgaccctgtgctgcccctgcctgccctgatccaggagggccgcagcacctctgtgaccaatgacaagctgaccagcaagatgaatgctgaggaggacagcgaggagatgcccagcctgctgaccagcacagtgcaggtggccagtgacaacctgatcccccagatccgggacaaggaggacccccaggagatgccccacagccccctgggctccatgcctgagatccgggacaacagccctgagcccaatgaccctgaggagccccaggaggtgagcagcacccccagcgacaagaagggcaagaagaggaagcgctgcatctggagcacccccaagaggaggcacaagaagaagagcctgcccggggccagcagccgccacggcatccagaagaagctgaagagggtggaccaggtgccccagaagaaggatgacagcacctgcaacagcacagtggagacccgggcccagaaggccaggacagaatgtgccaggaagagccgctctgaggagatcattgatggcaccagcgagatgaatgaaggcaagaggagccagaagacccccagcaccccccggcgggtgacccagggcgccgccagccctggccacggcatccaggagaagctgcaggtggtggacaaggtgacccagaggaaggatgacagcacctggaacagcgaggtgatgatgagggtgcagaaggcccggaccaagtgtgccaggaagagccggctgaaggagaagaagaaggagaaggacatctgcagcagcagcaagaggcgcttccagaagaacatccaccggcggggcaagcccaagagtgacacagtggacttccactgcagcaagctgcctgtgacctgtggggaggccaagggcatcctgtacaagaagaagatgaagcacggcagctctgtgaagtgcatcagaaatgaagatggcacctggctgaccccaaatgaatttgaggtggagggcaaaggaagaaatgccaagaactggaagaggaacatccgctgtgagggcatgaccctgggggagctgctgaagagcggcctgctgctgtgccccccacgcatcaacctgaagcgggagctgaacagcaagtag

SEQ ID NO: 171203 - DNA, 666 bp, Artificial Sequence
  Description of Artificial Sequence: Synthetic coding sequence
atgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctaccgctccttcaagagggtgggcgccagctatgagtggcagagccgggacacccccatcctgctggaggcccccaccggcctggccgagggcagcagcctgcacacccccctggccctgcccccaccccagcccccccagcccagctgcagcccctgtgccccccgggtgtctgagcccggcaccagcagccagcagagtgatgagatcctgtctgagagccccagccccagcgaccctgtgctgcccctgcctgccctgatccaggagggccgcagcacctctgtgaccaatgacaagctgaccagcaagatgaatgctgaggaggacagcgaggagatgcccagcctgctgaccagcacagtgtag

SEQ ID NO: 171204 - DNA, 306 bp, Artificial Sequence
  Description of Artificial Sequence: Synthetic coding sequence
atgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctacagatag

SEQ ID NO: 171205 - DNA, 1668 bp, Artificial Sequence
  Description of Artificial Sequence: Synthetic coding sequence
atgggccggggcttcaggatgttcaccatgacccgggccatggaggaggccctcttccagcacttcatgcaccagaagctgggcatcgcctatgccatccacaagcccttccccttctttgagggcctgctggacaacagcatcatcaccaagaggatgtacatggagagcctggaggcctgcaggaacctgatccctgtgtcccgggtggtgcacaacatcctgacccagctggagaggaccttcaacctgagcctgctggtgaccctcttcagccagatcaacctgcgggagtaccccaacctggtgaccatctaccgctccttcaagagggtgggcgccagctatgagtggcagagccgggacacccccatcctgctggaggcccccaccggcctggccgagggcagcagcctgcacacccccctggccctgcccccaccccagcccccccagcccagctgcagcccctgtgccccccgggtgtctgagcccggcaccagcagccagcagagtgatgagatcctgtctgagagccccagccccagcgaccctgtgctgcccctgcctgccctgatccaggagggccgcagcacctctgtgaccaatgacaagctgaccagcaagatgaatgctgaggaggacagcgaggagatgcccagcctgctgaccagcacagtgcaggtggccagtgacaacctgatcccccagatccgggacaaggaggacccccaggagatgccccacagccccctgggctccatgcctgagatccgggacaacagccctgagcccaatgaccctgaggagccccaggaggtgagcagcacccccagcgacaagaagggcaagaagaggaagcgctgcatctggagcacccccaagaggaggcacaagaagaagagcctgcccggcggcacagccagcagccgccacggcatccagaagaagctgaagagggtggaccaggtgccccagaagaaggatgacagcacctgcaacagcacagtggagacccgggcccagaaggccaggacagaatgtgccaggaagagccgctctgaggagatcattgatggcaccagcgagatgaatgaaggcaagaggagccagaagacccccagcaccccccggcgggtgacccagggcgccgccagccctggccacggcatccaggagaagctgcaggtggtggacaaggtgacccagaggaaggatgacagcacctggaacagcgaggtgatgatgagggtgcagaaggcccggaccaagtgtgccaggaagagccggctgaaggagaagaagaaggagaaggacatctgcagcagcagcaagaggcgcttccagaagaacatccaccggcggggcaagcccaagagtgacacagtggacttccactgcagcaagctgcctgtgacctgtggggaggccaagggcatcctgtacaagaagaagatgaagcacggcagctctgtgaagtgcatcagaaatgaagatggcacctggctgaccccaaatgaatttgaggtggagggcaaaggaagaaatgccaagaactggaagaggaacatccgctgtgagggcatgaccctgggggagctgctgaagagcggcctgctgctgtgccccccacgcatcaacctgaagcgggagctgaacagcaagtag

SEQ ID NO: 171206 - DNA, 2346 bp, Artificial Sequence
  Description of Artificial Sequence: Synthetic coding sequence
atgacagcccctgagaagcctgtgaagcaggaggagatggccgccctggatgtggacagcggcggcggcggcggcggcggcggcggccacggggagtacctgcagcagcagcagcagcacggcaatggagctgtggccgctgctgctgctgcccaggacacccagcccagccccctggccctgctggccgccacctgcagcaagattggcccccccagccctggagatgatgaggaggaggccgctgctgctgctggggccccagctgctgctggggccaccggggacctggccagcgcccagctgggcggggcccccaaccgctgggaggtgctgagcgccacccccaccaccatcaaggatgaagctggcaacctggtgcagatccccagcgctgccaccagcagcggccagtatgtgctgcccctgcagaacctgcagaaccagcagatcttctctgtggcccctggcagtgacagcagcaatggcaccgtgtcctctgtgcagtaccaggtgatcccccagatccagagcgcagatggccagcaggtgcagatcggcttcaccggcagcagtgacaatggaggcatcaaccaggagagcagccagatccagatcatccctggcagcaaccagaccctgctggccagcggcaccccatctgccaacatccagaacctgatcccccagacaggccaggtgcaggtgcagggcgtggccatcggcggcagcagcttccctggccagacccaggtggtggccaacgtgcccctgggcctgcccggcaacatcacctttgtgcccatcaacagcgtggacctggacagcctgggcctgagcggcagcagccagaccatgacagctggcatcaatgctgatggccacctgatcaacacaggccaggccatggacagcagtgacaacagcgagaggactggagagcgggtgtccccagacatcaatgagaccaacacagacacagacctgtttgtgcccaccagcagcagcagccagctgcctgtgaccatcgacagcacaggcatcctgcagcagaacaccaacagcctgaccaccagcagcggccaggtgcacagcagtgacctgcagggcaactacatccagagccctgtgtctgaggagacccaggcccagaacatccaggtgtccacagcccagcctgtggtgcagcacctgcagctgcaggagagccagcagcccaccagccaggcccagatcgtgcagggcatcaccccccagaccatccacggcgtgcaggccagcggccagaacatcagccagcaggccctgcagaacctgcagctgcagctgaaccctggcaccttcctgatccaggcccagacagtgacccccagcggccaggtgacctggcagaccttccaggtgcagggcgtgcagaacctgcagaacctgcagatccagaacacagctgcccagcagatcaccctgacccctgtgcagaccctgaccctgggccaggtggccgccggcggggccttcaccagcacccctgtgtccctgagcacaggccagctgcccaacctgcagacagtgacagtgaacagcattgattctgctggcatccagctgcaccctggagaaaatgctgacagccctgctgacatccgcatcaaggaggaggagccagaccctgaggagtggcagctgagcggggacagcaccctgaacaccaatgacctgacccacctgcgggtgcaggtggtggatgaggagggggaccagcagcaccaggagggcaagaggctgcggcgggtggcctgcacctgccccaactgcaaggagggcggcggccggggcaccaacctgggcaagaagaagcagcacatctgccacatccctggctgtgggaaggtgtatggcaagaccagccacctgcgggcccacctgcgctggcacagcggggagcggccctttgtgtgcaactggatgtactgtgggaagcgcttcaccaggagtgatgagctgcagaggcacaggaggacccacactggagagaagaagtttgtgtgcccagaatgttccaagcgcttcatgagaagtgaccacctggccaagcacatcaagacccaccagaacaagaagggcatccacagcagcagcacagtgctggcctctgtggaggccgccagagatgacaccctcatcacagctgggggcaccaccctcatcctggccaacatccagcagggctctgtgtctggcatcggcaccgtgaacaccagcgccaccagcaaccaggacatcctgaccaacacagagatccccctgcagctggtgacagtgtctggaaatgagaccatggagtag

SEQ ID NO: 171207 - DNA, 2217 bp, Artificial Sequence
  Description of Artificial Sequence: Synthetic coding sequence
tgaccagagaagcctgtgaagcaggaggagatggccgccctggatgtggacagcggcggcggcggcggcggcggcggcggccacggggagtacctgcagcagcagcagcagcacggcaatggagctgtggccgctgctgctgctgcccagacaggagacctggccagcgcccagctgggcggggcccccaaccgctgggaggtgctgagcgccacccccaccaccatcaaggatgaggccggcaacctggtgcagatccccagcgctgccaccagcagcggccagtatgtgctgcccctgcagaacctgcagaaccagcagatcttctctgtggcccctggcagtgacagcagcaatggaacagtgtcctctgtgcagtaccaggtgatcccccagatccagagcgcagatggccagcaggtgcagatcggcttcaccggcagcagtgacaatggaggcatcaaccaggagagcagccagatccagatcatccctggcagcaaccagaccctgctggccagcggcacccccagcgccaacatccagaacctgatcccccagacaggccaggtgcaggtgcagggcgtggccatcggcggcagcagcttccctggccagacccaggtggtggccaacgtgcccctgggcctgcccggcaacatcacctttgtgcccatcaacagcgtggacctggacagcctgggcctgagcggcagcagccagaccatgacagctggcatcaatgctgatggccacctgatcaacacaggccaggccatggacagcagtgacaacagcgagaggactggagagcgggtgtccccagacatcaatgagaccaacacagacacagacctgtttgtgcccaccagcagcagcagccagctgcctgtgaccatcgacagcacaggcatcctgcagcagaacaccaacagcctgaccaccagcagcggccaggtgcacagcagtgacctgcagggcaactacatccagagccctgtgtctgaggagacccaggcccagaacatccaggtgtccacagcccagcctgtggtgcagcacctgcagctgcaggagagccagcagcccaccagccaggcccagatcgtgcagggcatcaccccccagaccatccatggagtgcaggccagcggccagaacatcagccagcaggccctgcagaacctgcagctgcagctgaaccctggcaccttcctgatccaggcccagacagtgaccccatctggccaggtgacctggcagaccttccaggtgcagggcgtgcagaacctgcagaacctgcagatccagaacacagctgcccagcagatcaccctgacccctgtgcagaccctgaccctgggccaggtggccgccggcggggccttcaccagcacccctgtgtccctgagcacaggccagctgcccaacctgcagacagtgacagtgaacagcattgacagcgctggcatccagctgcaccctggagaaaatgctgacagccctgctgacatccgcatcaaggaggaggagccagaccctgaggagtggcagctgagcggggacagcaccctgaacaccaatgacctgacccacctgcgggtgcaggtggtggatgaggagggggaccagcagcaccaggagggcaagaggctgcggcgggtggcctgcacctgccccaactgcaaggagggcggcggccggggcaccaacctgggcaagaagaagcagcacatctgccacatccctggctgcggcaaggtgtatggcaagaccagccacctgcgggcccacctgcgctggcacagcggggagcggccctttgtgtgcaactggatgtactgcggcaagcgcttcaccaggagtgatgagctgcagaggcacaggaggacccacactggagagaagaagtttgtgtgcccagagtgcagcaagcgcttcatgagaagtgaccacctggccaagcacatcaagacccaccagaacaagaagggcatccacagcagcagcacagtgctggcctctgtggaggccgccagagatgacaccctcatcacagctgggggcaccaccctcatcctggccaacatccagcagggctctgtgtctggaattggaacagtgaacaccagcgccaccagcaaccaggacatcctgaccaacacagagatccccctgcagctggtgacagtgtctggaaatgagaccatggagtag

SEQ ID NO: 171208 - DNA, 2142 bp, Artificial Sequence
  Description of Artificial Sequence: Synthetic coding sequence
attggcccccccagccctggagatgatgaggaggaggccgctgctgctgctggggccccagctgctgctggggccaccggggacctggccagcgcccagctgggcggggcccccaaccgctgggaggtgctgagcgccacccccaccaccatcaaggatgaagctggcaacctggtgcagatccccagcgctgccaccagcagcggccagtatgtgctgcccctgcagaacctgcagaaccagcagatcttctctgtggcccctggcagtgacagcagcaatggcaccgtgtcctctgtgcagtaccaggtgatcccccagatccagagcgcagatggccagcaggtgcagatcggcttcaccggcagcagtgacaatggaggcatcaaccaggagagcagccagatccagatcatccctggcagcaaccagaccctgctggccagcggcaccccatctgccaacatccagaacctgatcccccagacaggccaggtgcaggtgcagggcgtggccatcggcggcagcagcttccctggccagacccaggtggtggccaacgtgcccctgggcctgcccggcaacatcacctttgtgcccatcaacagcgtggacctggacagcctgggcctgagcggcagcagccagaccatgacagctggcatcaatgctgatggccacctgatcaacacaggccaggccatggacagcagtgacaacagcgagaggactggagagcgggtgtccccagacatcaatgagaccaacacagacacagacctgtttgtgcccaccagcagcagcagccagctgcctgtgaccatcgacagcacaggcatcctgcagcagaacaccaacagcctgaccaccagcagcggccaggtgcacagcagtgacctgcagggcaactacatccagagccctgtgtctgaggagacccaggcccagaacatccaggtgtccacagcccagcctgtggtgcagcacctgcagctgcaggagagccagcagcccaccagccaggcccagatcgtgcagggcatcaccccccagaccatccacggcgtgcaggccagcggccagaacatcagccagcaggccctgcagaacctgcagctgcagctgaaccctggcaccttcctgatccaggcccagacagtgacccccagcggccaggtgacctggcagaccttccaggtgcagggcgtgcagaacctgcagaacctgcagatccagaacacagctgcccagcagatcaccctgacccctgtgcagaccctgaccctgggccaggtggccgccggcggggccttcaccagcacccctgtgtccctgagcacaggccagctgcccaacctgcagacagtgacagtgaacagcattgattctgctggcatccagctgcaccctggagaaaatgctgacagccctgctgacatccgcatcaaggaggaggagccagaccctgaggagtggcagctgagcggggacagcaccctgaacaccaatgacctgacccacctgcgggtgcaggtggtggatgaggagggggaccagcagcaccaggagggcaagaggctgcggcgggtggcctgcacctgccccaactgcaaggagggcggcggccggggcaccaacctgggcaagaagaagcagcacatctgccacatccctggctgtgggaaggtgtatggcaagaccagccacctgcgggcccacctgcgctggcacagcggggagcggccctttgtgtgcaactggatgtactgtgggaagcgcttcaccaggagtgatgagctgcagaggcacaggaggacccacactggagagaagaagtttgtgtgcccagaatgttccaagcgcttcatgagaagtgaccacctggccaagcacatcaagacccaccagaacaagaagggcatccacagcagcagcacagtgctggcctctgtggaggccgccagagatgacaccctcatcacagctgggggcaccaccctcatcctggccaacatccagcagggctctgtgtctggcatcggcaccgtgaacaccagcgccaccagcaaccaggacatcctgaccaacacagagatccccctgcagctggtgacagtgtctggaaatgagaccatggagtag

SEQ ID NO: 171209 - DNA, 2187 bp, Artificial Sequence
  Description of Artificial Sequence: Synthetic coding sequence
atggccgccctggatgtggacagcggcggcggcggcggcggcggcggcggccacggggagtacctgcagcagcagcagcagcacggcaatggagctgtggccgctgctgctgctgcccagacaggagacctggccagcgcccagctgggcggggcccccaaccgctgggaggtgctgagcgccacccccaccaccatcaaggatgaggccggcaacctggtgcagatccccagcgctgccaccagcagcggccagtatgtgctgcccctgcagaacctgcagaaccagcagatcttctctgtggcccctggcagtgacagcagcaatggaacagtgtcctctgtgcagtaccaggtgatcccccagatccagagcgcagatggccagcaggtgcagatcggcttcaccggcagcagtgacaatggaggcatcaaccaggagagcagccagatccagatcatccctggcagcaaccagaccctgctggccagcggcacccccagcgccaacatccagaacctgatcccccagacaggccaggtgcaggtgcagggcgtggccatcggcggcagcagcttccctggccagacccaggtggtggccaacgtgcccctgggcctgcccggcaacatcacctttgtgcccatcaacagcgtggacctggacagcctgggcctgagcggcagcagccagaccatgacagctggcatcaatgctgatggccacctgatcaacacaggccaggccatggacagcagtgacaacagcgagaggactggagagcgggtgtccccagacatcaatgagaccaacacagacacagacctgtttgtgcccaccagcagcagcagccagctgcctgtgaccatcgacagcacaggcatcctgcagcagaacaccaacagcctgaccaccagcagcggccaggtgcacagcagtgacctgcagggcaactacatccagagccctgtgtctgaggagacccaggcccagaacatccaggtgtccacagcccagcctgtggtgcagcacctgcagctgcaggagagccagcagcccaccagccaggcccagatcgtgcagggcatcaccccccagaccatccatggagtgcaggccagcggccagaacatcagccagcaggccctgcagaacctgcagctgcagctgaaccctggcaccttcctgatccaggcccagacagtgaccccatctggccaggtgacctggcagaccttccaggtgcagggcgtgcagaacctgcagaacctgcagatccagaacacagctgcccagcagatcaccctgacccctgtgcagaccctgaccctgggccaggtggccgccggcggggccttcaccagcacccctgtgtccctgagcacaggccagctgcccaacctgcagacagtgacagtgaacagcattgacagcgctggcatccagctgcaccctggagaaaatgctgacagccctgctgacatccgcatcaaggaggaggagccagaccctgaggagtggcagctgagcggggacagcaccctgaacaccaatgacctgacccacctgcgggtgcaggtggtggatgaggagggggaccagcagcaccaggagggcaagaggctgcggcgggtggcctgcacctgccccaactgcaaggagggcggcggccggggcaccaacctgggcaagaagaagcagcacatctgccacatccctggctgcggcaaggtgtatggcaagaccagccacctgcgggcccacctgcgctggcacagcggggagcggccctttgtgtgcaactggatgtactgcggcaagcgcttcaccaggagtgatgagctgcagaggcacaggaggacccacactggagagaagaagtttgtgtgcccagagtgcagcaagcgcttcatgagaagtgaccacctggccaagcacatcaagacccaccagaacaagaagggcatccacagcagcagcacagtgctggcctctgtggaggccgccagagatgacaccctcatcacagctgggggcaccaccctcatcctggccaacatccagcagggctctgtgtctggaattggaacagtgaacaccagcgccaccagcaaccaggacatcctgaccaacacagagatccccctgcagctggtgacagtgtctggaaatgagaccatggagtag

SEQ ID NO: 171210 - DNA, 1545 bp, Artificial Sequence
  Description of Artificial Sequence: Synthetic coding sequence
atggtgtgggaggtgaagaccaaccagatgcccaatgctgtgcagaagctgctgctggtgatggacaagagggccagcggcatgaatgacagcctggagctgctgcagtgcaatgaaaacctgcccagcagccctggctacaacagctgtgatgagcacatggagctggatgacctgcctgagctgcaggccgtgcagagcgaccccacccagagcggcatgtaccagctgagcagtgatgtgagccaccaggagtaccccaggagctcctggaaccagaacaccagtgacatccctgagaccacctacagagaaaatgaggtggactggctgacagagctggccaacatcgccaccagcccccagagccccctgatgcagtgcagcttctacaacagaagcagccctgtgcacatcatcgccaccagcaagagcctgcacagctatgcccggcccccacctgtgagcagcagcagcaagtctgagcccgccttcccccaccaccactggaaggaggagacccctgtgagacatgagcgggccaacagcgagagcgagagcggcatcttctgcatgagcagcctgagtgatgatgatgacctgggctggtgcaacagctggcccagcacagtgtggcactgcttcctgaagggcacccggctgtgcttccacaagggcagcaacaaggagtggcaggatgtggaggactttgcccgggcagagggctgtgacaatgaggaggacctgcagatgggcatccacaagggctacggcagtgatggcctgaagctgctgagccatgaggagagcgtgtcctttggagagagcgtgctgaagctgacctttgaccccggcaccgtggaggatggcctgctgactgtggagtgcaagctggaccaccccttctacgtgaagaacaagggctggagcagcttctaccccagcctgactgtggtgcagcacggcatcccctgctgtgaggtgcacatcggagatgtgtgcctgcccccaggccacccagatgccatcaactttgatgacagcggcgtgtttgacaccttcaagagctatgacttcacccccatggacagcagcgctgtgtatgtgctgagctccatggcccggcagaggcgggccagcctgagctgtggcggccctgggggccaggactttgcccggagcggcttcagcaagaactgtggcagccctggcagcagccagctgagcagcaacagcctgtatgccaaggctgtgaagaaccacagcagcggcaccgtgtctgccaccagccccaacaagtgcaagaggcccatgaatgccttcatgctgtttgccaagaagtacagagtggagtacacccagatgtacccaggcaaggacaacagagccatcagcgtcatcctgggggaccgctggaagaagatgaagaatgaggagaggaggatgtacaccctggaggccaaggccctggccgaggagcagaagaggctgaacccagactgctggaagaggaagaggaccaacagcggcagccagcagcactag

SEQ ID NO: 171211 - DNA, 432 bp, Artificial Sequence
  Description of Artificial Sequence: Synthetic coding sequence
atgtctgaccagaagaaggaggaggaggaggaggccgctgctgctgctgccatggccacagagggcggcaagaccagcgagcctgagaacaacaacaagaagcccaagaccagcggcagccaggacagccagcccagccccctggccctgctggccgccacctgcagcaagattggcaccccaggagagaaccaggccaccggccagcagcagaggaacctgctggagaccctgggcaacctgctgccccccctgctgctgctgcagaagaggatcaccttcctgaaccagcccctggtgcggctggtgctgcctgctgtgatcactggagtgcacctgctgcagaagctgaaccaggtgatcctgccccccctggtgaacttcaagagctacaagtacaagatccaggtggtggtgtacagcaccaagtag

SEQ ID NO: 171212 - DNA, 1296 bp, Artificial Sequence
  Description of Artificial Sequence: Synthetic coding sequence
atggccagcagcctgctggaggaggaggtgcactacggcagcagccccctggccatgctgacagctgcctgcagcaagtttggaggcagcagccccctgcgggacagcaccaccctgggcaaggccggcaccaagaagccctacagcgtgggcagtgacctgagcgccagcaagaccatgggagatgcctacccagcccccttcaccagcaccaacggcctgctgagccctgctggcagccccccagcccccaccagcggctacgccaatgactacccacccttcagccacagcttccctggccccaccggcacccaggaccccggcctgctggtgcccaagggccacagcagcagtgactgcctgcccagcgtgtacaccagcctggacatgacccacccctacggctcctggtacaaggccggcatccatgctggcatcagccctggccctggcaacacccccaccccctggtgggacatgcaccctgggggcaactggctgggcggcggccagggccagggagatggcctgcagggcaccctgcccaccggccctgcccagccccccctgaacccccagctgcccacctaccccagcgactttgcccccctgaacccagccccctacccagccccccacctgctgcagcccggcccccagcacgtgctgccccaggatgtgtacaagcccaaggctgtgggcaacagcggccagctggagggcagcggcggggccaagccacccaggggggccagcactggaggcagcggcggctacggcggcagcggggccggccgcagcagctgtgactgccccaactgccaggagctggagcggctgggcgctgctgctgctggcctgaggaagaagcccatccacagctgccacatccctggctgcggcaaggtgtatggcaaggccagccacctgaaggcccacctgcgctggcacactggagagcggccctttgtgtgcaactggctgttctgtgggaagcgcttcaccaggagtgatgagctggagcggcacgtgaggacccacacccgggagaagaagttcacctgcctgctgtgcagcaagcgcttcaccaggagtgaccacctgagcaagcaccagaggacccacggggagcccggccctggccccccacccagcggccccaaggagctgggggagggccgcagcactggagaggaggaggccagccagaccccccggcccagcgccagccctgccaccccagagaaggcccctgggggcagccctgagcagagcaacctgctggagatctag

SEQ ID NO: 171213 - DNA, 1296 bp, Artificial Sequence; identical to SEQ ID NO: 171212
  Description of Artificial Sequence: Synthetic coding sequence

SEQ ID NO: 171214 - DNA, 1242 bp, Artificial Sequence
  Description of Artificial Sequence: Synthetic coding sequence
atgctgacagctgcctgcagcaagtttggaggcagcagccccctgcgggacagcaccaccctgggcaaggccggcaccaagaagccctacagcgtgggcagtgacctgagcgccagcaagaccatgggagatgcctacccagcccccttcaccagcaccaacggcctgctgagccctgctggcagccccccagcccccaccagcggctacgccaatgactacccacccttcagccacagcttccctggccccaccggcacccaggaccccggcctgctggtgcccaagggccacagcagcagtgactgcctgcccagcgtgtacaccagcctggacatgacccacccctacggctcctggtacaaggccggcatccatgctggcatcagccctggccctggcaacacccccaccccctggtgggacatgcaccctgggggcaactggctgggcggcggccagggccagggagatggcctgcagggcaccctgcccaccggccctgcccagccccccctgaacccccagctgcccacctaccccagcgactttgcccccctgaacccagccccctacccagccccccacctgctgcagcccggcccccagcacgtgctgccccaggatgtgtacaagcccaaggctgtgggcaacagcggccagctggagggcagcggcggggccaagccacccaggggggccagcactggaggcagcggcggctacggcggcagcggggccggccgcagcagctgtgactgccccaactgccaggagctggagcggctgggcgctgctgctgctggcctgaggaagaagcccatccacagctgccacatccctggctgcggcaaggtgtatggcaaggccagccacctgaaggcccacctgcgctggcacactggagagcggccctttgtgtgcaactggctgttctgtgggaagcgcttcaccaggagtgatgagctggagcggcacgtgaggacccacacccgggagaagaagttcacctgcctgctgtgcagcaagcgcttcaccaggagtgaccacctgagcaagcaccagaggacccacggggagcccggccctggccccccacccagcggccccaaggagctgggggagggccgcagcactggagaggaggaggccagccagaccccccggcccagcgccagccctgccaccccagagaaggcccctgggggcagccctgagcagagcaacctgctggagatctag

SEQ ID NO: 171215 - DNA, 1401 bp, Artificial Sequence
  Description of Artificial Sequence: Synthetic coding sequence
atggccaccagcctgctgggggaggagccccggctgggcagcacccccctggccatgctggccgccacctgcaacaagattggcagccccagccccagccccagcagcctgagtgacagcagcagcagctttgggaagggcttccacccctggaagaggagcagcagcagcagcagcgccagctgcaatgtggtgggcagcagcctgagcagctttggagtgtctggggccagcagaaatggaggcagcagcagcgctgctgctgctgctgctgctgctgctgctgctgctgctgccctggtgtctgacagcttcagctgtggcggcagccctggcagcagcgccttcagcctgaccagcagcggcggcagcagcgcccacagccaggacggcagccaccagcctgtgttcatcagcaaggtgcacacctctgtggatggcctgcagggcatctacccccgggtgggcatggcccacccctatgaatcctggttcaagcccagccaccctggcctgggcgctgctggggaggtgggcagcgctggggccagctcctggtgggatgtgggcgccggctggattgatgtgcagaaccccaacagcgctgctgccctgcccggcagcctgcaccctgctgctgggggcctgcagaccagcctgcacagccccctgggcggctacaacagcgactacagcggcctgagccacagcgccttcagcagcggggccagcagccacctgctgagccctgctggccagcacctgatggatggcttcaagcctgtgctgcccggcagctacccagacagcgcccccagccccctggccggggccggcggctccatgctgtctgctggccccagcgcccccctgggcggcagccccaggagcagcgcccggcgctacagcggccgggccacctgtgactgccccaactgccaggaggccgagcggctgggccctgctggggccagcctgcggaggaagggcctgcacagctgccacatccctggctgcggcaaggtgtatggcaagaccagccacctgaaggcccacctgcgctggcacactggagagcggccctttgtgtgcaactggctgttctgtgggaagcgcttcaccaggagtgatgagctgcagaggcacctgcggacccacactggagagaagagatttgcctgccctgtgtgcaacaagcgcttcatgagaagtgaccacctgagcaagcacgtgaagacccacagcggcggcggcggcggcggcggcagcgctggcagcggcagcggcggcaagaagggcagtgacacagacagcgagcacagcgctgctggcagccccccctgccacagccctgagctgctgcagcccccagagcccggccacagaaatggcctggagtag

SEQ ID NO: 171216 - DNA, 1473 bp, Artificial Sequence
  Description of Artificial Sequence: Synthetic coding sequence
atgctggccgccacctgcaacaagattggcagccccagccccagccccagcagcctgagtgacagcagcagcagctttgggaagggcttccacccctggaagaggagcagcagcagcagcagcgccagctgcaatgtggtgggcagcagcctgagcagctttggagtgtctggggccagcagaaatggaggcagcagcagcgctgctgctgctgctgctgctgctgctgctgctgctgctgccctggtgtctgacagcttcagctgtggcggcagccctggcagcagcgccttcagcctgaccagcagcagcgctgctgctgctgctgctgctgctgctgctgctgccagcagcagcccctttgccaatgactacagcgtcttccaggcccctggggtgtctgggggcagcggcggcggcggcggcggcggcggcggcggcagcagcgcccacagccaggacggcagccaccagcctgtgttcatcagcaaggtgcacacctctgtggatggcctgcagggcatctacccccgggtgggcatggcccacccctatgaatcctggttcaagcccagccaccctggcctgggcgctgctggggaggtgggcagcgctggggccagctcctggtgggatgtgggcgccggctggattgatgtgcagaaccccaacagcgctgctgccctgcccggcagcctgcaccctgctgctgggggcctgcagaccagcctgcacagccccctgggcggctacaacagcgactacagcggcctgagccacagcgccttcagcagcggggccagcagccacctgctgagccctgctggccagcacctgatggatggcttcaagcctgtgctgcccggcagctacccagacagcgcccccagccccctggccggggccggcggctccatgctgtctgctggccccagcgcccccctgggcggcagccccaggagcagcgcccggcgctacagcggccgggccacctgtgactgccccaactgccaggaggccgagcggctgggccctgctggggccagcctgcggaggaagggcctgcacagctgccacatccctggctgcggcaaggtgtatggcaagaccagccacctgaaggcccacctgcgctggcacactggagagcggccctttgtgtgcaactggctgttctgtgggaagcgcttcaccaggagtgatgagctgcagaggcacctgcggacccacactggagagaagagatttgcctgccctgtgtgcaacaagcgcttcatgagaagtgaccacctgagcaagcacgtgaagacccacagcggcggcggcggcggcggcggcagcgctggcagcggcagcggcggcaagaagggcagtgacacagacagcgagcacagcgctgctggcagccccccctgccacagccctgagctgctgcagcccccagagcccggccacagaaatggcctggagtag

SEQ ID NO: 171217 - DNA, 1527 bp, Artificial Sequence
  Description of Artificial Sequence: Synthetic coding sequence
atggccaccagcctgctgggggaggagccccggctgggcagcacccccctggccatgctggccgccacctgcaacaagattggcagccccagccccagccccagcagcctgagtgacagcagcagcagctttgggaagggcttccacccctggaagaggagcagcagcagcagcagcgccagctgcaatgtggtgggcagcagcctgagcagctttggagtgtctggggccagcagaaatggaggcagcagcagcgctgctgctgctgctgctgctgctgctgctgctgctgctgccctggtgtctgacagcttcagctgtggcggcagccctggcagcagcgccttcagcctgaccagcagcagcgctgctgctgctgctgctgctgctgctgctgctgccagcagcagcccctttgccaatgactacagcgtcttccaggcccctggggtgtctgggggcagcggcggcggcggcggcggcggcggcggcggcagcagcgcccacagccaggacggcagccaccagcctgtgttcatcagcaaggtgcacacctctgtggatggcctgcagggcatctacccccgggtgggcatggcccacccctatgaatcctggttcaagcccagccaccctggcctgggcgctgctggggaggtgggcagcgctggggccagctcctggtgggatgtgggcgccggctggattgatgtgcagaaccccaacagcgctgctgccctgcccggcagcctgcaccctgctgctgggggcctgcagaccagcctgcacagccccctgggcggctacaacagcgactacagcggcctgagccacagcgccttcagcagcggggccagcagccacctgctgagccctgctggccagcacctgatggatggcttcaagcctgtgctgcccggcagctacccagacagcgcccccagccccctggccggggccggcggctccatgctgtctgctggccccagcgcccccctgggcggcagccccaggagcagcgcccggcgctacagcggccgggccacctgtgactgccccaactgccaggaggccgagcggctgggccctgctggggccagcctgcggaggaagggcctgcacagctgccacatccctggctgcggcaaggtgtatggcaagaccagccacctgaaggcccacctgcgctggcacactggagagcggccctttgtgtgcaactggctgttctgtgggaagcgcttcaccaggagtgatgagctgcagaggcacctgcggacccacactggagagaagagatttgcctgccctgtgtgcaacaagcgcttcatgagaagtgaccacctgagcaagcacgtgaagacccacagcggcggcggcggcggcggcggcagcgctggcagcggcagcggcggcaagaagggcagtgacacagacagcgagcacagcgctgctggcagccccccctgccacagccctgagctgctgcagcccccagagcccggccacagaaatggcctggagtag

SEQ ID NO: 171218 - DNA, 294 bp, Artificial Sequence
  Description of Artificial Sequence: Synthetic coding sequence
atggacaagcagagcagcgctggaggagtgaagaggtctgtgccctgtgacagcaatgaggccaatgagatgatgcctgagacccccaccggggacagcgacccccagcctgcccccaagaagatgaagaccagcgagagcagcaccatcctggtggtgcgctacagaagaaacttcaagaggaccagccctgaggagctgctgaatgaccacgcccgggagaaccgcatcaaccccctgcagatggaggaggaggagttcatggagatcatggtggagatcccagccaagtag

SEQ ID NO: 171219 - DNA, 294 bp, Artificial Sequence
  Description of Artificial Sequence: Synthetic coding sequence
atggacaagcagagcagcgctggaggagtgaagaggtctgtgccctgtgagagcaatgaggtgaatgagaccatgcctgagacccccaccggggacagcgacccccagcctgcccccaagaagatgaagaccagcgagagcagcaccatcctggtggtgcgctacagaagaaatgtgaagaggaccagccctgaggagctgctgaatgaccacgcccgggagaaccgcatcaaccccctgcagatggaggaggaggagttcatggagatcatggtggagatcccagccaagtag

SEQ ID NO: 171220 - DNA, 1308 bp, Artificial Sequence
  Description of Artificial Sequence: Synthetic coding sequence
atgctgcctgcccgctgtgcccggctgctgaccccccacctgctgctggtgctggtgcagctgagccctgcccggggccacaggaccaccggcccccgcttcctgatcagtgaccgggacccccagtgcaacctgcactgcagcaggacccagcccaagcccatctgtgccagtgatggccgctcctatgaatccatgtgtgagtaccagagggccaagtgccgggaccccaccctgggcgtggtgcaccggggccgctgcaaggatgctggccagagcaagtgccgcctggagcgggcccaggccctggagcaggccaagaagccccaggaggccgtgtttgtgcctgaatgtggggaggatggcagcttcacccaggtgcagtgccacacctacacaggctactgctggtgtgtgaccccagatggcaagcccatcagcggcagctctgtgcagaacaagacccctgtgtgcagcggctctgtgacagacaagcccctgagccagggcaacagcggcaggaaggatgatggcagcaagcccacccccaccatggagacccagcctgtgtttgatggagatgagatcacagcccccaccctgtggatcaagcacctggtgatcaaggacagcaagctgaacaacaccaacatcagaaattctgagaaggtgtacagctgtgaccaggagcggcagagcgccctggaggaggcccagcagaacccccgggagggcatcgtcatcccagaatgtgcccctgggggcctgtacaagcctgtgcagtgccaccagagcacaggctactgctggtgtgtgctggtggacaccggccggcccctgcccggcaccagcaccaggtatgtgatgcccagctgtgagagtgatgcccgggccaagaccacagaagcagatgaccccttcaaggaccgggagctgcccggctgcccagagggcaagaagatggagttcatcaccagcctgctggatgccctgaccacagacatggtgcaggccatcaacagcgctgcccccactggaggcggccgcttcagcgagccagaccccagccacaccctggaggagcgggtggtgcactggtacttcagccagctggacagcaacagcagcaatgacatcaacaagcgggagatgaagcccttcaagcgctacgtgaagaagaaggccaagcccaagaagtgtgcccggcgcttcacagactactgtgacctgaacaaggacaaggtgatcagcctgcctgagctgaagggctgcctgggcgtgtccaaggaggtgggccgcctggtgtag

SEQ ID NO: 171221 - DNA, 1305 bp, Artificial Sequence
  Description of Artificial Sequence: Synthetic coding sequence
atgctgcctgcccgctgtgcccggctgctgaccccccacctgctgctggtgctggtgcagctgagccctgcccggggccacaggaccaccggcccccgcttcctgatcagtgaccgggacccccagtgcaacctgcactgcagcaggacccagcccaagcccatctgtgccagtgatggccgctcctatgaatccatgtgtgagtaccagagggccaagtgccgggaccccaccctgggcgtggtgcaccggggccgctgcaaggatgctggccagagcaagtgccgcctggagcgggcccaggccctggagcaggccaagaagccccaggaggccgtgtttgtgcctgaatgtggggaggatggcagcttcacccaggtgcagtgccacacctacacaggctactgctggtgtgtgaccccagatggcaagcccatcagcggcagctctgtgcagaacaagacccctgtgtgcagcggctctgtgacagacaagcccctgagccagggcaacagcggcaggaaggatgatggcagcaagcccacccccaccatggagacccagcctgtgtttgatggagatgagatcacagcccccaccctgtggatcaagcacctggtgatcaaggacagcaagctgaacaacaccaacatcagaaattctgagaaggtgtacagctgtgaccaggagcggcagagcgccctggaggaggcccagcagaacccccgggagggcatcgtcatcccagaatgtgcccctgggggcctgtacaagcctgtgcagtgccaccagagcacaggctactgctggtgtgtgctggtggacaccggccggcccctgcccggcaccagcaccaggtatgtgatgcccagctgtgagagtgatgcccgggccaagaccacagaagcagatgaccccttcaaggaccgggagctgcccggctgcccagagggcaagaagatggagttcatcaccagcctgctggatgccctgaccacagacatggtgcaggccatcaacagcgctgcccccactggaggcggccgcttcagcgagccagaccccagccacaccctggaggagcgggtggtgcactggtacttcagccagctggacagcaacagcagcaatgacatcaacaagcgggagatgaagcccttcaagcgctacgtgaagaagaaggccaagcccaagaagtgtgcccggcgcttcacagactactgtgacctgaacaaggacaaggtgatcagcctgcctgagctgaagggctgcctgggcgtgtccaaggagggccgcctggtgtag

SEQ ID NO: 171222 - DNA, 1374 bp, Artificial Sequence
  Description of Artificial Sequence: Synthetic coding sequence
atgctgctgccccagctgtgctggctgcccctgctggccggcctgctgccccctgtgcctgcccagaagttcagcgccctgaccttcctgcgggtggaccaggacaaggacaaggactgcagcctggactgtgccggcagcccccagaagcccctgtgtgccagtgatggccgcaccttcctgagccgctgtgagttccagagggccaagtgcaaggacccccagctggagatcgcctaccggggcaactgcaaggatgtgagccgctgtgtggccgagaggaagtacacccaggagcaggccaggaaggagttccagcaggtgttcatccctgagtgcaatgatgatggcacctacagccaggtgcagtgccacagctacacaggctactgctggtgtgtgaccccaaatggccggcccatcagcggcacagctgtggcccacaagaccccccgctgccccggctctgtgaatgagaagctgccccagcgggagggcaccgggaagacagtgtccctgcagatcttctctgtgctgaacagtgatgatgctgctgccccagccctggagacccagccccagggagatgaggaggacatcgccagccgctaccccaccctgtggacagagcaggtgaagagccggcagaacaagaccaacaagaacagcgtgagcagctgtgaccaggagcaccagagcgccctggaggaggccaagcagcccaagaatgacaacgtggtgatcccagaatgtgcccatggaggcctgtacaagcctgtgcagtgccaccccagcacaggctactgctggtgtgtgctggtggacaccggccggcccatccctggcaccagcaccaggtatgagcagcccaagtgtgacaacacagcccgggcccacccagccaaggcccgggacctgtacaagggccggcagctgcagggctgccctggggccaagaagcatgagttcctgacctctgtgctggatgccctgagcacagacatggtgcacgccgccagtgaccccagcagcagcagcggccgcctgtctgagccagaccccagccacaccctggaggagcgggtggtgcactggtacttcaagctgctggacaagaacagcagcggggacatcggcaagaaggagatcaagcccttcaagcgcttcctgaggaagaagagcaagcccaagaagtgtgtgaagaagtttgtggagtactgtgatgtgaacaatgacaagagcatctctgtgcaggagctgatgggctgcctgggcgtggccaaggaggatggcaaggctgacaccaagaagaggcacaccccccggggccatgctgagagcaccagcaaccggcagcccaggaagcagggctag

SEQ ID NO: 171223 - DNA, 1341 bp, Artificial Sequence
  Description of Artificial Sequence: Synthetic coding sequence
atgctgctgccccagctgtgctggctgcccctgctggccggcctgctgccccctgtgcctgcccagaagttcagcgccctgaccttcctgcgggtggaccaggacaaggacaaggactgcagcctggactgtgccggcagcccccagaagcccctgtgtgccagtgatggccgcaccttcctgagccgctgtgagttccagagggccaagtgcaaggacccccagctggagatcgcctaccggggcaactgcaaggatgtgagccgctgtgtggccgagaggaagtacacccaggagcaggccaggaaggagttccagcaggtgttcatccctgagtgcaatgatgatggcacctacagccaggtgcagtgccacagctacacaggctactgctggtgtgtgaccccaaatggccggcccatcagcggcacagctgtggcccacaagaccccccgctgccccggctctgtgaatgagaagctgccccagcgggagggcaccgggaagacagatgatgctgctgccccagccctggagacccagccccagggagatgaagaagatattgccagccgctaccccaccctgtggacagagcaggtgaagagccggcagaacaagaccaacaagaacagcgtgagcagctgtgaccaggagcaccagagcgccctggaggaggccaagcagcccaagaatgacaacgtggtgatcccagaatgtgcccacggcggcctgtacaagcctgtgcagtgccaccccagcacaggctactgctggtgtgtgctggtggacaccggccggcccatccctggcaccagcaccaggtatgagcagcccaagtgtgacaacacagcccgggcccacccagccaaggcccgggacctgtacaagggccggcagctgcagggctgccctggggccaagaagcatgagttcctgacctctgtgctggatgccctgagcacagacatggtgcatgctgccagtgaccccagcagcagcagcggccgcctgtctgagccagaccccagccacaccctggaggagcgggtggtgcactggtacttcaagctgctggacaagaacagcagcggggacatcggcaagaaggagatcaagcccttcaagcgcttcctgaggaagaagagcaagcccaagaagtgtgtgaagaagtttgtggagtactgtgatgtgaacaatgacaagagcatctctgtgcaggagctgatgggctgcctgggcgtggccaaggaggatggcaaggctgacaccaagaagaggcacaccccccggggccacgccgagagcaccagcaaccggcagcccaggaagcagggctag

SEQ ID NO: 171224 - DNA, 1347 bp, Artificial Sequence
  Description of Artificial Sequence: Synthetic coding sequence
atgctgctgccccagctgtgctggctgcccctgctggccggcctgctgccccctgtgcctgcccagaagttcagcgccctgaccttcctgcgggtggaccaggacaaggacaaggactgcagcctggactgtgccggcagcccccagaagcccctgtgtgccagtgatggccgcaccttcctgagccgctgtgagttccagagggccaagtgcaaggacccccagctggagatcgcctaccggggcaactgcaaggatgtgagccgctgtgtggccgagaggaagtacacccaggagcaggccaggaaggagttccagcaggtgttcatccctgagtgcaatgatgatggcacctacagccaggtgcagtgccacagctacacaggctactgctggtgtgtgaccccaaatggccggcccatcagcggcacagctgtggcccacaagaccccccgctgccccggctctgtgaatgagaagctgccccagcgggagggcaccgggaagacagatgatgctgctgccccagccctggagacccagccccagggagatgaagaagatattgccagccgctaccccaccctgtggacagagcaggtgaagagccggcagaacaagaccaacaagaacagcgtgagcagctgtgaccaggagcaccagagcgccctggaggaggccaagcagcccaagaatgacaacgtggtgatcccagaatgtgcccacggcggcctgtacaagcctgtgcagtgccaccccagcacaggctactgctggtgtgtgctggtggacaccggccggcccatccctggcaccagcaccaggtatgagcagcccaagtgtgacaacacagcccgggcccacccagccaaggcccgggacctgtacaagggccggcagctgcagggctgccctggggccaagaagcatgagttcctgacctctgtgctggatgccctgagcacagacatggtgcatgctgccagtgaccccagcagcagcagcggccgcctgtctgagccagaccccagccacaccctggaggagcgggtggtgcactggtacttcaagctgctggacaagaacagcagcggggacatcggcaagaaggagatcaagcccttcaagcgcttcctgaggaagaagagcaagcccaagaagtgtgtgaagaagtttgtggagtactgtgatgtgaacaatgacaagagcatctctgtgcaggagctgatgggctgcctgggcgtggccaaggaggatggcaaggctgacaccaagaagaggcacaccccccggggccacgccgagagcaccagcaaccggcaggagaaccccaggaaggagggctag

SEQ ID NO: 171225 - DNA, 255 bp, Artificial Sequence
  Description of Artificial Sequence: Synthetic coding sequence
aagaagagcaagcccaagaagtgtgtgaagaagtttgtggagtactgtgatgtgaacaatgacaagagcatctctgtgcaggagctgatgggctgcctgggcgtggccaaggaggatggcaaggctgacaccaagaagaggcacaccccccggggccacgccgagagcaccagcaaccggcaggatgccatggtggtgagcagccggcccaaggccaccacccacaggaagagcaggaccctgagcagaagatag

SEQ ID NO: 171226 - DNA, 1275 bp, Artificial Sequence
  Description of Artificial Sequence: Synthetic coding sequence
atgagggcccctggctgcggccgcctggtgctgcccctgctgctgctggccgctgctgccctggccgagggagatgccaagggcctgaaggagggggagaccccaggcaacttcatggaggatgagcagtggctgagcagcatcagccagtacagcggcaagatcaagcactggaaccgcttcagagatgaggtggaggatgactacatcaagtcctgggaggacaaccagcagggagatgaggccctggacaccaccaaggacccctgccagaaggtgaagtgcagccgccacaaggtgtgcatcgcccagggctaccagagggccatgtgcatcagcaggaagaagctggagcaccgcatcaagcagcccaccgtgaagctgcacggcaacaaggacagcatctgcaagccctgccacatggcccagctggcctctgtgtgtggcagtgatggccacacctacagctctgtgtgcaagctggagcagcaggcctgcctgagcagcaagcagctggccgtgcgctgtgagggcccctgcccctgccccacagagcaggccgccaccagcacagcagatggcaagccagagacctgcaccggccaggacctggccgacctgggggaccggctgcgggactggttccagctgctgcacgagaacagcaagcagaatggaagtgccagctctgtggccggccctgccagcggcctggacaagagcctgggcgccagctgcaaggacagcatcggctggatgttcagcaagctggacaccagcgctgacctcttcctggaccagacagagctggccgccatcaacctggacaagtatgaggtgtgcatccggcccttcttcaacagctgtgacacctacaaggatggccgggtgtccacagctgagtggtgcttctgcttctggagggagaagccaccctgcctggccgagctggagcgcatccagatccaggaggccgccaagaagaagccaggcatcttcatccccagctgtgatgaagatggctactacaggaagatgcagtgtgaccagagcagcggggactgctggtgtgtggaccagctgggcctggagctgaccggcaccaggacccacggcagcccagactgtgatgacatcgtgggcttcagcggggactttggcagcggcgtgggctgggaggatgaggaggagaaggagacagaggaggccggggaggaggccgaggaggaggagggggaggccggggaggctgatgatggcggctacatctggtag

SEQ ID NO: 171227 - DNA, 1266 bp, Artificial Sequence
  Description of Artificial Sequence: Synthetic coding sequence
atgagggcccctggctgcggccgcctggtgctgcccctgctgctgctggccgctgctgccctggccgagggagatgccaagggcctgaaggagggggagaccccaggcaacttcatggaggatgagcagtggctgagcagcatcagccagtacagcggcaagatcaagcactggaaccgcttcagagatgatgactacatcaagtcctgggaggacaaccagcagggagatgaggccctggacaccaccaaggacccctgccagaaggtgaagtgcagccgccacaaggtgtgcatcgcccagggctaccagagggccatgtgcatcagcaggaagaagctggagcaccgcatcaagcagcccaccgtgaagctgcacggcaacaaggacagcatctgcaagccctgccacatggcccagctggcctctgtgtgtggcagtgatggccacacctacagctctgtgtgcaagctggagcagcaggcctgcctgagcagcaagcagctggccgtgcgctgtgagggcccctgcccctgccccacagagcaggccgccaccagcacagcagatggcaagccagagacctgcaccggccaggacctggccgacctgggggaccggctgcgggactggttccagctgctgcacgagaacagcaagcagaatggcagcgccagctctgtggccggccctgccagcggcctggacaagagcctgggcgccagctgcaaggacagcatcggctggatgttcagcaagctggacaccagcgctgacctcttcctggaccagacagagctggccgccatcaacctggacaagtatgaggtgtgcatccggcccttcttcaacagctgtgacacctacaaggatggccgggtgtccacagctgagtggtgcttctgcttctggagggagaagccaccctgcctggccgagctggagcgcatccagatccaggaggccgccaagaagaagccaggcatcttcatccccagctgtgatgaagatggctactacaggaagatgcagtgtgaccagagcagcggggactgctggtgtgtggaccagctgggcctggagctgaccggcaccaggacccacggcagcccagactgtgatgacatcgtgggcttcagcggggactttggaagtggagtgggctgggaggatgaggaggagaaggagacagaggaggccggggaggaggccgaggaggaggagggggaggccggggaggctgatgatggcggctacatctggtag

SEQ ID NO: 171228 - DNA, 234 bp, Artificial Sequence
  Description of Artificial Sequence: Synthetic coding sequence
atgagggcccctggctgcggccgcctggtgctgcccctgctgctgctggccgctgctgccctggccgagggagatgccaagggcctgaaggagggggagaccccaggcaacttcatggaggatgagcagtggctgagcagcatcagccagtacagcggcaagatcaagcactggaaccgcttcagagatgtgcccagcagtgacccccccagcaccacccaggccaccccctag

SEQ ID NO: 171229 - DNA, 1275 bp, Artificial Sequence
  Description of Artificial Sequence: Synthetic coding sequence
atgagggcccctggctgcggccgcctggtgctgcccctgctgctgctggccgctgctgccctggccgagggagatgccaagggcctgaaggagggggagaccccaggcaacttcatggaggatgagcagtggctgagcagcatcagccagtacagcggcaagatcaagcactggaaccgcttcagagatggcattgaagatgactacatcaagtcctgggaggacaaccagcagggagatgaggccctggacaccaccaaggacccctgccagaaggtgaagtgcagccgccacaaggtgtgcatcgcccagggctaccagagggccatgtgcatcagcaggaagaagctggagcaccgcatcaagcagcccaccgtgaagctgcacggcaacaaggacagcatctgcaagccctgccacatggcccagctggcctctgtgtgtggcagtgatggccacacctacagctctgtgtgcaagctggagcagcaggcctgcctgagcagcaagcagctggccgtgcgctgtgagggcccctgcccctgccccacagagcaggccgccaccagcacagcagatggcaagccagagacctgcaccggccaggacctggccgacctgggggaccggctgcgggactggttccagctgctgcacgagaacagcaagcagaatggaagtgccagctctgtggccggccctgccagcggcctggacaagagcctgggcgccagctgcaaggacagcatcggctggatgttcagcaagctggacaccagcgctgacctcttcctggaccagacagagctggccgccatcaacctggacaagtatgaggtgtgcatccggcccttcttcaacagctgtgacacctacaaggatggccgggtgtccacagctgagtggtgcttctgcttctggagggagaagccaccctgcctggccgagctggagcgcatccagatccaggaggccgccaagaagaagccaggcatcttcatccccagctgtgatgaagatggctactacaggaagatgcagtgtgaccagagcagcggggactgctggtgtgtggaccagctgggcctggagctgaccggcaccaggacccacggcagcccagactgtgatgacatcgtgggcttcagcggggactttggcagcggcgtgggctgggaggatgaggaggagaaggagacagaggaggccggggaggaggccgaggaggaggagggggaggccggggaggctgatgatggcggctacatctggtag

SEQ ID NO: 171230 - DNA, 1311 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgaggtggaggatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcatgaaagtggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaatggagtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171231 - DNA, 1302 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcacgagagcggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaacggggtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171232 - DNA, 1158 bp, Artificial Sequence
  Description of Artificial Sequence: Synthetic coding sequence
atgatcacccaggaccacatccacatgagcagcggcctgagccaggatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcacgagagcggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaacggggtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171233 - DNA, 1311 bp, Artificial Sequence; identical to SEQ ID NO: 171230
  Description of Artificial Sequence: Synthetic coding sequence

SEQ ID NO: 171234 - DNA, 1302 bp, Artificial Sequence; identical to SEQ ID NO: 171231
  Description of Artificial Sequence: Synthetic coding sequence

SEQ ID NO: 171235 - DNA, 348 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgaggtggaggatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccacaggtag

SEQ ID NO: 171236 - DNA, 1311 bp, Artificial Sequence; identical to SEQ ID NO: 171230
  Description of Artificial Sequence: Synthetic coding sequence

SEQ ID NO: 171237 - DNA, 486 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctgtag

SEQ ID NO: 171238 - DNA, 522 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgatgactacttccgcacctggagccctgggaagccctttgaccaggcctgcagcgacctggagttccgggaggtggccaaccggctgcgggactggttcaaggccctgcacgagagcggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctag

SEQ ID NO: 171239 - DNA, 1182 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagaggggctttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaacggggtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171240 - DNA, 1302 bp, Artificial Sequence; identical to SEQ ID NO: 171231
  Description of Artificial Sequence: Synthetic coding sequence

SEQ ID NO: 171241 - DNA, 1311 bp, Artificial Sequence; identical to SEQ ID NO: 171230
  Description of Artificial Sequence: Synthetic coding sequence

SEQ ID NO: 171242 - DNA, 348 bp, Artificial Sequence; identical to SEQ ID NO: 171235
  Description of Artificial Sequence: Synthetic coding sequence

SEQ ID NO: 171243 - DNA, 942 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttcagagatgatgactacttccgcacctggagccctgggaagccctttgaccaggccctggaccctgccaaggacccctgcctgaagatgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcacgagagcggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcagggcaagaggtag

SEQ ID NO: 171244 - DNA, 1017 bp, Artificial Sequence
  Description of Artificial Sequence: Synthetic coding sequence
atgctgaaggtgtctgctgtgctgtgtgtgtgtgccgccgcctggtgcagccagagcctggccgctgctgctgctgtggccgctgctgggggccgcagtgatggcggcaacttcctggatgacaagcagtggctgaccaccatcagccagtatgacaaggaggtgggccagtggaacaagttccgggactgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcatgaaagtggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaatggagtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171245 - DNA, 1023 bp, Artificial Sequence
  Description of Artificial Sequence: Synthetic coding sequence
atgatcaacaacggcagcccccagagcctgtccatgaccaggaagagtgacagcggcaccaacagcgagaccatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcatgaaagtggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaatggagtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171246 - DNA, 915 bp, Artificial Sequence
  Description of Artificial Sequence: Synthetic coding sequence
atgaagtgcagccgccacaaggtgtgcatcgcccaggacagccagacagctgtgtgcatcagccaccggcggctgacccacaggatgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagaggggctttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaatggagtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171247 - DNA, 951 bp, Artificial Sequence
  Description of Artificial Sequence: Synthetic coding sequence
atgaaggaggccggcgtggaccaccggcagtggaggggccccatcctgagcacctgcaagcagtgccctgtggtgtaccccagccctgtgtgtggcagtgatggccacacctacagcttccagtgcaagctggagtaccaggcctgtgtgctgggcaagcagatctctgtgaagtgtgagggccactgcccctgccccagcgacaagcccaccagcaccagcagaaatgtgaagagggcctgcagcgacctggagttccgggaggtggccaaccggctgcgggactggttcaaggccctgcatgaaagtggcagccagaacaagaagaccaagaccctgctgcggcctgagaggagcagatttgacaccagcatcctgcccatctgcaaggacagcctgggctggatgttcaaccggctggacaccaactatgacctgctgctggaccagagcgagctgcggagcatctacctggacaagaatgagcagtgcaccaaggccttcttcaacagctgtgacacctacaaggacagcctcatcagcaacaatgagtggtgctactgcttccagaggcagcaggaccccccctgccagacagagctgagcaacatccagaagaggcagggcgtgaagaagctgctgggccagtacatccccctgtgtgatgaagatggctactacaagcccacccagtgccacggctctgtgggccagtgctggtgtgtggacagatatggaaatgaggtgatgggcagccgcatcaatggagtggccgactgtgccatcgactttgagatcagcggggactttgccagcggggacttccacgagtggacagatgatgaagatgatgaagatgacatcatgaatgatgaagatgaaattgaagatgatgatgaagatgaaggagatgatgatgatggaggagatgaccatgatgtgtacatctag

SEQ ID NO: 171248 - DNA, 1017 bp, Artificial Sequence; identical to SEQ ID NO: 171244
  Description of Artificial Sequence: Synthetic coding sequence

SEQ ID NO: 171249 - DNA, 13740 bp, Artificial Sequence
  Description of Artificial Sequence: Synthetic coding sequence
atggagaccaaggaaaatcgctgggtgcctgtgacagtgctgcccggctgtgtgggctgcaggacagtggccgccctggcctcctggacagtgagagatgtgaaggagcgcatctttgctgagaccggcttccctgtgtctgagcagaggctgtggaggggcggccgggagctgagtgactggatcaagatcggggacctgaccagcaagaactgccacctgtttgtgaacctgcagagcaagggcctgaagggcggcggccgcttcggccagaccaccccacccctggtggacttcctgaaggacatcctgcggcgctacccagagggcggccagatcctgaaggagctgatccagaatgcagaagatgctggggccacagaggtgaagttcctgtatgatgagacccagtatggaacagagaccctgtggagcaaggacatggccccctaccagggccctgccctgtatgtgtacaacaatgctgtgttcaccccagaggactggcacggcatccaggagatcgcccggagcaggaagaaggatgaccccctgaaggtgggccgcttcggcatcggcttcaacagcgtgtaccacatcacagatgtgccctgcatcttcagcggggaccagatcggcatgctggacccccaccagaccctgtttggcccccatgaaagtggccagtgctggaacctgaaggatgacagcaaggagatcagcgagctgagtgaccagtttgccccctttgtgggcatcttcggcagcaccaaggagaccttcatcaatggaaacttccctggcaccttcttccgcttccccctgcggctgcagcccagccagctgagcagcaacctgtacaacaagcagaaggtgctggagctgtttgagagcttccgggcagatgctgacacagtgctgctcttcctgaagtctgtgcaggatgtgtccctgtatgtgcgggaggctgatggaacagagaagctggtgttccgggtgaccagcagcgagagcaaggccctgaagcatgagcggcccaacagcatcaagatcctgggcacagccatcagcaactactgcaagaagacccccagcaacaacatcacctgtgtgacctaccacgtgaacatcgtgctggaggaggagagcaccaaggatgcccagaagacctcctggctggtgtgcaacagcgtgggcggccggggcatcagcagcaagctggacagcctggctgatgagctgaagtttgtgcccatcatcggcatcgccatgcccctgagcagcagagatgatgaggccaagggggccaccagtgacttcagcggcaaggccttctgcttcctgcccctgcccccaggagaggagagcagcacaggcctgcctgtgcacatcagcggcttcttcggcctgacagacaacagaagaagcatcaagtggagggagctggaccagtggagggaccctgctgccctgtggaatgagttcctggtgatgaatgtggtgcccaaggcctatgccaccctcatcctggacagcatcaagaggctggagatggagaagagcagtgacttccccctgtctgtggatgtgatctacaagctgtggccagaggccagcaaggtgaaggtgcactggcagcctgtgctggagcccctcttcagcgagctgctgcagaatgctgtgatctacagcatcagctgtgactgggtgcggctggagcaggtgtacttcagcgagctggatgagaacctggagtacaccaagacagtgctgaactacctgcagagcagcggcaagcagatcgccaaggtgcctggaaatgtggatgctgctgtgcagctgacagctgccagcggcaccacccctgtgaggaaggtgaccccagcctgggtgcggcaggtgctgaggaaatgtgcccacctgggctgtgccgaggagaagctgcacctgctggagtttgtgctgagtgaccaggcctacagcgagctgctgggcctggagctgctgcccctgcagaatggaaactttgtgcccttcagcagctctgtgtctgaccaggatgtgatctacatcaccagcgctgagtaccccaggagcctcttccccagcctggagggccgcttcatcctggacaacctgaagccccacctggtggccgccctgaaggaggccgcccagacccggggccggccctgcacccagctgcagctgctgaaccctgagagatttgcccggctcatcaaggaggtgatgaacaccttctggccaggccgggagctgattgtgcagtggtacccctttgatgaaaatagaaaccaccccagcgtgtcctggctgaagatggtgtggaagaacctgtacatccacttcagcgaggacctgaccctgtttgatgagatgcccctcatccccaggaccatcctggaggagggccagacctgtgtggagctgatccggctgcgcatccccagcctggtgatcctggatgatgagagcgaggcccagctgcctgagttcctggccgacatcgtgcagaagctgggcggctttgtgctgaagaagctggatgccagcatccagcaccccctcatcaagaagtacatccacagccccctgcccagcgctgtgctgcagatcatggagaagatgcccctgcagaagctgtgcaaccagatcaccagcctgctgcccacccacaaggatgccctgaggaagttcctggccagcctgacagacagcagcgagaaggagaagaggatcatccaggagctggccatcttcaagaggatcaaccacagcagtgaccagggcatcagcagctacaccaagctgaagggctgcaaggtgctgcaccacacagccaagctgcctgctgacctgcggctgagcatctctgtgattgacagcagtgatgaggccaccatccggctggccaacatgctgaagattgagcagctgaagaccaccagctgcctgaagctggtgctgaaggacattgaaaatgccttctacagccatgaggaggtgacccagctgatgctgtgggtgctggagaacctgagcagcctgaagaatgaaaaccccaacgtgctggagtggctgacccccctgaagttcatccagatcagccaggagcagatggtgtctgctggggagctgtttgatcctgacatcgaggtgctgaaggacctcttctgcaatgaggagggcacctacttcccccccagcgtcttcaccagcccagacatcctgcacagcctgcggcagatcggcctgaagaatgaggccagcctgaaggagaaggatgtggtgcaggtggccaagaagattgaggccctgcaggtgggcgcctgcccagaccaggatgtgctgctgaagaaggccaagaccctgctgctggtgctgaacaagaaccacaccctgctgcagagcagcgagggcaagatgaccctgaagaagatcaagtgggtgcctgcctgcaaggagcggccccccaactacccaggcagcctggtgtggaagggggacctgtgcaacctgtgtgcccccccagacatgtgtgatgtgggccacgccatcctgattggcagcagcctgcccctggtggagagcatccacgtgaacctggagaaggccctgggcatcttcaccaagcccagcctgtctgctgtgctgaagcacttcaagatcgtggtggactggtacagcagcaagaccttcagtgatgaggactactaccagttccagcacatcctgctggagatctacggcttcatgcatgaccacctgaatgaaggcaaggacagcttccgggccctgaagttcccctgggtgtggacaggcaagaagttctgccccctggcccaggccgtcatcaagcccatccatgacctggacctgcagccctacctgcacaacgtgcccaagaccatggccaagttccaccagctgttcaaggtgtgtggcagcattgaggagctgaccagtgaccacatctccatggtgatccagaagatctacctgaagagtgaccaggacctgtctgagcaggagagcaagcagaacctgcacctgatgctgaacatcatccgctggctgtacagcaaccagatcccagccagccccaacacccctgtgcccatccaccacagcaagaaccccagcaagctgatcatgaagcccatccacgagtgctgctactgtgacatcaaggtggatgacctgaatgacctgctggaggacagcgtggagcccatcatcctggtgcatgaggacatccccatgaagacagctgagtggctgaaggtgccctgcctgagcaccaggctcatcaaccctgagaacatgggctttgagcagagcggccagcgggagcccctgactgtgcgcatcaagaacatcctggaggagtaccccagcgtgtctgacatcttcaaggagctgctgcagaatgctgatgatgccaatgccacagagtgcagcttcctgattgacatgagaagaaacatggacatccgggagaacctgctggaccccggcatggccgcctgccacggccctgccctgtggagcttcaacaacagccagttcagtgacagcgactttgtgaacatcacccggctgggggagagcctgaagagaggagaggtggacaaggtgggcaagtttggcctgggcttcaacagcgtgtaccacatcacagacatccccatcatcatgagccgggagttcatgatcatgtttgaccccaacatcaaccacatcagcaagcacatcaaggacaagagcaaccctggcatcaagatcaactggagcaagcagcagaagaggctgaggaagttccccaaccagttcaagcccttcattgatgtgtttggctgccagctgcccctgactgtggaggccccctacagctacaacggcaccctcttccggctgtccttccgcacccagcaggaggccaaggtgtctgaggtgagcagcacctgctacaacacagctgacatctacagcctggtggatgagttcagcctgtgtggccacaggctcatcatcttcacccagagcgtgaagtccatgtacctgaagtacctgaagattgaggagaccaaccccagcctggcccaggacaccgtcatcatcaagaagaagagctgcagcagcaaggccctgaacacccctgtgctgtctgtgctgaaggaggccgccaagctgatgaagacctgcagcagcagcaacaagaagctgcccagtgatgagcccaagagcagctgcatcctgcagatcaccgtggaggagttccaccacgtgttcagaagaattgctgacctgcagagccccctcttccggggcccagatgatgatcctgctgccctgtttgagatggccaagagcggccagagcaagaagcccagtgatgagctgagccagaagacagtggagtgcaccacctggctgctgtgcacctgcatggacaccggggaggccctgaagttcagcctgtctgagagcggccgccgcctgggcctggtgccctgtggggctgtgggcgtgcagctgtctgagatccaggaccagaagtggacagtgaagccccacatcggggaggtgttctgctacctgcccctgcgcatcaagacaggcctgcctgtgcacatcaatggctgctttgctgtgaccagcaacaggaaggagatctggaagacagacaccaagggccgctggaacaccaccttcatgagacatgtgattgtgaaggcctacctgcaggtgctgtctgtgctgcgggacctggccaccagcggggagctgatggactacacctactatgctgtgtggccagaccctgacctggtgcatgatgacttcagcgtcatctgccagggcttctatgaagatattgcccacggcaagggcaaggagctgaccaaggtgttcagtgatggcagcacctgggtgtccatgaagaatgtgcgcttcctggatgacagcatcctgaagagaagagatgtgggcagcgctgccttcaagatcttcctgaagtacctgaagaagacaggcagcaagaacctgtgtgctgtggagctgcccagctctgtgaagctgggctttgaggaggccggctgcaagcagatcctgctggagaacaccttcagcgagaagcagttcttcagcgaggtgttcttccccaacatccaggagattgaggccgagctgcgggaccccctgatgatctttgtgctgaatgagaaggtggatgagttctctggagtgctgcgggtgaccccctgcatcccctgcagcctggagggccaccccctggtgctgcccagccgcctcatccaccctgagggccgggtggccaagctgtttgacatcaaggatggccgcttcccctacggcagcacccaggactacctgaaccccatcatcctgatcaagctggtgcagctgggcatggccaaggatgacatcctgtgggatgacatgctggagagagctgtgtctgtggccgagatcaacaagagtgaccacgtggccgcctgcctgcggagcagcatcctgctgagcctgattgatgagaagctgaagatccgggacccccgggccaaggactttgctgccaagtaccagaccatccgcttcctgcccttcctgaccaagccagctggcttcagcctggactggaagggcaacagcttcaagccagagaccatgtttgctgccacagacctgtacacagctgagcaccaggacatcgtgtgcctgctgcagcccatcctgaatgaaaacagccacagcttccggggctgcggctctgtgtccctggccgtgaaggagttcctgggcctgctgaagaagcccaccgtggacctggtgatcaaccagctgaaggaggtggccaagtctgtggatgatggcatcaccctgtaccaggagaacatcaccaatgcctgctacaagtacctgcacgaggccctgatgcagaatgagatcaccaagatgagcatcatcgacaagctgaagcccttctccttcatcctggtggagaatgcctacgtggacagcgagaaggtgtccttccacctgaactttgaagctgccccctacctgtaccagctgcccaacaagtacaagaacaacttccgggagctgtttgagaccgtgggcgtgcggcagagctgcaccgtggaggactttgccctggtgctggagagcattgaccaggagcggggcaccaagcagatcacagaggagaacttccagctgtgccgccgcatcatcagcgagggcatctggagcctcatccgggagaagaagcaggagttctgtgagaagaactacggcaagatcctgctgcctgacaccaacctgatgctgctgcctgccaagagcctgtgctacaatgactgcccctggatcaaggtgaaggacaccaccgtgaagtactgccacgccgacatcccccgggaggtggccgtgaagctgggcgctgtgcccaagaggcacaaggccctggagagatatgccagcaatgtgtgcttcaccaccctgggcacagaatttggccagaaggagaagctgaccagccgcatcaagagcatcctgaatgcctaccccagcgagaaggagatgctgaaggagctgctgcagaatgctgatgatgccaaggccacagagatctgctttgtgtttgacccccggcagcaccctgtggaccgcatctttgatgacaagtgggcccccctgcagggccctgccctgtgtgtgtacaacaaccagcccttcacagaagatgatgtgcggggcatccagaacctgggcaagggcaccaaggagggcaacccctacaagacaggccagtatggcatcggcttcaacagcgtgtaccacatcacagactgccccagcttcatctctggaaatgacatcctgtgcatctttgacccccacgcccgctatgcccctggggccaccagcatcagccctggccgcatgttccgggacctggatgctgacttccgcacccagttcagtgatgtgctggacctgtacctgggcacccacttcaagctggacaactgcaccatgttccgcttccccctgagaaatgctgagatggccaaggtgtctgagatcagctctgtgcctgccagtgacaggatggtgcagaacctgctggacaagctgcggagtgatggagctgagctgctgatgttcctgaaccacatggagaagatcagcatctgtgaaattgacaagagcactggagccctgaatgtgctgtacagcgtgaagggcaagatcacagatggagaccggctgaagaggaagcagttccacgcctctgtgattgattctgtgaccaagaagaggcagctgaaggacatccctgtgcagcagatcacctacaccatggacacagaagattctgagggcaacctgaccacctggctgatctgcaacagaagtggcttcagctccatggagaaggtgtccaagagcgtcatcagcgcccacaagaaccaggacatcaccctcttcccccggggcggcgtggccgcctgcatcacccacaactacaagaagccccaccgggccttctgcttcctgcccctgagcctggagaccggcctgcccttccacgtgaatggccactttgccctggacagcgcccggaggaacctgtggagagatgacaatggagtgggcgtgcggagtgactggaacaacagcctgatgacagccctgattgccccagcctacgtggagctgctgatccagctgaagaagcgctacttccctggcagtgaccccaccctgtctgtgctgcagaacacccccatccacgtggtgaaggacaccctgaagaagttcctgtccttcttccctgtgaaccggctggacctgcagcctgacctgtactgcctggtgaaggccctgtacaactgcatccacgaggacatgaagaggctgctgcctgtggtgcgggcccccaacattgatggcagtgacctgcacagcgctgtgatcatcacctggatcaacatgagcaccagcaacaagacccggcccttctttgacaacctgctgcaggatgagctgcagcacctgaagaatgctgactacaacatcaccaccaggaagacagtggctgaaaatgtgtaccgcctgaagcacctgctgctggagatcggcttcaacctggtgtacaactgtgatgaaacagccaacctgtaccactgcctgattgatgctgacatccctgtgtcctatgtgaccccagctgacatccgctccttcctgatgaccttcagcagcccagacaccaactgccacatcggcaagctgccctgccgcctgcagcagaccaacctgaagctgttccacagcctgaagctgctggtggactactgcttcaaggatgctgaagaaaatgaaattgaggtggagggcctgcccctgctgatcaccctggacagcgtgctgcagacctttgatgccaagaggcccaagttcctgaccacctaccacgagctgatccccagcaggaaggacctcttcatgaacaccctgtacctgaagtacagcaacatcctgctgaactgcaaggtggccaaggtgtttgacatcagcagctttgctgacctgctgagctctgtgctgccccgggagtacaagaccaagagctgcaccaagtggaaggacaactttgccagcgagagctggctgaagaatgcctggcacttcatcagcgagagcgtgtctgtgaaggaggaccaggaggagaccaagcccacctttgacatcgtggtggacaccctgaaggactgggccctgctgcccggcaccaagttcaccgtgtctgccaaccagctggtggtgcctgaaggagatgtgctgctgcccctgagcctgatgcacatcgctgtgttccccaatgcccagagcgacaaggtgttccacgccctgatgaaggccggctgcatccagctggccctgaacaagatctgcagcaaggacagcgcctttgtgcccctgctgagctgccacacagccaacatcgagagccccaccagcatcctgaaggccctgcactacatggtgcagaccagcaccttccgggcagagaagctggtggagaatgactttgaggccctgctgatgtacttcaactgcaacctgaaccacctgatgagccaggatgacatcaagatcctgaagagcctgccctgctacaagagcatcagcggccgctacgtgtccatcggcaagtttggcacctgctacgtgctgaccaagagcatccccagcgctgaggtggagaagtggacccagagcagcagcagcgccttcctggaggagaagatccacctgaaggagctgtatgaagtcatcggctgtgtgcctgtggatgacctggaggtgtacctgaagcacctgctgcccaagattgagaacctgtcctatgatgccaagctggagcacctgatctacctgaagaaccggctgagcagcgctgaggagctgtctgagatcaaggagcagctgtttgagaagctggagagcctgctgatcatccatgatgccaacagccggctgaagcaggccaagcacttctatgacagaacagtgcgggtgtttgaggtgatgctgcctgagaagctgttcatccccaatgacttcttcaagaagctggagcagctgatcaagcccaagaaccacgtgaccttcatgacctcctgggtggagttcctgagaaatattggcctgaagtacatcctgagccagcagcagctgctgcagtttgccaaggagatctctgtgcgggccaacacagagaactggagcaaggagaccctgcagaacacagtggacatcctgctgcaccacatcttccaggagaggatggacctgctgagcggcaacttcctgaaggagctgagcctcatccccttcctgtgcccagagcgggccccagctgagttcatccgcttccacccccagtaccaggaggtgaatggcaccctgcccctcatcaagttcaatggagcccaggtgaaccccaagttcaagcagtgtgatgtgctgcagctgctgtggaccagctgccccatcctgcctgagaaggccacccccctgagcatcaaggagcaggagggcagtgacctgggcccccaggagcagctggagcaggtgctgaacatgctgaatgtgaacctggacccccccctggacaaggtgatcaacaactgcaggaacatctgcaacatcaccaccctggatgaggagatggtgaagacccgggccaaggtgctgcggagcatctatgagttcctgtctgctgagaagcgggagttccgcttccagctgcggggcgtggcctttgtgatggtggaggatggctggaagctgctgaagccagaggaggtggtgatcaacctggagtatgaaagtgacttcaagccctacctgtacaagctgcccctggagctgggcaccttccaccagctgttcaagcacctgggcacagaggacatcatcagcaccaagcagtatgtggaggtgctgagccgcatcttcaagaacagcgagggcaagcagctggaccccaatgagatgaggacagtgaagagggtggtgtctggcctcttccgcagcctgcagaatgacagcgtgaaggtgcggagtgacctggagaatgtgcgggacctggccctgtacctgcccagccaggacggccgcctggtgaagagcagcatcctggtgtttgatgatgccccccactacaagagccgcatccagggcaacatcggcgtgcagatgctggtggacctgagccagtgctacctgggcaaggaccacggcttccacaccaagctgatcatgctgttcccccagaagctgcggccccggctgctgagcagcatcctggaggagcagctggatgaggagacccccaaggtgtgccagtttggagccctgtgcagcctgcagggccgcctgcagctgctgctgagcagcgagcagttcatcaccggcctcatccgcatcatgaagcatgaaaatgacaatgccttcctggccaatgaggagaaggccatccggctgtgcaaggccctgcgggagggcctgaaggtgtcctgctttgagaagctgcagaccaccctgcgggtgaagggcttcaaccccatcccccacagccgctctgagacctttgccttcctgaagagatttggaaatgctgtgatcctgctgtacatccagcacagcgacagcaaggacatcaacttcctgctggccctggccatgaccctgaagagcgccacagacaacctgatcagtgacaccagctacctgattgccatgctgggctgcaatgacatctaccgcatcggggagaagctggacagcctgggcgtgaagtatgacagcagcgagcccagcaagctggagctgcccatgcctggcacccccatcccagctgagatccactacaccctgctgatggaccccatgaatgtgttctacccaggagaatatgtgggctacctggtggatgctgagggcggggacatctacggcagctaccagcccacctacacctacgccatcatcgtgcaggaggtggagagagaagatgctgacaacagcagcttcctgggcaagatctaccagattgatattggctacagcgagtacaagatcgtgagcagcctggacctgtacaagttcagcaggcctgaggagagcagccagagccgggacagcgcccccagcacccccaccagccccacagagttcctgaccccaggcctgcggagcatccccccactcttcagcggccgggagagccacaagaccagcagcaagcaccagagccccaagaagctgaaggtgaacagcctgcctgagatcctgaaggaggtgacctctgtggtggagcaggcctggaagctgcctgagagcgagaggaagaagatcatccggcggctgtacctgaagtggcacccagacaagaacccagaaaatcatgacatcgccaatgaggtgttcaagcacctgcagaatgagatcaaccggctggagaagcaggccttcctggaccagaatgctgaccgggccagcaggaggaccttcagcaccagcgccagccgcttccagagcgacaagtacagcttccagcgcttctacacctcctggaaccaggaggccaccagccacaagtctgagcggcagcagcagaacaaggagaagtgccccccatctgctggccagacctacagccagcgcttctttgtgccccccaccttcaagtctgtgggcaaccctgtggaggcccggcgctggctgcggcaggcccgggccaacttctctgctgccagaaatgacctgcacaagaatgccaatgagtgggtgtgcttcaagtgctacctgagcaccaagctggccctgattgctgctgactatgctgtgcggggcaagagtgacaaggatgtgaagcccacagccctggcccagaagattgaggagtacagccagcagctggagggcctgaccaatgatgtgcacaccctggaggcctatggagtggacagcctgaagacccgctacccagacctgctgcccttcccccagatccccaatgaccgcttcaccagcgaggtggccatgagggtgatggagtgcacagcctgcatcatcatcaagctggagaacttcatgcagcagaaggtgtag

SEQ ID NO: 171250 - DNA, 13740 bp, Artificial Sequence; identical to SEQ ID NO: 171249
  Description of Artificial Sequence: Synthetic coding sequence

SEQ ID NO: 171251 - DNA, 11490 bp, Artificial Sequence
  Description of Artificial Sequence: Synthetic coding sequence
atgaacaccttctggccaggccgggagctgattgtgcagtggtacccctttgatgaaaatagaaaccaccccagcgtgtcctggctgaagatggtgtggaagaacctgtacatccacttcagcgaggacctgaccctgtttgatgagatgcccctcatccccaggaccatcctggaggagggccagacctgtgtggagctgatccggctgcgcatccccagcctggtgatcctggatgatgagagcgaggcccagctgcctgagttcctggccgacatcgtgcagaagctgggcggctttgtgctgaagaagctggatgccagcatccagcaccccctcatcaagaagtacatccacagccccctgcccagcgctgtgctgcagatcatggagaagatgcccctgcagaagctgtgcaaccagatcaccagcctgctgcccacccacaaggatgccctgaggaagttcctggccagcctgacagacagcagcgagaaggagaagaggatcatccaggagctggccatcttcaagaggatcaaccacagcagtgaccagggcatcagcagctacaccaagctgaagggctgcaaggtgctgcaccacacagccaagctgcctgctgacctgcggctgagcatctctgtgattgacagcagtgatgaggccaccatccggctggccaacatgctgaagattgagcagctgaagaccaccagctgcctgaagctggtgctgaaggacattgaaaatgccttctacagccatgaggaggtgacccagctgatgctgtgggtgctggagaacctgagcagcctgaagaatgaaaaccccaacgtgctggagtggctgacccccctgaagttcatccagatcagccaggagcagatggtgtctgctggggagctgtttgatcctgacatcgaggtgctgaaggacctcttctgcaatgaggagggcacctacttcccccccagcgtcttcaccagcccagacatcctgcacagcctgcggcagatcggcctgaagaatgaggccagcctgaaggagaaggatgtggtgcaggtggccaagaagattgaggccctgcaggtgggcgcctgcccagaccaggatgtgctgctgaagaaggccaagaccctgctgctggtgctgaacaagaaccacaccctgctgcagagcagcgagggcaagatgaccctgaagaagatcaagtgggtgcctgcctgcaaggagcggccccccaactacccaggcagcctggtgtggaagggggacctgtgcaacctgtgtgcccccccagacatgtgtgatgtgggccacgccatcctgattggcagcagcctgcccctggtggagagcatccacgtgaacctggagaaggccctgggcatcttcaccaagcccagcctgtctgctgtgctgaagcacttcaagatcgtggtggactggtacagcagcaagaccttcagtgatgaggactactaccagttccagcacatcctgctggagatctacggcttcatgcatgaccacctgaatgaaggcaaggacagcttccgggccctgaagttcccctgggtgtggacaggcaagaagttctgccccctggcccaggccgtcatcaagcccatccatgacctggacctgcagccctacctgcacaacgtgcccaagaccatggccaagttccaccagctgttcaaggtgtgtggcagcattgaggagctgaccagtgaccacatctccatggtgatccagaagatctacctgaagagtgaccaggacctgtctgagcaggagagcaagcagaacctgcacctgatgctgaacatcatccgctggctgtacagcaaccagatcccagccagccccaacacccctgtgcccatccaccacagcaagaaccccagcaagctgatcatgaagcccatccacgagtgctgctactgtgacatcaaggtggatgacctgaatgacctgctggaggacagcgtggagcccatcatcctggtgcatgaggacatccccatgaagacagctgagtggctgaaggtgccctgcctgagcaccaggctcatcaaccctgagaacatgggctttgagcagagcggccagcgggagcccctgactgtgcgcatcaagaacatcctggaggagtaccccagcgtgtctgacatcttcaaggagctgctgcagaatgctgatgatgccaatgccacagagtgcagcttcctgattgacatgagaagaaacatggacatccgggagaacctgctggaccccggcatggccgcctgccacggccctgccctgtggagcttcaacaacagccagttcagtgacagcgactttgtgaacatcacccggctgggggagagcctgaagagaggagaggtggacaaggtgggcaagtttggcctgggcttcaacagcgtgtaccacatcacagacatccccatcatcatgagccgggagttcatgatcatgtttgaccccaacatcaaccacatcagcaagcacatcaaggacaagagcaaccctggcatcaagatcaactggagcaagcagcagaagaggctgaggaagttccccaaccagttcaagcccttcattgatgtgtttggctgccagctgcccctgactgtggaggccccctacagctacaacggcaccctcttccggctgtccttccgcacccagcaggaggccaaggtgtctgaggtgagcagcacctgctacaacacagctgacatctacagcctggtggatgagttcagcctgtgtggccacaggctcatcatcttcacccagagcgtgaagtccatgtacctgaagtacctgaagattgaggagaccaaccccagcctggcccaggacaccgtcatcatcaagaagaagagctgcagcagcaaggccctgaacacccctgtgctgtctgtgctgaaggaggccgccaagctgatgaagacctgcagcagcagcaacaagaagctgcccagtgatgagcccaagagcagctgcatcctgcagatcaccgtggaggagttccaccacgtgttcagaagaattgctgacctgcagagccccctcttccggggcccagatgatgatcctgctgccctgtttgagatggccaagagcggccagagcaagaagcccagtgatgagctgagccagaagacagtggagtgcaccacctggctgctgtgcacctgcatggacaccggggaggccctgaagttcagcctgtctgagagcggccgccgcctgggcctggtgccctgtggggctgtgggcgtgcagctgtctgagatccaggaccagaagtggacagtgaagccccacatcggggaggtgttctgctacctgcccctgcgcatcaagacaggcctgcctgtgcacatcaatggctgctttgctgtgaccagcaacaggaaggagatctggaagacagacaccaagggccgctggaacaccaccttcatgagacatgtgattgtgaaggcctacctgcaggtgctgtctgtgctgcgggacctggccaccagcggggagctgatggactacacctactatgctgtgtggccagaccctgacctggtgcatgatgacttcagcgtcatctgccagggcttctatgaagatattgcccacggcaagggcaaggagctgaccaaggtgttcagtgatggcagcacctgggtgtccatgaagaatgtgcgcttcctggatgacagcatcctgaagagaagagatgtgggcagcgctgccttcaagatcttcctgaagtacctgaagaagacaggcagcaagaacctgtgtgctgtggagctgcccagctctgtgaagctgggctttgaggaggccggctgcaagcagatcctgctggagaacaccttcagcgagaagcagttcttcagcgaggtgttcttccccaacatccaggagattgaggccgagctgcgggaccccctgatgatctttgtgctgaatgagaaggtggatgagttctctggagtgctgcgggtgaccccctgcatcccctgcagcctggagggccaccccctggtgctgcccagccgcctcatccaccctgagggccgggtggccaagctgtttgacatcaaggatggccgcttcccctacggcagcacccaggactacctgaaccccatcatcctgatcaagctggtgcagctgggcatggccaaggatgacatcctgtgggatgacatgctggagagagctgtgtctgtggccgagatcaacaagagtgaccacgtggccgcctgcctgcggagcagcatcctgctgagcctgattgatgagaagctgaagatccgggacccccgggccaaggactttgctgccaagtaccagaccatccgcttcctgcccttcctgaccaagccagctggcttcagcctggactggaagggcaacagcttcaagccagagaccatgtttgctgccacagacctgtacacagctgagcaccaggacatcgtgtgcctgctgcagcccatcctgaatgaaaacagccacagcttccggggctgcggctctgtgtccctggccgtgaaggagttcctgggcctgctgaagaagcccaccgtggacctggtgatcaaccagctgaaggaggtggccaagtctgtggatgatggcatcaccctgtaccaggagaacatcaccaatgcctgctacaagtacctgcacgaggccctgatgcagaatgagatcaccaagatgagcatcatcgacaagctgaagcccttctccttcatcctggtggagaatgcctacgtggacagcgagaaggtgtccttccacctgaactttgaagctgccccctacctgtaccagctgcccaacaagtacaagaacaacttccgggagctgtttgagaccgtgggcgtgcggcagagctgcaccgtggaggactttgccctggtgctggagagcattgaccaggagcggggcaccaagcagatcacagaggagaacttccagctgtgccgccgcatcatcagcgagggcatctggagcctcatccgggagaagaagcaggagttctgtgagaagaactacggcaagatcctgctgcctgacaccaacctgatgctgctgcctgccaagagcctgtgctacaatgactgcccctggatcaaggtgaaggacaccaccgtgaagtactgccacgccgacatcccccgggaggtggccgtgaagctgggcgctgtgcccaagaggcacaaggccctggagagatatgccagcaatgtgtgcttcaccaccctgggcacagaatttggccagaaggagaagctgaccagccgcatcaagagcatcctgaatgcctaccccagcgagaaggagatgctgaaggagctgctgcagaatgctgatgatgccaaggccacagagatctgctttgtgtttgacccccggcagcaccctgtggaccgcatctttgatgacaagtgggcccccctgcagggccctgccctgtgtgtgtacaacaaccagcccttcacagaagatgatgtgcggggcatccagaacctgggcaagggcaccaaggagggcaacccctacaagacaggccagtatggcatcggcttcaacagcgtgtaccacatcacagactgccccagcttcatctctggaaatgacatcctgtgcatctttgacccccacgcccgctatgcccctggggccaccagcatcagccctggccgcatgttccgggacctggatgctgacttccgcacccagttcagtgatgtgctggacctgtacctgggcacccacttcaagctggacaactgcaccatgttccgcttccccctgagaaatgctgagatggccaaggtgtctgagatcagctctgtgcctgccagtgacaggatggtgcagaacctgctggacaagctgcggagtgatggagctgagctgctgatgttcctgaaccacatggagaagatcagcatctgtgaaattgacaagagcactggagccctgaatgtgctgtacagcgtgaagggcaagatcacagatggagaccggctgaagaggaagcagttccacgcctctgtgattgattctgtgaccaagaagaggcagctgaaggacatccctgtgcagcagatcacctacaccatggacacagaagattctgagggcaacctgaccacctggctgatctgcaacagaagtggcttcagctccatggagaaggtgtccaagagcgtcatcagcgcccacaagaaccaggacatcaccctcttcccccggggcggcgtggccgcctgcatcacccacaactacaagaagccccaccgggccttctgcttcctgcccctgagcctggagaccggcctgcccttccacgtgaatggccactttgccctggacagcgcccggaggaacctgtggagagatgacaatggagtgggcgtgcggagtgactggaacaacagcctgatgacagccctgattgccccagcctacgtggagctgctgatccagctgaagaagcgctacttccctggcagtgaccccaccctgtctgtgctgcagaacacccccatccacgtggtgaaggacaccctgaagaagttcctgtccttcttccctgtgaaccggctggacctgcagcctgacctgtactgcctggtgaaggccctgtacaactgcatccacgaggacatgaagaggctgctgcctgtggtgcgggcccccaacattgatggcagtgacctgcacagcgctgtgatcatcacctggatcaacatgagcaccagcaacaagacccggcccttctttgacaacctgctgcaggatgagctgcagcacctgaagaatgctgactacaacatcaccaccaggaagacagtggctgaaaatgtgtaccgcctgaagcacctgctgctggagatcggcttcaacctggtgtacaactgtgatgaaacagccaacctgtaccactgcctgattgatgctgacatccctgtgtcctatgtgaccccagctgacatccgctccttcctgatgaccttcagcagcccagacaccaactgccacatcggcaagctgccctgccgcctgcagcagaccaacctgaagctgttccacagcctgaagctgctggtggactactgcttcaaggatgctgaagaaaatgaaattgaggtggagggcctgcccctgctgatcaccctggacagcgtgctgcagacctttgatgccaagaggcccaagttcctgaccacctaccacgagctgatccccagcaggaaggacctcttcatgaacaccctgtacctgaagtacagcaacatcctgctgaactgcaaggtggccaaggtgtttgacatcagcagctttgctgacctgctgagctctgtgctgccccgggagtacaagaccaagagctgcaccaagtggaaggacaactttgccagcgagagctggctgaagaatgcctggcacttcatcagcgagagcgtgtctgtgaaggaggaccaggaggagaccaagcccacctttgacatcgtggtggacaccctgaaggactgggccctgctgcccggcaccaagttcaccgtgtctgccaaccagctggtggtgcctgaaggagatgtgctgctgcccctgagcctgatgcacatcgctgtgttccccaatgcccagagcgacaaggtgttccacgccctgatgaaggccggctgcatccagctggccctgaacaagatctgcagcaaggacagcgcctttgtgcccctgctgagctgccacacagccaacatcgagagccccaccagcatcctgaaggccctgcactacatggtgcagaccagcaccttccgggcagagaagctggtggagaatgactttgaggccctgctgatgtacttcaactgcaacctgaaccacctgatgagccaggatgacatcaagatcctgaagagcctgccctgctacaagagcatcagcggccgctacgtgtccatcggcaagtttggcacctgctacgtgctgaccaagagcatccccagcgctgaggtggagaagtggacccagagcagcagcagcgccttcctggaggagaagatccacctgaaggagctgtatgaagtcatcggctgtgtgcctgtggatgacctggaggtgtacctgaagcacctgctgcccaagattgagaacctgtcctatgatgccaagctggagcacctgatctacctgaagaaccggctgagcagcgctgaggagctgtctgagatcaaggagcagctgtttgagaagctggagagcctgctgatcatccatgatgccaacagccggctgaagcaggccaagcacttctatgacagaacagtgcgggtgtttgaggtgatgctgcctgagaagctgttcatccccaatgacttcttcaagaagctggagcagctgatcaagcccaagaaccacgtgaccttcatgacctcctgggtggagttcctgagaaatattggcctgaagtacatcctgagccagcagcagctgctgcagtttgccaaggagatctctgtgcgggccaacacagagaactggagcaaggagaccctgcagaacacagtggacatcctgctgcaccacatcttccaggagaggatggacctgctgagcggcaacttcctgaaggagctgagcctcatccccttcctgtgcccagagcgggccccagctgagttcatccgcttccacccccagtaccaggaggtgaatggcaccctgcccctcatcaagttcaatggagcccaggtgaaccccaagttcaagcagtgtgatgtgctgcagctgctgtggaccagctgccccatcctgcctgagaaggccacccccctgagcatcaaggagcaggagggcagtgacctgggcccccaggagcagctggagcaggtgctgaacatgctgaatgtgaacctggacccccccctggacaaggtgatcaacaactgcaggaacatctgcaacatcaccaccctggatgaggagatggtgaagacccgggccaaggtgctgcggagcatctatgagttcctgtctgctgagaagcgggagttccgcttccagctgcggggcgtggcctttgtgatggtggaggatggctggaagctgctgaagccagaggaggtggtgatcaacctggagtatgaaagtgacttcaagccctacctgtacaagctgcccctggagctgggcaccttccaccagctgttcaagcacctgggcacagaggacatcatcagcaccaagcagtatgtggaggtgctgagccgcatcttcaagaacagcgagggcaagcagctggaccccaatgagatgaggacagtgaagagggtggtgtctggcctcttccgcagcctgcagaatgacagcgtgaaggtgcggagtgacctggagaatgtgcgggacctggccctgtacctgcccagccaggacggccgcctggtgaagagcagcatcctggtgtttgatgatgccccccactacaagagccgcatccagggcaacatcggcgtgcagatgctggtggacctgagccagtgctacctgggcaaggaccacggcttccacaccaagctgatcatgctgttcccccagaagctgcggccccggctgctgagcagcatcctggaggagcagctggatgaggagacccccaaggtgtgccagtttggagccctgtgcagcctgcagggccgcctgcagctgctgctgagcagcgagcagttcatcaccggcctcatccgcatcatgaagcatgaaaatgacaatgccttcctggccaatgaggagaaggccatccggctgtgcaaggccctgcgggagggcctgaaggtgtcctgctttgagaagctgcagaccaccctgcgggtgaagggcttcaaccccatcccccacagccgctctgagacctttgccttcctgaagagatttggaaatgctgtgatcctgctgtacatccagcacagcgacagcaaggacatcaacttcctgctggccctggccatgaccctgaagagcgccacagacaacctgatcagtgacaccagctacctgattgccatgctgggctgcaatgacatctaccgcatcggggagaagctggacagcctgggcgtgaagtatgacagcagcgagcccagcaagctggagctgcccatgcctggcacccccatcccagctgagatccactacaccctgctgatggaccccatgaatgtgttctacccaggagaatatgtgggctacctggtggatgctgagggcggggacatctacggcagctaccagcccacctacacctacgccatcatcgtgcaggaggtggagagagaagatgctgacaacagcagcttcctgggcaagatctaccagattgatattggctacagcgagtacaagatcgtgagcagcctggacctgtacaagttcagcaggcctgaggagagcagccagagccgggacagcgcccccagcacccccaccagccccacagagttcctgaccccaggcctgcggagcatccccccactcttcagcggccgggagagccacaagaccagcagcaagcaccagagccccaagaagctgaaggtgaacagcctgcctgagatcctgaaggaggtgacctctgtggtggagcaggcctggaagctgcctgagagcgagaggaagaagatcatccggcggctgtacctgaagtggcacccagacaagaacccagaaaatcatgacatcgccaatgaggtgttcaagcacctgcagaatgagatcaaccggctggagaagcaggccttcctggaccagaatgctgaccgggccagcaggaggaccttcagcaccagcgccagccgcttccagagcgacaagtacagcttccagcgcttctacacctcctggaaccaggaggccaccagccacaagtctgagcggcagcagcagaacaaggagaagtgccccccatctgctggccagacctacagccagcgcttctttgtgccccccaccttcaagtctgtgggcaaccctgtggaggcccggcgctggctgcggcaggcccgggccaacttctctgctgccagaaatgacctgcacaagaatgccaatgagtgggtgtgcttcaagtgctacctgagcaccaagctggccctgattgctgctgactatgctgtgcggggcaagagtgacaaggatgtgaagcccacagccctggcccagaagattgaggagtacagccagcagctggagggcctgaccaatgatgtgcacaccctggaggcctatggagtggacagcctgaagacccgctacccagacctgctgcccttcccccagatccccaatgaccgcttcaccagcgaggtggccatgagggtgatggagtgcacagcctgcatcatcatcaagctggagaacttcatgcagcagaaggtgtag

SEQ ID NO: 171252 - DNA, 7332 bp, Artificial Sequence
  Description of Artificial Sequence: Synthetic coding sequence
atggctgctgaggagggcgtggccagcgctgccagcgctgggggctcctggggcacagctgccatgggccgggtgctgcccatgctgctggtgcctgtgcctgctgaggccatgggccagctgggcagccgggcccagctgcggacccagcctgaggccctgggcagcctgacagctgctggcagcctgcaggtgctgagcctgaccccaggcagccggggcggcggccgctgctgcctggagggccccttctggcacttcctgtgggaggacagcaggaacagcagcacccccacagagaagcccaagctgctggccctgggagaaaattatgagctgctgatctatgagttcaacctgaaggatggccgctgtgatgccaccatcctgtacagctgcagccgggaggccctgcagaagctgattgatgaccaggacatcagcatcagcctgctgagcctgcgcatcctgtccttccacaacaacaccagcctgctcttcatcaacaagtgtgtgatcctgcacatcatcttccctgagagagatgctgccatccgggtgctgaactgcttcaccctgcccctgcctgcccaggccgtggacatgatcatcgacacccagctgtgccggggcatcctgtttgtgctgagcagcctgggctggatctacatctttgatgtggtggatggcacctacgtggcccacgtggacctggccctgcacaaggaggacatgtgcaatgagcagcagcaggagcccgccaagatcagcagcttcaccagcctgaaggtgtcccaggacctggatgtggccgtgattgtgagcagcagcaacagcgctgtggccctgaacctgaacctgtacttccggcagcaccctggccacctgctgtgtgagcgcatcctggaggacctgcccatccagggccccaagggcgtggatgaagatgatcctgtgaacagcgcctacaacatgaagctggccaagttctccttccagattgaccgctcctggaaggcccagctgagcagcctgaatgagaccatcaagaacagcaagctggaggtgtcctgctgtgccccctggttccaggacatcctgcacctggagagccctgagagcggcaaccacagcacctctgtgcagagctgggccttcatcccccaggacatcatgcacggccagtacaacgtgctgcagaaggaccacgccaagaccagtgaccccggccgctcctggaagatcatgcacatcagcgagcaggaggagcccatcgagctgaagtgtgtgtctgtgacaggcttcaccgccctcttcacctgggaggtggagaggatgggctacaccatcaccctgtgggacctggagacccagggcatgcagtgcttcagcctgggcaccaagtgcatccctgtggacagcagcggggaccagcagctgtgctttgtgctgacagaaaatggcctgagcctcatcctgtttggcctgacccaggaggagttcctgaaccggctgatgatccacggcagcgccagcacagtggacaccctgtgccacctgaatggctggggccgctgcagcatccccatccacgccctggaggccggcatcgagaaccggcagctggacacagtgaacttcttcctgaagagcaaagaaaatctcttcaaccccagcagcaagagctctgtgtctgaccagtttgaccacctgagcagccacctgtacctgagaaatgtggaggagctgatcccagccctggacctgctgtgcagcgccatccgggagagctacagcgagccccagagcaagcacttcagcgagcagctgctgaacctgaccctgtccttcctgaacaaccagatcaaggagctgttcatccacacagaggagctggatgagcacctgcagaagggcgtgaacatcctgaccagctacatcaatgagctgcggaccttcatgatcaagttcccctggaagctgacagatgccattgatgaatatgatgtgcatgaaaatgtgcccaaggtgaaggagagcaacatctggaagaagctgagctttgaggaggtgattgccagcgccatcctgaacaacaagatccctgaggcccagaccttcttcagaattgacagccacagcgcccagaagctggaggagctgattggcatcggcctgaacctggtgtttgacaacctgaagaagaacaacatcaaggaggccagcgagctgctgaagaacatgggctttgatgtgaagggccagctgctgaagatctgcttctacaccaccaacaagaacatccgggacttcctggtggagatcctgaaggagaagaactacttcagcgagaaggagaagaggaccatcgactttgtgcaccaggtggagaagctgtacctgggccacttccaggagaacatgcagatccagagcttcccccgctactggatcaaggagcaggacttcttcaagcacaagtctgtgctggacagcttcctgaagtatgactgcaaggatgagttcaacaagcaggaccacagaattgtgctgaactgggccctgtggtgggaccagctgacccaggagagcatcctgctgccccgcatcagccctgaggagtacaagagctacagccctgaggccctgtggagatacctgacagcccggcatgactggctgaacatcatcctgtggattggagagttccagacccagcacagctatgccagcctgcagcagaacaagtggcccctgctgactgtggatgtgatcaaccagaacaccagctgcaacaactacatgagaaatgagatcctggacaagctggccagaaatggagtcttcctggccagcgagctggaggactttgagtgcttcctgctgcggctgagcagaattggaggagtcatccaggacaccctgcctgtgcagaactacaagaccaaggagggctgggacttccacagccagttcatcctgtactgcctggagcacagcctgcagcacctgctgtatgtgtacctggactgctacaagctgagccctgagaactgccccttcctggagaagaaggagctgcacgaggcccacccctggtttgagttcctggtgcagtgccggcaggtggccagcaacctgacagaccccaagctgatcttccaggccagcctggccaatgcccagatcctgatccccaccaaccaggcctctgtgtcctccatgctgctggagggccacaccctgctggccctggccaccaccatgtacagccctgggggcgtgtcccaggtggtgcagaatgaagaaaatgaaaactgcctgaagaaggtggacccccagctgctgaagatggccctgaccccctaccccaagctgaagacagccctcttcccccagtgcaccccacccagcgtgctgcccagcgacatcaccatctaccacctgatccagagcctgagcccctttgaccccagccggctgtttggctggcagagcgccaacaccctggccatcggagatgcctggagccacctgccccacttcagcagcccagacctggtgaacaagtatgccatcgtggagcggctgaactttgcctactacctgcacaacggccggcccagctttgccttcggcaccttcctggtgcaggagctgatcaagagcaagacccccaagcagctgatccagcaggtgggcaatgaggcctacgtgattggcctgagcagcttccacatccccagcatcggggccgcctgtgtgtgcttcctggagctgctgggcctggacagcctgaagctgcgggtggacatgaaggtggccaacatcatcctgagctacaagtgcagaaatgaagatgcccagtacagcttcatccgggagagcgtggccgagaagctgagcaagctggctgatggagagaagaccaccacagaggagctgctggtgctgctggaggagggcacctggaacagcatccagcagcaggagatcaagaggctgagcagcgagagcagcagccagtgggccctggtggtgcagttctgccgcctgcacaacatgaagctgagcatctcctacctgcgggagtgtgccaaggccaatgactggctgcagttcatcatccacagccagctgcacaactaccaccctgctgaggtgaagagcctcatccagtacttcagccctgtgatccaggaccacctgcggctggcctttgagaacctgcccagcgtgcccaccagcaagatggacagcgaccaggtgtgcaacaagtgcccccaggagctgcagggcagcaagcaggagatgacagacctgtttgagatcctgctgcagtgcagcgaggagccagacagctggcactggctgctggtggaggccgtgaagcagcaggcccccatcctgtctgtgctggccagctgcctgcagggcgccagcgccatcagctgcctgtgtgtgtggatcatcacctctgtggaggacaacgtggccacagaggccatgggccacatccaggacagcacagaggaccacacctggaacctggaggacctgagcgtcatctggaggaccctgctgacccggcagaagagcaagaccctcatccggggcttccagctgttcttcaaggacagccccctgctgctggtgatggagatgtatgagctgtgcatgttcttcaggaactacaaggaggccgaggccaagctgctggagttccagaagagcctggagaccctgaacacagctgccaccaaggtgcaccctgtgatcccagccatgtggctggaggaccaggtgtgcttcctgctgaagctgatgctgcagcagtgcaagacccagtatgagctgggcaagctgctgcagctgtttgtggagcgggagcacctgttcagtgatggcccagatgtgaagaagctgtgcatcctgtgccagatcctgaaggacaccagcatcgccatcaaccacaccatcatcaccagctacagcattgagaacctgcagcacgagtgccgcagcatcctggagcggctgcagacagatggccagtttgccctggcccggcgggtggccgagctggccgagctgcctgtggacaacctggtgatcaaggagatcacccaggagatgcagaccctgaagcacatcgagcagtggagcctgaagcaggccagaattgacttctggaagaagtgccacgagaacttcaagaagaacagcatcagcagcaaggccgccagcagcttcttcagcacccaggcccacgtggcctgtgagcaccccaccggctggagctccatggaggagcggcacctgctgctgaccctggccggccactggctggcccaggaggatgtggtgcccctggacaagctggaggagctggagaagcagatctggctgtgccgcatcacccagcacaccctgggcaggaaccaggaggagacagagccccgcttcagccggcagatcagcaccagcggggagctgagctttgacagcctggccagcgagttctccttcagcaagctggccgccctgaacaccagcaagtacctggagctgaacagcctgcccagcaaggagacctgtgaaaatcggctggactggaaggagcaggagagcctgaacttcctgattggccgcctgctggatgatggctgtgtgcatgaggccagccgggtgtgccgctacttccacttctacaacccagatgtggccctggtgctgcactgccgggccctggccagcggggaggcctccatggaggacctgcaccctgagatccacgccctgctgcagagcgctgagctgctggaggaggaggccccagacatccccctgcggcgggtgcacagcaccagcagcctggacagccagaagtttgtgacagtgcccagcagcaatgaggtggtgaccaacctggaggtgctgaccagcaagtgcctgcacggcaagaactactgccggcaggtgctgtgcctgtatgacctggccaaggagctgggctgcagctacacagatgtggccgcccaggatggagaggccatgctgaggaagatcctggccagccagcagcctgaccgctgcaagagggcccaggccttcatcagcacccagggcctgaagccagacacagtggccgagctggtggccgaggaggtgacccgggagctgctgaccagcagccagggcaccggccacaagcagatgttcaaccccacagaggagagccagaccttcctgcagctgaccaccctgtgccaggacaggaccctggtgggcatgaagctgctggacaagatcagctctgtgccccatggagagctgagctgcaccacagagctgctgatcctggcccaccactgcttcaccctgacctgccacatggagggcatcatccgggtgctgcaggccgcccacatgctgacagacaaccacctggcccccagcgaggagtatggcctggtggtgcggctgctgaccggcatcggccgctacaatgagatgacctacatctttgacctgctgcacaagaagcactactttgaggtgctgatgaggaagaagctggaccccagcggcaccctgaagacagccctgctggactacatcaagcgctgcaggcctggggacagcgagaagcacaacatgattgccctgtgcttctccatgtgccgggagattggagaaaatcatgaagctgctgcccgcatccagctgaagctgattgagagccagccctgggaggacagcctgaaggatggccaccagctgaagcagctgctgctgaaggccctgaccctgatgctggatgctgctgagagctatgccaaggacagctgtgtgcggcaggcccagcactgccagaggctgaccaagctgatcaccctgcagatccacttcctgaacacaggccagaacaccatgctgatcaacctgggccgccacaagctgatggactgcatcctggccctgccccgcttctaccaggccagcatcgtggccgaggcctatgactttgtgcctgactgggccgagatcctgtaccagcaggtgatcctgaagggggacttcaactacctggaggagttcaagcagcagaggctgctgaagagcagcatctttgaggagatcagcaagaagtacaagcagcaccagcccacagacatggtgatggagaacctgaagaagctgctgacctactgtgaagatgtgtacctgtactacaagctggcctatgagcacaagttctatgaaattgtgaatgtgctgctgaaggacccccagacaggctgctgcctgaaggacatgctggccggctag

SEQ ID NO: 171253 - DNA, 6993 bp, Artificial Sequence
  Description of Artificial Sequence: Synthetic coding sequence
atggctgctgaggagggcgtggccagcgctgccagcgctgggggctcctggggcacagctgccatgggccgggtgctgcccatgctgctggtgcctgtgcctgctgaggccatgggccagctgggcagccgggcccagctgcggacccagcctgaggccctgggcagcctgacagctgctggcagcctgcaggtgctgagcctgaccccaggcagccggggcggcggccgctgctgcctggagggccccttctggcacttcctgtgggaggacagcaggaacagcagcacccccacagagaagcccaagctgctggccctgggagaaaattatgagctgctgatctatgagttcaacctgaaggatggccgctgtgatgccaccatcctgtacagctgcagccgggaggccctgcagaagctgattgatgaccaggacatcagcatcagcctgctgagcctgcgcatcctgtccttccacaacaacaccagcctgctcttcatcaacaagtgtgtgatcctgcacatcatcttccctgagagagatgctgccatccgggtgctgaactgcttcaccctgcccctgcctgcccaggccgtggacatgatcatcgacacccagctgtgccggggcatcctgtttgtgctgagcagcctgggctggatctacatctttgatgtggtggatggcacctacgtggcccacgtggacctggccctgcacaaggaggacatgtgcaatgagcagcagcaggagcccgccaagatcagcagcttcaccagcctgaaggtgtcccaggacctggatgtggccgtgattgtgagcagcagcaacagcgctgtggccctgaacctgaacctgtacttccggcagcaccctggccacctgctgtgtgagcgcatcctggaggacctgcccatccagggccccaagggcgtggatgaagatgatcctgtgaacagcgcctacaacatgaagctggccaagttctccttccagattgaccgctcctggaaggcccagctgagcagcctgaatgagaccatcaagaacagcaagctggaggtgtcctgctgtgccccctggttccaggacatcctgcacctggagagccctgagagcggcaaccacagcacctctgtgcagagctgggccttcatcccccaggacatcatgcacggccagtacaacgtgctgcagaaggaccacgccaagaccagtgaccccggccgctcctggaagatcatgcacatcagcgagcaggaggagcccatcgagctgaagtgtgtgtctgtgacaggcttcaccgccctcttcacctgggaggtggagaggatgggctacaccatcaccctgtgggacctggagacccagggcatgcagtgcttcagcctgggcaccaagtgcatccctgtggacagcagcggggaccagcagctgtgctttgtgctgacagaaaatggcctgagcctcatcctgtttggcctgacccaggaggagttcctgaaccggctgatgatccacggcagcgccagcacagtggacaccctgtgccacctgaatggctggggccgctgcagcatccccatccacgccctggaggccggcatcgagaaccggcagctggacacagtgaacttcttcctgaagagcaaagaaaatctcttcaaccccagcagcaagagctctgtgtctgaccagtttgaccacctgagcagccacctgtacctgagaaatgtggaggagctgatcccagccctggacctgctgtgcagcgccatccgggagagctacagcgagccccagagcaagcacttcagcgagcagctgctgaacctgaccctgtccttcctgaacaaccagatcaaggagctgttcatccacacagaggagctggatgagcacctgcagaagggcgtgaacatcctgaccagctacatcaatgagctgcggaccttcatgatcaagttcccctggaagctgacagatgccattgatgaatatgatgtgcatgaaaatgtgcccaaggtgaaggagagcaacatctggaagaagctgagctttgaggaggtgattgccagcgccatcctgaacaacaagatccctgaggcccagaccttcttcagaattgacagccacagcgcccagaagctggaggagctgattggcatcggcctgaacctggtgtttgacaacctgaagaagaacaacatcaaggaggccagcgagctgctgaagaacatgggctttgatgtgaagggccagctgctgaagatctgcttctacaccaccaacaagaacatccgggacttcctggtggagatcctgaaggagaagaactacttcagcgagaaggagaagaggaccatcgactttgtgcaccaggtggagaagctgtacctgggccacttccaggagaacatgcagatccagagcttcccccgctactggatcaaggagcaggacttcttcaagcacaagtctgtgctggacagcttcctgaagtatgactgcaaggatgagttcaacaagcaggaccacagaattgtgctgaactgggccctgtggtgggaccagctgacccaggagagcatcctgctgccccgcatcagccctgaggagtacaagagctacagccctgaggccctgtggagatacctgacagcccggcatgactggctgaacatcatcctgtggattggagagttccagacccagcacagctatgccagcctgcagcagaacaagtggcccctgctgactgtggatgtgatcaaccagaacaccagctgcaacaactacatgagaaatgagatcctggacaagctggccagaaatggagtcttcctggccagcgagctggaggactttgagtgcttcctgctgcggctgagcagaattggaggagtcatccaggacaccctgcctgtgcagaactacaagaccaaggagggctgggacttccacagccagttcatcctgtactgcctggagcacagcctgcagcacctgctgtatgtgtacctggactgctacaagctgagccctgagaactgccccttcctggagaagaaggagctgcacgaggcccacccctggtttgagttcctggtgcagtgccggcaggtggccagcaacctgacagaccccaagctgatcttccaggccagcctggccaatgcccagatcctgatccccaccaaccaggcctctgtgtcctccatgctgctggagggccacaccctgctggccctggccaccaccatgtacagccctgggggcgtgtcccaggtggtgcagaatgaagaaaatgaaaactgcctgaagaaggtggacccccagctgctgaagatggccctgaccccctaccccaagctgaagacagccctcttcccccagtgcaccccacccagcgtgctgcccagcgacatcaccatctaccacctgatccagagcctgagcccctttgaccccagccggctgtttggctggcagagcgccaacaccctggccatcggagatgcctggagccacctgccccacttcagcagcccagacctggtgaacaagtatgccatcgtggagcggctgaactttgcctactacctgcacaacggccggcccagctttgccttcggcaccttcctggtgcaggagctgatcaagagcaagacccccaagcagctgatccagcaggtgggcaatgaggcctacgtgattggcctgagcagcttccacatccccagcatcggggccgcctgtgtgtgcttcctggagctgctgggcctggacagcctgaagctgcgggtggacatgaaggtggccaacatcatcctgagctacaagtgcagaaatgaagatgcccagtacagcttcatccgggagagcgtggccgagaagctgagcaagctggctgatggagagaagaccaccacagaggagctgctggtgctgctggaggagggcacctggaacagcatccagcagcaggagatcaagaggctgagcagcgagagcagcagccagtgggccctggtggtgcagttctgccgcctgcacaacatgaagctgagcatctcctacctgcgggagtgtgccaaggccaatgactggctgcagttcatcatccacagccagctgcacaactaccaccctgctgaggtgaagagcctcatccagtacttcagccctgtgatccaggaccacctgcggctggcctttgagaacctgcccagcgtgcccaccagcaagatggacagcgaccaggtgtgcaacaagtgcccccaggagctgcagggcagcaagcaggagatgacagacctgtttgagatcctgctgcagtgcagcgaggagccagacagctggcactggctgctggtggaggccgtgaagcagcaggcccccatcctgtctgtgctggccagctgcctgcagggcgccagcgccatcagctgcctgtgtgtgtggatcatcacctctgtggaggacaacgtggccacagaggccatgggccacatccaggacagcacagaggaccacacctggaacctggaggacctgagcgtcatctggaggaccctgctgacccggcagaagagcaagaccctcatccggggcttccagctgttcttcaaggacagccccctgctgctggtgatggagatgtatgagctgtgcatgttcttcaggaactacaaggaggccgaggccaagctgctggagttccagaagagcctggagaccctgaacacagctgccaccaaggtgcaccctgtgatcccagccatgtggctggaggaccaggtgtgcttcctgctgaagctgatgctgcagcagtgcaagacccagtatgagctgggcaagctgctgcagctgtttgtggagcgggagcacctgttcagtgatggcccagatgtgaagaagctgtgcatcctgtgccagatcctgaaggacaccagcatcgccatcaaccacaccatcatcaccagctacagcattgagaacctgcagcacgagtgccgcagcatcctggagcggctgcagacagatggccagtttgccctggcccggcgggtggccgagctggccgagctgcctgtggacaacctggtgatcaaggagatcacccaggagatgcagaccctgaagcacatcgagcagtggagcctgaagcaggccagaattgacttctggaagaagtgccacgagaacttcaagaagaacagcatcagcagcaaggccgccagcagcttcttcagcacccaggcccacgtggcctgtgagcaccccaccggctggagctccatggaggagcggcacctgctgctgaccctggccggccactggctggcccaggaggatgtggtgcccctggacaagctggaggagctggagaagcagatctggctgtgccgcatcacccagcacaccctgggcaggaaccaggaggagacagagccccgcttcagccggcagatcagcaccagcggggagctgagctttgacagcctggccagcgagttctccttcagcaagctggccgccctgaacaccagcaagtacctggagctgaacagcctgcccagcaaggagacctgtgaaaatcggctggactggaaggagcaggagagcctgaacttcctgattggccgcctgctggatgatggctgtgtgcatgaggccagccgggtgtgccgctacttccacttctacaacccagatgtggccctggtgctgcactgccgggccctggccagcggggaggcctccatggaggacctgcaccctgagatccacgccctgctgcagagcgctgagctgctggaggaggaggccccagacatccccctgcggcgggtgcacagccgccacaagcagatgttcaaccccacagaggagagccagaccttcctgcagctgaccaccctgtgccaggacaggaccctggtgggcatgaagctgctggacaagatcagctctgtgccccacggggagctgagctgcaccacagagctgctgatcctggcccaccactgcttcaccctgacctgccacatggagggcatcatccgggtgctgcaggccgcccacatgctgacagacaaccacctggcccccagcgaggagtatggcctggtggtgcggctgctgactggaattggccgctacaatgagatgacctacatctttgacctgctgcacaagaagcactactttgaggtgctgatgaggaagaagctggaccccagcggcaccctgaagacagccctgctggactacatcaagcgctgcaggcctggggacagcgagaagcacaacatgattgccctgtgcttctccatgtgccgggagatcggggagaaccacgaggccgccgcccgcatccagctgaagctgattgagagccagccctgggaggacagcctgaaggatggccaccagctgaagcagctgctgctgaaggccctgaccctgatgctggatgctgctgagagctatgccaaggacagctgtgtgcggcaggcccagcactgccagaggctgaccaagctgatcaccctgcagatccacttcctgaacacaggccagaacaccatgctgatcaacctgggccgccacaagctgatggactgcatcctggccctgccccgcttctaccaggccagcatcgtggccgaggcctatgactttgtgcctgactgggccgagatcctgtaccagcaggtgatcctgaagggggacttcaactacctggaggagttcaagcagcagaggctgctgaagagcagcatctttgaggagatcagcaagaagtacaagcagcaccagcccacagacatggtgatggagaacctgaagaagctgctgacctactgtgaagatgtgtacctgtactacaagctggcctatgagcacaagttctatgagatcgtgaatgtgctgctgaaggacccccagacaggctgctgcctgaaggacatgctggccggctag

SEQ ID NO: 171254 - DNA, 6240 bp, Artificial Sequence
  Description of Artificial Sequence: Synthetic coding sequence
atggctgctgaggagggcgtggccagcgctgccagcgctgggggctcctggggcacagctgccatgggccgggtgctgcccatgctgctggtgcctgtgcctgctgaggccatgggccagctgggcagccgggcccagctgcggacccagcctgaggccctgggcagcctgacagctgctggcagcctgcaggtgctgagcctgaccccaggcagccggggcggcggccgctgctgcctggagggccccttctggcacttcctgtgggaggacagcaggaacagcagcacccccacagagaagcccaagctgctggccctgggagaaaattatgagctgctgatctatgagttcaacctgaaggatggccgctgtgatgccaccatcctgtacagctgcagccgggaggccctgcagaagctgattgatgaccaggacatcagcatcagcctgctgagcctgcgcatcctgtccttccacaacaacaccagcctgctcttcatcaacaagtgtgtgatcctgcacatcatcttccctgagagagatgctgccatccgggtgctgaactgcttcaccctgcccctgcctgcccaggccgtggacatgatcatcgacacccagctgtgccggggcatcctgtttgtgctgagcagcctgggctggatctacatctttgatgtggtggatggcacctacgtggcccacgtggacctggccctgcacaaggaggacatgtgcaatgagcagcagcaggagcccgccaagatcagcagcttcaccagcctgaaggtgtcccaggacctggatgtggccgtgattgtgagcagcagcaacagcgctgtggccctgaacctgaacctgtacttccggcagcaccctggccacctgctgtgtgagcgcatcctggaggacctgcccatccagggccccaagggcgtggatgaagatgatcctgtgaacagcgcctacaacatgaagctggccaagttctccttccagattgaccgctcctggaaggcccagctgagcagcctgaatgagaccatcaagaacagcaagctggaggtgtcctgctgtgccccctggttccaggacatcctgcacctggagagccctgagagcggcaaccacagcacctctgtgcagagctgggccttcatcccccaggacatcatgcacggccagtacaacgtgctgcagaaggaccacgccaagaccagtgaccccggccgctcctggaagatcatgcacatcagcgagcaggaggagcccatcgagctgaagtgtgtgtctgtgacaggcttcaccgccctcttcacctgggaggtggagaggatgggctacaccatcaccctgtgggacctggagacccagggcatgcagtgcttcagcctgggcaccaagtgcatccctgtggacagcagcggggaccagcagctgtgctttgtgctgacagaaaatggcctgagcctcatcctgtttggcctgacccaggaggagttcctgaaccggctgatgatccacggcagcgccagcacagtggacaccctgtgccacctgaatggctggggccgctgcagcatccccatccacgccctggaggccggcatcgagaaccggcagctggacacagtgaacttcttcctgaagagcaaagaaaatctcttcaaccccagcagcaagagctctgtgtctgaccagtttgaccacctgagcagccacctgtacctgagaaatgtggaggagctgatcccagccctggacctgctgtgcagcgccatccgggagagctacagcgagccccagagcaagcacttcagcgagcagctgctgaacctgaccctgtccttcctgaacaaccagatcaaggagctgttcatccacacagaggagctggatgagcacctgcagaagggcgtgaacatcctgaccagctacatcaatgagctgcggaccttcatgatcaagttcccctggaagctgacagatgccattgatgaatatgatgtgcatgaaaatgtgcccaaggtgaaggagagcaacatctggaagaagctgagctttgaggaggtgattgccagcgccatcctgaacaacaagatccctgaggcccagaccttcttcagaattgacagccacagcgcccagaagctggaggagctgattggcatcggcctgaacctggtgtttgacaacctgaagaagaacaacatcaaggaggccagcgagctgctgaagaacatgggctttgatgtgaagggccagctgctgaagatctgcttctacaccaccaacaagaacatccgggacttcctggtggagatcctgaaggagaagaactacttcagcgagaaggagaagaggaccatcgactttgtgcaccaggtggagaagctgtacctgggccacttccaggagaacatgcagatccagagcttcccccgctactggatcaaggagcaggacttcttcaagcacaagtctgtgctggacagcttcctgaagtatgactgcaaggatgagttcaacaagcaggaccacagaattgtgctgaactgggccctgtggtgggaccagctgacccaggagagcatcctgctgccccgcatcagccctgaggagtacaagagctacagccctgaggccctgtggagatacctgacagcccggcatgactggctgaacatcatcctgtggattggagagttccagacccagcacagctatgccagcctgcagcagaacaagtggcccctgctgactgtggatgtgatcaaccagaacaccagctgcaacaactacatgagaaatgagatcctggacaagctggccagaaatggagtcttcctggccagcgagctggaggactttgagtgcttcctgctgcggctgagcagaattggaggagtcatccaggacaccctgcctgtgcagaactacaagaccaaggagggctgggacttccacagccagttcatcctgtactgcctggagcacagcctgcagcacctgctgtatgtgtacctggactgctacaagctgagccctgagaactgccccttcctggagaagaaggagctgcacgaggcccacccctggtttgagttcctggtgcagtgccggcaggtggccagcaacctgacagaccccaagctgatcttccaggccagcctggccaatgcccagatcctgatccccaccaaccaggcctctgtgtcctccatgctgctggagggccacaccctgctggccctggccaccaccatgtacagccctgggggcgtgtcccaggtggtgcagaatgaagaaaatgaaaactgcctgaagaaggtggacccccagctgctgaagatggccctgaccccctaccccaagctgaagacagccctcttcccccagtgcaccccacccagcgtgctgcccagcgacatcaccatctaccacctgatccagagcctgagcccctttgaccccagccggctgtttggctggcagagcgccaacaccctggccatcggagatgcctggagccacctgccccacttcagcagcccagacctggtgaacaagtatgccatcgtggagcggctgaactttgcctactacctgcacaacggccggcccagctttgccttcggcaccttcctggtgcaggagctgatcaagagcaagacccccaagcagctgatccagcaggtgggcaatgaggcctacgtgattggcctgagcagcttccacatccccagcatcggggccgcctgtgtgtgcttcctggagctgctgggcctggacagcctgaagctgcgggtggacatgaaggtggccaacatcatcctgagctacaagtgcagaaatgaagatgcccagtacagcttcatccgggagagcgtggccgagaagctgagcaagctggctgatggagagaagaccaccacagaggagctgctggtgctgctggaggagggcacctggaacagcatccagcagcaggagatcaagaggctgagcagcgagagcagcagccagtgggccctggtggtgcagttctgccgcctgcacaacatgaagctgagcatctcctacctgcgggagtgtgccaaggccaatgactggctgcagttcatcatccacagccagctgcacaactaccaccctgctgaggtgaagagcctcatccagtacttcagccctgtgatccaggaccacctgcggctggcctttgagaacctgcccagcgtgcccaccagcaagatggacagcgaccaggtgtgcaacaagtgcccccaggagctgcagggcagcaagcaggagatgacagacctgtttgagatcctgctgcagtgcagcgaggagccagacagctggcactggctgctggtggaggccgtgaagcagcaggcccccatcctgtctgtgctggccagctgcctgcagggcgccagcgccatcagctgcctgtgtgtgtggatcatcacctctgtggaggacaacgtggccacagaggccatgggccacatccaggacagcacagaggaccacacctggaacctggaggacctgagcgtcatctggaggaccctgctgacccggcagaagagcaagaccctcatccggggcttccagctgttcttcaaggacagccccctgctgctggtgatggagatgtatgagctgtgcatgttcttcaggaactacaaggaggccgaggccaagctgctggagttccagaagagcctggagaccctgaacacagctgccaccaaggtgcaccctgtgatcccagccatgtggctggaggaccaggtgtgcttcctgctgaagctgatgctgcagcagtgcaagacccagtatgagctgggcaagctgctgcagctgtttgtggagcgggagcacctgttcagtgatggcccagatgtgaagaagctgtgcatcctgtgccagatcctgaaggacaccagcatcgccatcaaccacaccatcatcaccagctacagcattgagaacctgcagcacgagtgccgcagcatcctggagcggctgcagacagatggccagtttgccctggcccggcgggtggccgagctggccgagctgcctgtggacaacctggtgatcaaggagatcacccaggagatgcagaccctgaagcacatcgagcagtggagcctgaagcaggccagaattgacttctggaagaagtgccacgagaacttcaagaagaacagcatcagcagcaaggccgccagcagcttcttcagcacccaggcccacgtggcctgtgagcaccccaccggctggagctccatggaggagcggcacctgctgctgaccctggccggccactggctggcccaggaggatgtggtgcccctggacaagctggaggagctggagaagcagatctggctgtgccgcatcacccagcacaccctgggcaggaaccaggaggagacagagccccgcttcagccggcagatcagcaccagcggggagctgagctttgacagcctggccagcgagttctccttcagcaagctggccgccctgaacaccagcaagtacctggagctgaacagcctgcccagcaaggagacctgtgaaaatcggctggactggaaggagcaggagagcctgaacttcctgattggccgcctgctggatgatggctgtgtgcatgaggccagccgggtgtgccgctacttccacttctacaacccagatgtggccctggtgctgcactgccgggccctggccagcggggaggcctccatggaggacctgcaccctgagatccacgccctgctgcagagcgctgagctgctggaggaggaggccccagacatccccctgcggcgggtgcacagcaccagcagcctggacagccagaagtttgtgacagtgcccagcagcaatgaggtggtgaccaacctggaggtgctgaccagcaagtgcctgcacggcaagaactactgccggcaggtgctgtgcctgtatgacctggccaaggagctgggctgcagctacacagatgtggccgcccaggatggagaggccatgctgaggaagatcctggccagccagcagcctgaccgctgcaagagggcccaggccttcatcagcacccagggcctgaagccagacacagtggccgagctggtggccgaggaggtgacccgggagctgctgaccagcagccagggcaccggggccctgcccccaggggacagccagcccctgtag

SEQ ID NO: 171255 - DNA, 2001 bp, Artificial Sequence
  Description of Artificial Sequence: Synthetic coding sequence
atggagcaggagccccagaatggagagcctgctgagatcaagatcatccgggaggcctacaagaaggccttcctgtttgtgaacaagggcctgaacacagatgagctgggccagaaggaggaggccaagaactactacaagcagggcatcggccacctgctgcggggcatcagcatcagcagcaaggagagcgagcacactggacctggctgggagagcgcccggcagatgcagcagaagatgaaggagaccctgcagaatgtgaggacccggctggagatcctggagaagggcctggccaccagcctgcagaatgacctgcaggaggtgcccaagctgtacccagagttcccccccaaggacatgtgtgagaagctgcctgagccccagagcttcagcagcgccccccagcacgccgaggtgaatggaaacaccagcaccccatctgctggagctgtggccgccccagccagcctgagcctgcccagccagagctgcccagctgaggcccccccagcctacaccccccaggccgctgagggccactacacagtgtcctatggaacagattctggagagttcagctctgtgggggaggagttctacagaaaccacagccagcccccacccctggagaccctgggcctggatgctgatgagctgatcctgatccccaacggggtgcagatcttctttgtgaacccagctggggaggtgtctgcccccagctacccaggctacctgcgcatcgtgcgcttcctggacaacagcctggacacagtgctgaacagacctcctggcttcctgcaggtgtgtgactggctgtaccccctggtgcctgacaggagccctgtgctgaagtgcacagctggggcctacatgtttcctgacaccatgctgcaggccgccggctgctttgtgggcgtggtgctgagcagcgagctgcctgaagatgaccgggagctgtttgaggacctgctgcggcagatgtctgacctgcggctgcaggccaactggaacagagctgaggaggagaatgagttccagatccctggccgcacccggcccagcagtgaccagctgaaggaggccagcggcacagatgtgaagcagctggaccagggcaacaaggatgtgcgccacaagggcaagaggggcaagagggccaaggacaccagcagcgaggaggtgaacctgagccacatcgtgccctgtgagcctgtgcctgaggagaagcccaaggagctgcctgagtggagcgagaaggtggcccacaacatcctgagcggggcctcctgggtgtcctggggcctggtgaagggagctgagatcaccgggaaggccatccagaagggggccagcaagctgcgggagcgcatccagcctgaggagaagcctgtggaggtgtccccagctgtgaccaagggcctgtacatcgccaagcaggccaccggcggggccgccaaggtgtcccagttcctggtggatggagtgtgcaccgtggccaactgtgtgggcaaggagctggccccccacgtgaagaagcacggcagcaagctggtgcctgagagcctgaagaaggacaaggatggcaagagccccctggatggagccatggtggtggccgccagctctgtgcagggcttcagcacagtgtggcagggcctggagtgtgccgccaagtgcatcgtgaacaacgtgtctgctgagaccgtgcagacagtgcgctacaagtatggctacaatgctggggaggccacccaccacgctgtggacagcgctgtgaatgtgggcgtgacagcctacaacatcaacaacatcggcatcaaggccatggtgaagaagacagccacccagacaggccacaccctgctggaggactaccagatcgtggacaacagccagcgggagaaccaggagggcgccgccaacgtgaatgtgcggggggagaaggatgagcagaccaaggaggtgaaggaggccaagaagaaggacaagtag

SEQ ID NO: 171256 - DNA, 2001 bp, Artificial Sequence; identical to SEQ ID NO: 171255
  Description of Artificial Sequence: Synthetic coding sequence

SEQ ID NO: 171257 - DNA, 2001 bp, Artificial Sequence; identical to SEQ ID NO: 171255
  Description of Artificial Sequence: Synthetic coding sequence

SEQ ID NO: 171258 - DNA, 2001 bp, Artificial Sequence; identical to SEQ ID NO: 171255
  Description of Artificial Sequence: Synthetic coding sequence

SEQ ID NO: 171259 - DNA, 846 bp, Artificial Sequence
  Description of Artificial Sequence: Synthetic coding sequence
atgggagagatcaaggtgtccccagactacaactggttccggggcaccgtgcccctgaagaagatcatcgtggatgatgatgacagcaagatctggagcctgtatgatgctggccccaggagcatccgctgccccctcatcttcctgccccctgtgtctggaacagcagatgtgttcttccggcagatcctggccctgaccggctggggctacagagtgattgctgtgcacctgtttggagccagcctgggcggcttcctggcccagaagtttgctgagtacacccacaagagcccccgggtgcacagcctcatcctgtgcaacagcttcagtgacaccagcatcttcaaccagacctggacagccaacagcttctggctgatgcctgccttcatgctgaagaagatcgtgctgggcaacttcagcagcggccctgtggaccccatgatggctgatgccatcgacttcatggtggaccggctggagagcctgggccagagcgagctggccagccggctgaccctgaactgccagaacagctatgtggagccccacaagatccgggacatccctgtgaccatcatggatgtgtttgaccagagcgccctgagcacagaggccaaggaggagatgtacaagctgtacccaaatgcccggcgggcccacctgaagacaggaggcaacttcccctacctgtgccgctctgctgaggtgaacctgtatgtgcagatccacctgctgcagttccacggcaccaagtatgctgccatcgaccccagcatggtgtctgctgaggagctggaggtgcagaagggcagcctgggcatcagccaggaggagcagtag

SEQ ID NO: 171260 - DNA, 927 bp, Artificial Sequence
  Description of Artificial Sequence: Synthetic coding sequence
atgggagagatcaaggtgtccccagactacaactggttccggggcaccgtgcccctgaagaagatcatcgtggatgatgatgacagcaagatctggagcctgtatgatgctggccccaggagcatccgctgccccctcatcttcctgccccctgtgtctggaacagcagatgtgttcttccggcagatcctggccctgaccggctggggctacagagtcatcgccctgcagtaccctgtgtactgggaccacctggagttctgtgatggcttcaggaagctgctggaccacctgcagctggacaaggtgcacctgtttggagccagcctgggcggcttcctggcccagaagtttgctgagtacacccacaagagcccccgggtgcacagcctcatcctgtgcaacagcttcagtgacaccagcatcttcaaccagacctggacagccaacagcttctggctgatgcctgccttcatgctgaagaagatcgtgctgggcaacttcagcagcggccctgtggaccccatgatggctgatgccatcgacttcatggtggaccggctggagagcctgggccagagcgagctggccagccggctgaccctgaactgccagaacagctatgtggagccccacaagatccgggacatccctgtgaccatcatggatgtgtttgaccagagcgccctgagcacagaggccaaggaggagatgtacaagctgtacccaaatgcccggcgggcccacctgaagacaggaggcaacttcccctacctgtgccgctctgctgaggtgaacctgtatgtgcagatccacctgctgcagttccacggcaccaagtatgctgccatcgaccccagcatggtgtctgctgaggagctggaggtgcagaagggcagcctgggcatcagccaggaggagcagtag

SEQ ID NO: 171261 - DNA, 927 bp, Artificial Sequence; identical to SEQ ID NO: 171260
  Description of Artificial Sequence: Synthetic coding sequence

SEQ ID NO: 171262 - DNA, 2388 bp, Artificial Sequence
  Description of Artificial Sequence: Synthetic coding sequence
atggctgtgctgctgctgctgctgcgggccctgcggcggggccctggccctggcccccggcccctgtggggccctggccctgcctggagccctggcttccctgcccggcccggccggggccggccctacatggccagccggcccccaggggacctggccgaggccggcggccgggccctgcagagcctgcagctgcggctgctgacccccacctttgagggcatcaatggcctgctgctgaagcagcacctggtgcagaaccctgtgcggctgtggcagctgctgggcggcaccttctacttcaacaccagccggctgaagcagaagaacaaggagaaggacaagagcaagggcaaggccccagaagaagatgaggaggagaggagaagaagagaaagagatgaccagatgtaccgggagcggctgcggaccctgctggtgattgctgtggtgatgagcctgctgaatgccctgagcaccagcggcggcagcatctcctggaatgactttgtgcatgagatgctggccaagggggaggtgcagagggtgcaggtggtgcctgagagtgatgtggtggaggtgtacctgcaccctggagctgtggtgtttggccggccccggctggccctgatgtacaggatgcaggtggccaacatcgacaagtttgaggagaagctgcgggctgctgaagatgagctgaacatcgaggccaaggaccgcatccctgtgtcctacaagaggacaggcttctttggaaatgccctgtacagcgtgggcatgacagctgtgggcctggccatcctgtggtacgtgttccggctggccggcatgacaggccgggagggcggcttcagcgccttcaaccagctgaagatggcccgcttcaccatcgtggatggcaagatgggcaagggcgtgtccttcaaggatgtggccggcatgcatgaggccaagctggaggtgcgggagtttgtggactacctgaagagccctgagcgcttcctgcagctgggcgccaaggtgcccaagggggccctgctgctgggccccccaggctgcggcaagaccctgctggccaaggctgtggccacagaggcccaggtgcccttcctggccatggccggccctgagtttgtggaggtgattggaggcctgggcgccgcccgggtgcgcagcctcttcaaggaggcccgggcccgggccccctgcatcgtgtacattgatgaaattgatgctgtgggcaagaagaggagcaccaccatgagcggcttcagcaacacagaggaggagcagaccctgaaccagctgctggtggagatggatggcatgggcaccacagaccacgtgattgtgctggccagcaccaacagagctgacatcctggatggagccctgatgaggcctggccgcctggacagacatgtgttcatcgacctgcccaccctgcaggagcggcgggagatctttgagcagcacctgaagagcctgaagctgacccagagcagcaccttctacagccagaggctggccgagctgaccccaggcttctctggagctgacatcgccaacatctgcaatgaggccgccctgcacgccgcccgggagggccacacctctgtgcacaccctgaactttgaatatgctgtggagcgggtgctggccggcacagccaagaagagcaagatcctgagcaaggaggagcagaaggtggtggccttccacgagagcggccacgccctggtgggctggatgctggagcacacagaggccgtgatgaaggtgtccatcacccccaggaccaatgctgccctgggctttgcccagatgctgccccgggaccagcacctgttcaccaaggagcagctgtttgagaggatgtgcatggccctgggcggccgggccagcgaggccctgtccttcaatgaggtgaccagcggggcccaggatgacctgaggaaggtgaccagaattgcctacagcatggtgaagcagtttggcatggcccctggcatcggccccatctccttccctgaggcccaggagggcctgatgggcatcggccggcggcccttcagccagggcctgcagcagatgatggaccacgaggcccggctgctggtggccaaggcctaccgccacacagagaaggtgctgcaggacaacctggacaagctgcaggccctggccaatgccctgctggagaaggaggtgatcaactatgaagatattgaggccctgattggccccccaccccacggccccaagaagatgattgccccccagcgctggattgatgcccagcgggagaagcaggacctgggggaggaggagacagaggagacccagcagccccccctgggcggggaggagcccacctggcccaagtag

SEQ ID NO: 171263 - DNA, 672 bp, Artificial Sequence
  Description of Artificial Sequence: Synthetic coding sequence
atgaggctgcgctgcacccggcggggccgggacaccctgccctgcaccctgagcaccagcagcaccccctggagcgccagcagccaggtgccccgggcccagctgggcaaggctgtgggcagctgccggggcgtgggcagctgctgtgcccggcactgcaagacccacctggccagcctgcggcagccctgtggggagaggactggagctgcctgtgtgctgctgatctacttccgggtgaccatctacttctacgtggagattgagaagctgctgatcatcgtggccaagcaggagggcctgagcggcaaccacaagcctgtggagaggaagtacatgacctacctgagcgcccaggaccacgagctgatccaggtggtgcagaatggccacctgcagatgtgtgggaagtcagaaacaggaaatgaggccagccctggcctgcccaagagggcccggagctgccccaggaagaacaggaagtggctgcgcttcatgagccgggccaccccctggtgggccggctgctggagcaccaggagagatgagggcctgcacaaccccagcaccaatgctgccctgggctttgcccaggccccccagaggcctgcccccctgcacgagcagctgtttgagaggatgtgcatggccctgggcggccgggccagctag

SEQ ID NO: 171264 - DNA, 618 bp, Artificial Sequence
  Description of Artificial Sequence: Synthetic coding sequence
ctgggcccccaggcctgcaccgtggtgcccaggagcaaatgttttgacctggagatggtgagcagccgctgggagcccctgctgctgctgacagaggtgaccagcgccaatgaggtgtgggtgaccagcaacagcacagccctggtgtttgtgtctgacaacgtgcgggaggagctggaggaggtgcaggacctgctgtgcaggaccctgcccctgcctgtgcagctgtccttccctgaggaggccctggatgtggcccgggtggcccacgtgtttgtgagccccttctgcttctctgctggcagcgaggagaggagaagaagagaaagagatgaccagatgtaccgggagcggctgcggaccctgctggtgattgctgtggtgatgagcctgctgaatgccctgagcaccagcggcggcagcatctcctggaatgactttgtgcatgagatgctggccaagggggaggtgcagagggtgcaggtggtgcctgagagtgatgtggtggaggtgtacctgcaccctggagctgtggtgtttggccggccccggctggccctgatgtacaggatgcaggtggccaacatcgacaagtttgaggagaagctgcgggcctag

SEQ ID NO: 171265 - DNA, 1470 bp, Artificial Sequence
  Description of Artificial Sequence: Synthetic coding sequence
atggctgtgctgctgctgctgctgcgggccctgcggcggggccctggccctggcccccggcccctgtggggccctggccctgcctggagccctggcttccctgcccggcccggccggggccggccctacatggccagccggcccccaggggacctggccgaggccggcggccgggccctgcagagcctgcagctgcggctgctgacccccacctttgagggcatcaatggcctgctgctgaagcagcacctggtgcagaaccctgtgcggctgtggcagctgctgggcggcaccttctacttcaacaccagccggctgaagcagaagaacaaggagaaggacaagagcaagggcaaggccccagaagaagatgaggaggagaggagaagaagagaaagagatgaccagatgtaccgggagcggctgcggaccctgctggtgattgctgtggtgatgagcctgctgaatgccctgagcaccagcggcggcagcatctcctggaatgactttgtgcatgagatgctggccaagggggaggtgcagagggtgcaggtggtgcctgagagtgatgtggtggaggtgtacctgcaccctggagctgtggtgtttggccggccccggctggccctgatgtacaggatgcaggtggccaacatcgacaagtttgaggagaagctgcgggctgctgaagatgagctgaacatcgaggccaaggaccgcatccctgtgtcctacaagaggacaggcttctttggaaatgccctgtacagcgtgggcatgacagctgtgggcctggccatcctgtggtacgtgttccggctggccggcatgacaggccgggagggcggcttcagcgccttcaaccagctgaagatggcccgcttcaccatcgtggatggcaagatgggcaagggcgtgtccttcaaggatgtggccggcatgcatgaggccaagctggaggtgcgggagtttgtggactacctgaagagccctgagcgcttcctgcagctgggcgccaaggtgcccaagggggccctgctgctgggccccccaggctgcggcaagaccctgctggccaaggctgtggccacagaggcccaggtgcccttcctggccatggccggccctgagtttgtggaggtgattggaggcctgggcgccgcccgggtgcgcagcctcttcaaggaggcccgggcccgggccccctgcatcgtgtacattgatgaaattgatgctgtgggcaagaagaggagcaccaccatgagcggcttcagcaacacagaggaggagcagaccctgaaccagctgctggtggagatggatggagccagcctggaccagctgcccagccagggcaccatgaggaagctgcggggcaagaccccagcctgcagctgcctgacagagcccaccggcagccggcgggccatggagggccacagcctgtgctggggctgcctgctgcactag

SEQ ID NO: 171266 - DNA, 1851 bp, Artificial Sequence
  Description of Artificial Sequence: Synthetic coding sequence
atgaacagccctgggggccggggcaagaagaagggcagcggcggggccagcaaccctgtgcccccccggcccccaccaccctgcctggccccagcccctcctgctgctggccctgcccctcctcctgagagcccccacaagaggaacctgtactacttctcctaccccctgtttgtgggctttgccctgctgcggctggtggccttccacctgggcctgctgtttgtgtggctgtgccagcgcttcagccgggccctgatggccgccaagaggagcagtggagctgccccagccccagccagcgccagcgccccagcccctgtgcctggaggagaggccgagcgggtgcgggtcttccacaagcaggcctttgagtacatcagcatcgccctgagaattgatgaagatgagaaggccggccagaaggagcaggccgtggagtggtacaagaagggcatcgaggagctggagaagggcattgctgtgattgtgacaggccagggcgagcagtgtgagcgggcccggcggctgcaggccaagatgatgaccaacctggtgatggccaaggaccggctgcagctgctggagaagatgcagcctgtgctgcccttcagcaagagccagacagatgtgtacaatgacagcaccaacctggcctgcagaaatggccacctgcagagcgagagcggggctgtgcccaagaggaaggaccccctgacccacaccagcaacagcctgcccaggagcaagacagtgatgaagacaggcagcgctggcctgagcggccaccaccgggcccccagctacagcggcctgtccatggtgtctggagtgaagcagggcagcggccctgcccccaccacccacaagggcacccccaagaccaacagaaccaacaagcccagcacccccaccacagccaccaggaagaagaaggacctgaagaacttcagaaatgtggacagcaacctggccaacctgatcatgaatgagatcgtggacaatggaacagctgtgaagtttgatgacattgctggccaggacctggccaagcaggccctgcaggagatcgtcatcctgcccagcctgcggcctgagctgttcaccggcctgcgggccccagcccggggcctgctgctgtttggacctcctggaaatggcaagaccatgctggccaaggctgtggccgctgagagcaatgccaccttcttcaacatctctgctgccagcctgaccagcaaatatgtgggggagggggagaagctggtgcgggccctgtttgctgtggcccgggagctgcagcccagcatcatcttcattgatgaggtggacagcctgctgtgtgagcggcgggagggggagcatgatgccagccggcggctgaagacagagttcctgattgaatttgatggagtgcagagcgctggagatgacagagtgctggtgatgggcgccaccaaccggccccaggagctggatgaagctgtgctgcggcgcttcatcaagagggtgtatgtgtccctgcccaatgaggagacccggctgctgctgctgaagaacctgctgtgcaagcagggcagccccctgacccagaaggagctggcccagctggccaggatgacagatggctacagcggcagtgacctgacagccctggccaaggatgctgccctgggccccatccgggagctgaagccagagcaggtgaagaacatgtctgccagcgagatgaggaacatccggctgagtgacttcacagagagcctgaagaagatcaagaggtctgtgagcccccagaccctggaggcctacatccgctggaacaaggactttggagacaccaccgtgtag

SEQ ID NO: 171267 - DNA, 1755 bp, Artificial Sequence
  Description of Artificial Sequence: Synthetic coding sequence
atgaacagccctgggggccggggcaagaagaagggcagcggcggggccagcaaccctgtgcccccccggcccccaccaccctgcctggccccagcccctcctgctgctggccctgcccctcctcctgagagcccccacaagaggaacctgtactacttctcctaccccctgtttgtgggctttgccctgctgcggctggtggccttccacctgggcctgctgtttgtgtggctgtgccagcgcttcagccgggccctgatggccgccaagaggagcagtggagctgccccagccccagccagcgccagcgccccagcccctgtgcctggaggagaggccgagcgggtgcgggtcttccacaagcaggcctttgagtacatcagcatcgccctgagaattgatgaagatgagaaggccggccagaaggagcaggccgtggagtggtacaagaagggcatcgaggagctggagaagggcattgctgtgattgtgacaggccagggcgagcagtgtgagcgggcccggcggctgcaggccaagatgatgaccaacctggtgatggccaaggaccggctgcagctgctggagagcggggctgtgcccaagaggaaggaccccctgacccacaccagcaacagcctgcccaggagcaagacagtgatgaagacaggcagcgctggcctgagcggccaccaccgggcccccagctacagcggcctgtccatggtgtctggagtgaagcagggcagcggccctgcccccaccacccacaagggcacccccaagaccaacagaaccaacaagcccagcacccccaccacagccaccaggaagaagaaggacctgaagaacttcagaaatgtggacagcaacctggccaacctgatcatgaatgagatcgtggacaatggaacagctgtgaagtttgatgacattgctggccaggacctggccaagcaggccctgcaggagatcgtcatcctgcccagcctgcggcctgagctgttcaccggcctgcgggccccagcccggggcctgctgctgtttggacctcctggaaatggcaagaccatgctggccaaggctgtggccgctgagagcaatgccaccttcttcaacatctctgctgccagcctgaccagcaaatatgtgggggagggggagaagctggtgcgggccctgtttgctgtggcccgggagctgcagcccagcatcatcttcattgatgaggtggacagcctgctgtgtgagcggcgggagggggagcatgatgccagccggcggctgaagacagagttcctgattgaatttgatggagtgcagagcgctggagatgacagagtgctggtgatgggcgccaccaaccggccccaggagctggatgaagctgtgctgcggcgcttcatcaagagggtgtatgtgtccctgcccaatgaggagacccggctgctgctgctgaagaacctgctgtgcaagcagggcagccccctgacccagaaggagctggcccagctggccaggatgacagatggctacagcggcagtgacctgacagccctggccaaggatgctgccctgggccccatccgggagctgaagccagagcaggtgaagaacatgtctgccagcgagatgaggaacatccggctgagtgacttcacagagagcctgaagaagatcaagaggtctgtgagcccccagaccctggaggcctacatccgctggaacaaggactttggagacaccaccgtgtag

SEQ ID NO: 171268 - DNA, 26394 bp, Artificial Sequence
  Description of Artificial Sequence: Synthetic coding sequence
atggccaccagcagaggagccagccgctgcccccgggacatcgccaacgtgatgcagaggctgcaggatgagcaggagatcgtgcagaagaggaccttcaccaagtggatcaacagccacctggccaagaggaagccacccatggtggtggatgacctgtttgaggacatgaaggatggagtgaagctgctggccctgctggaggtgctgagcggccagaagctgccctgtgagcagggccgcaggatgaagagaattcatgctgtggccaacatcggcacagccctgaagttcctggagggcaggaagatcaagctggtgaacatcaacagcacagacattgctgatggccggcccagcatcgtgctgggcctgatgtggaccatcatcctgtacttccagatcgaggagctgaccagcaacctgccccagctgcagagcctgagcagcagcgccagctctgtggacagcatcgtgtcctctgagacccccagcccccccagcaagaggaaggtgaccaccaagatccagggcaatgccaagaaggccctgctgaagtgggtgcagtacacagctgggaagcagacaggcatcgaggtgaaggactttgggaagtcctggaggtctggagtggccttccacagcgtcatccacgccatccggcctgagctggtggacctggagaccgtgaagggccgcagcaaccgggagaacctggaggatgccttcaccatcgccgagacagagctgggcatcccccggctgctggaccctgaagatgtggatgtggacaagccagatgagaagagcatcatgacctacgtggcccagttcctgaagcactacccagacatccacaatgccagcacagatggccaggaggatgatgagatcctgcccggcttccccagctttgccaacagcgtgcagaacttcaagagagaagatagagtcatcttcaaggagatgaaggtgtggattgagcagtttgagcgggacctgacccgggcccagatggtggagagcaacctgcaggacaagtaccagagcttcaagcacttccgggtgcagtatgagatgaagaggaagcagatcgagcacctgatccagcccctgcacagagatggcaagctgagcctggaccaggccctggtgaagcagagctgggacagagtgaccagccggctgtttgactggcacatccagctggacaagagcctgcctgcccccctgggcaccatcggggcctggctgtacagagctgaggtggccctgcgggaggagatcaccgtgcagcaggtgcatgaggagacagccaacaccatccagaggaagctggagcagcacaaggacctgctgcagaacacagatgcccacaagagggccttccacgagatctaccgcaccaggtctgtgaatggcatccctgtgcccccagaccagctggaggacatggccgagcgcttccactttgtgagcagcaccagcgagctgcacctgatgaagatggagttcctggagctgaagtaccgcctgctgagcctgctggtgctggccgagagcaagctgaagtcctggatcatcaagtatggccggcgggagagcgtggagcagctgctgcagaactacgtgtccttcatcgagaacagcaagttctttgagcagtatgaggtgacctaccagatcctgaagcagacagctgagatgtatgtgaaggcagatggctctgtggaggaggctgaaaatgtgatgaagttcatgaatgagaccacagcccagtggaggaacctgtctgtggaggtgcgctctgtgcgctccatgctggaggaggtgatcagcaactgggacagatatggcaacacagtggccagcctgcaggcctggctggaggatgctgagaagatgctgaaccagagtgaaaatgccaagaaggacttcttcaggaacctgccccactggatccagcagcacacagccatgaatgatgctggcaacttcctgattgagacctgtgatgagatggtgtcccgggacctgaagcagcagctgctgctgctgaatggccgctggagggagctgttcatggaggtgaagcagtatgcccaggctgatgagatggacaggatgaagaaggagtacacagactgtgtggtgaccctgagcgcctttgccacagaggcccacaagaagctgtctgagcccctggaggtgtccttcatgaatgtgaagctgctgatccaggacctggaggacatcgagcagagggtgcctgtgatggatgcccagtacaagatcatcaccaagacagcccacctgatcaccaaggagagcccccaggaggagggcaaggagatgtttgccaccatgagcaagctgaaggagcagctgaccaaggtgaaggagtgctacagccccctgctgtatgagagccagcagctgctgatccccctggaggagctggagaagcagatgaccagcttctatgacagcctgggcaagatcaatgagatcatcaccgtgctggagcgggaggcccagagcagcgccctcttcaagcagaagcaccaggagctgctggcctgccaggagaactgcaagaagaccctgaccctcatcgagaagggcagccagagcgtgcagaagtttgtgaccctgagcaatgtgctgaagcactttgaccagacccggctgcagaggcagattgctgacatccacgtggccttccagagcatggtgaagaagacaggagactggaagaagcacgtggagaccaacagccggctgatgaagaagtttgaggagagcagagctgagctggagaaggtgctgagaattgcccaggagggcctggaggagaagggggaccctgaggagctgctgcggcggcacacagagttcttcagccagctggaccagagggtgctgaatgccttcctgaaggcctgtgatgagctgacagacatcctgcctgagcaggagcagcagggcctgcaggaggccgtgaggaagctgcacaagcagtggaaggacctgcagggcgaggccccctaccacctgctgcacctgaagattgatgtggagaagaaccgcttcctggcctctgtggaggagtgcaggacagagctggaccgggagaccaagctgatgccccaggagggcagcgagaagatcatcaaggagcacagggtcttcttcagtgacaagggcccccaccacctgtgtgagaagaggctgcagctgattgaggagctgtgtgtgaagctgcctgtgcgggaccctgtgcgggacaccccaggcacctgccacgtgaccctgaaggagctgcgggccgccatcgacagcacctacaggaagctgatggaggaccctgacaagtggaaggactacaccagccgcttcagcgagttcagctcctggatcagcaccaatgagacccagctgaagggcatcaagggggaggccatcgacacagccaaccacggggaggtgaagagagctgtggaggagatcagaaatggagtgaccaagagaggagagaccctgtcctggctgaagagccggctgaaggtgctgacagaggtgtccagtgaaaatgaggcccagaagcagggagatgagctggccaagctgagcagcagcttcaaggccctggtgaccctgctgtctgaggtggagaagatgctgagcaactttggagactgtgtgcagtacaaggagatcgtgaagaacagcctggaggagctgatcagcggcagcaaggaggtgcaggagcaggccgagaagatcctggacacagagaacctgtttgaggcccagcagctgctgctgcaccaccagcagaagaccaagaggatcagcgccaagaagagagatgtgcagcagcagatcgcccaggcccagcagggcgagggcggcctgcctgaccggggccacgaggagctgaggaagctggagagcaccctggatggcctggagaggagccgggagcggcaggagcggcgcatccaggtgaccctgaggaagtgggagagatttgagaccaacaaggagaccgtggtgcgctacctgttccagacaggcagcagccatgagcgcttcctgtccttcagcagcctggagagcctgagcagcgagctggagcagaccaaggagttcagcaagaggacagagagcattgctgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaactttgagaccctgtctgtgtggatcacagagaaggagaaggagctgaatgccctggagaccagcagcagcgccatggacatgcagatcagccagatcaaggtgaccatccaggagattgagagcaagctgagcagcatcgtgggcctggaggaggaggcccagagctttgcccagtttgtgaccaccggggagagcgcccgcatcaaggccaagctgacccagatccgccgctacggggaggagctgcgggagcacgcccagtgcctggagggcaccatcctgggccacctgagccagcagcagaagtttgaggagaacctgaggaagatccagcagagcgtgtctgaatttgaggacaagctggccgtgcccatcaagatctgcagcagcgccacagagacctacaaggtgctgcaggagcacatggacctgtgccaggccctggagagcctgagcagcgccatcacagccttcagcgccagcgccaggaaggtggtgaacagagacagctgtgtgcaggaggccgccgccctgcagcagcagtatgaggacatcctgcggcgggccaaggagcggcagacagccctggagaacctgctggcccactggcagaggctggagaaggagctgagcagcttcctgacctggctggagcggggggaggccaaggccagcagccctgagatggacatctctgctgacagagtgaaggtggagggggagctgcagctgatccaggccctgcagaatgaggtggtgtcccaggccagcttctacagcaagctgctgcagctgaaggagagcctcttctctgtggccagcaaggatgatgtgaagatgatgaagctgcacctggagcagctggatgagcgctggagggacctgccccagatcatcaacaagaggatcaacttcctgcagagcgtggtggccgagcaccagcagtttgatgagctgctgctgtccttctctgtgtggatcaagctgttcctgtctgagctgcagaccaccagcgagatcagcatcatggaccaccaggtggccctgaccaggcacaaggaccacgccgctgaggtggagagcaagaagggggagctgcagagcctgcagggccacctggccaagctgggcagcctgggccgggcagaggacctgcacctgctgcagggcaaggccgaggactgcttccagctgtttgaggaggccagccaggtggtggagcggcggcagctggccctgagccacctggccgagttcctgcagagccacgccagcctgagcggcatcctgcggcagctgcggcagacagtggaggccaccaacagcatgaacaagaatgaaagtgacctgattgagaaggacctgaatgatgccctgcagaatgccaaggccctggagagcgctgctgtgtccctggatggcatcctgagcaaggcccagtaccacctgaagattggcagcagcgagcagaggaccagctgccgggccacagctgaccagctgtgtggggaggtggagcgcatccagaacctgctgggcaccaagcagagcgaggctgatgccctggccgtgctgaagaaggccttccaggaccagaaggaggagctgctgaagagcattgaagatattgaggagaggacagacaaggagcggctgaaggagcccacccggcaggccctgcagcagaggctgcgggtcttcaaccagctggaggatgagctgaacagccatgaacatgagctgtgctggctgaaggacaaggccaagcagatcgcccagaaggatgtggcctttgcccctgaggtggaccgggagatcaaccggctggaggtgacctgggatgacaccaagaggctcatccacgagaaccagggccagtgctgcggcctgattgacctgatgagggagtaccagaacctgaagtctgctgtgtccaaggtgctggagaatgccagctctgtgattgtgaccaggaccaccatcaaggaccaggaggacctgaagtgggccttcagcaagcatgaaacagccaagaacaagatgaactacaagcagaaggacctggacaacttcaccagcaagggcaagcacctgctgtctgagctgaagaagatccacagcagtgacttcagcctggtgaagacagacatggagagcacagtggacaagtggctggatgtgtctgagaagctggaggagaacatggaccggctgcgggtgtccctgagcatctgggatgatgtgctgagcaccagagatgaaattgagggctggagcaacaactgtgtgccccagatggccgagaacatcagcaacctggacaaccacctgcgggcagaggagctgctgaaggagtttgagagcgaggtgaagaacaaggccctgcggctggaggagctgcacagcaaggtgaatgacctgaaggagctgaccaagaacctggagaccccaccagacctgcagttcattgaagctgacctgatgcagaagctggagcacgccaaggagatcacagaggtggccaagggcaccctgaaggacttcaccgcccagagcacccaggtggagaagttcatcaatgacatcaccacctggttcaccaaggtggaggagagcctgatgaactgtgcccagaatgagacctgtgaggccctgaagaaggtgaaggacatccagaaggagctgcagagccagcagagcaacatcagcagcacccaggagaacctgaacagcctgtgcaggaagtaccacagcgctgagctggagagcctgggccgggccatgacaggcctcatcaagaagcatgaagctgtgtcccagctgtgcagcaagacccaggccagcctgcaggagagcctggagaagcacttcagcgagagcatgcaggagttccaggagtggttcctgggcgccaaggccgccgccaaggagagcagtgacagaactggagacagcaaggtgctggaggccaagctgcatgacctgcagaacatcctggacagcgtgtctgatggccagagcaagctggatgctgtgacccaggagggccagaccctgtatgcccacctgagcaagcagatcgtgagcagcatccaggagcagatcaccaaggccaatgaggagttccaggccttcctgaagcagtgcctgaaggacaagcaggccctgcaggactgtgccagcgagctgggcagctttgaggaccagcacaggaagctgaacctgtggatccacgagatggaggagcgcttcaacacagagaacctgggggagagcaagcagcacatccctgagaagaagaatgaggtgcacaaggtggagatgttcctgggggagctgctggccgcccgggagagcctggacaagctgagccagaggggccagctgctgtctgaggagggccatggagctggccaggagggccgcctgtgcagccagctgctgaccagccaccagaacctgctgaggatgaccaaggagaagctgcggagctgccaggtggccctgcaggagcacgaggccctggaggaggccctgcagagcatgtggttctgggtgaaggccatccaggaccggctggcctgtgccgagagcaccctgggcagcaaggacaccctggagaagaggctgagccagatccaggacatcctgctgatgaagggggagggggaggtgaagctgaacatggccatcggcaaaggagagcaggccctgcggagcagcaacaaggagggccagagggtcatccagacccagctggagaccctgaaggaggtgtgggccgacatcatgagcagctctgtgcacgcccagagcaccctggagagcgtcatcagccagtggaatgactatgtggagaggaagaaccagctggagcagtggatggagagcgtggaccagaagattgagcaccccctgcagccccagcccggcctgaaggagaagtttgtgctgctggaccacctgcagagcatcctgtctgaggccgaggaccacacccgggccctgcacaggctcatcgccaagagccgggagctgtatgagaagacagaagatgagagcttcaaggacacagcccaggaggagctgaagacccagttcaatgacatcatgacagtggccaaggagaagatgaggaaggtggaggagatcgtgaaggaccacctgatgtacctggatgctgtgcatgagttcacagactggctgcacagcgccaaggaggagctgcaccgctggagcgacatgtctggggacagcagcgccacccagaagaagctgagcaagatcaaggagctgattgacagccgggagatcggggccagccggctgagccgggtggagagcctggcccctgaggtgaagcagaacaccacagccagcggctgtgagctgatgcacacagagatgcaggccctgcgggctgactggaagcagtgggaggacagcgtcttccagacccagagctgcctggagaacctggtgtcccagatggccctgtctgagcaggagttcagcggccaggtggcccagctggagcaggccctggagcagttcagcgccctgctgaagacctgggcccagcagctgaccctgctggagggcaagaacacagatgaggagatcgtggagtgctggcacaagggccaggagatcctggatgccctgcagaaggccgagcccaggacagaggacctgaagagccagctgaatgagctgtgccgcttcagccgggacctgagcacctacagcggcaaggtgtctggcctcatcaaggagtacaactgcctgtgcctgcaggccagcaagggctgccagaacaaggagcagatcctgcagcagcgcttcaggaaggccttccgggacttccagcagtggctggtgaatgccaagatcaccacagccaagtgctttgacatcccccagaacatcagcgaggtgtccaccagcctgcagaagatccaggagttcctgtctgagagtgaaaatggccagcacaagctgaacatgatgctgagcaaaggagagctgctgagcaccctgctgaccaaggagaaggccaagggcatccaggccaaggtgacagctgccaaggaggactggaagaacttccacagcaacctgcaccagaaggagagcgccctggagaacctgaagatccagatgaaggactttgaggtgtctgctgagcccatccaggactggctgagcaagacagagaagatggtgcatgagagcagcaaccggctgtatgacctgcctgccaagaggcgggagcagcagaagctgcagagcgtgctggaggagatccactgctatgagccccagctgaaccggctgaaggagaaggcccagcagctgtgggagggccaggccgccagcaagagcttccgccaccgggtgtcccagctgagcagccagtacctggccctgagcaacctgaccaaggagaaggtgtcccggctggaccgcatcgtggccgagcacaaccagttcagcctgggcatcaaggagctgcaggactggatgacagatgccatccacatgctggacagctactgccaccccaccagtgacaagtctgtgctggacagcaggaccctgaagctggaggccctgctgtctgtgaagcaggagaaggagatccagatgaagatgattgtgaccagaggagagagcgtgctgcagaacaccagccctgagggcatccccaccatccagcagcagctgcagagcgtgaaggacatgtgggccagcctgctgtctgctggcatccgctgcaagagccagctggagggcgccctgagcaagtggaccagctaccaggatggagtgcggcagttcagcggctggatggacagcatggaggccaacctgaatgaaagtgagcggcagcacgccgagctgcgggacaagaccaccatgctgggcaaggccaagctgctgaatgaggaggtgctgagctacagcagcctgctggagaccatcgaggtgaagggggccggcatgacagagcactacgtgacccagctggagctgcaggacctgcaggagcgctaccgggccatccaggagcgggccaaggaggccgtgaccaagtctgagaagctggtgcggctgcaccaggagtaccagagggacctgaaggcctttgaggtgtggctgggccaggagcaggagaagctggaccagtacagcgtgctggagggagatgcccacacccatgagaccaccctgcgggacctgcaggagctgcaggtgcactgtgccgagggccaggccctgctgaacagcgtgctgcacaccagagaagatgtgatccccagcggcatcccccaggccgaggaccgggccctggagagcctgcggcaggactggcaggcctaccagcaccggctgtctgagaccaggacccagttcaacaacgtggtgaacaagctgcggctgatggagcagaagttccagcaggtggatgagtggctgaagacagctgaggagaaggtgagccccaggacccggcggcagagcaacagagccaccaaggagatccagctgcaccagatgaagaagtggcatgaggaggtgacagcctacagagatgaggtggaggaggtgggcgcccgggcccaggagatcctggatgagagccacgtgaacagcaggatgggctgccaggccacccagctgaccagccgctaccaggccctgctgctgcaggtgctggagcagatcaagttcctggaggaggagatccagagcctggaggagagcgagagcagcctgagcagctacagcgactggtacggcagcacccacaagaacttcaagaatgtggccaccaagattgacaaggtggacacagtgatgatgggcaagaagctgaagaccctggaggtgctgctgaaggacatggagaagggccacagcctgctgaagagcgcccgggagaagggggagagagctgtgaagtacctggaggagggggaggccgagcggctgaggaaggagatccatgaccacatggagcagctgaaggagctgaccagcacagtgaggaaggagcacatgaccctggagaagggcctgcacctggccaaggagttcagtgacaagtgcaaggccctgacccagtggattgctgagtaccaggagatcctgcacgtgcctgaggagcccaagatggagctgtatgagaagaaggcccagctgagcaagtacaagagcctgcagcagacagtgctgagccatgagcccagcgtgaagtctgtgcgggagaagggggaggccctgctggagctggtgcaggatgtgaccctgaaggacaagattgaccagctgcagagcgactaccaggacctgtgcagcatcggcaaggagcacgtgttcagcctggaggccaaggtgaaggaccacgaggactacaacagcgagctgcaggaggtggagaagtggctgctgcagatgagcggccgcctggtggccccagacctgctggagaccagcagcctggagaccatcacccagcagctggcccaccacaaggccatgatggaggagattgctggctttgaagatcggctgaacaacctgcagatgaagggggacaccctgattggccagtgtgccgaccacctgcaggccaagctgaagcagaatgtgcacgcccacctgcagggcaccaaggacagctacagcgccatctgcagcacagcccagaggatgtaccagagcctggagcacgagctgcagaagcacgtgtcccggcaggacaccctgcagcagtgccaggcctggctgtctgctgtgcagcctgacctggagcccagcccccagccccccctgagcagagctgaggccatcaagcaggtgaagcacttccgggccctgcaggagcaggcccggacctacctggacctgctgtgcagcatgtgtgacctgagcaatgcctctgtgaagaccacagccaaggacatccagcagacagagcagaccatcgagcagaagctggtgcaggcccagaacctgacccagggctgggaggagatcaagcacctgaagtctgagctgtggatctacctgcaggatgctgaccagcagctgcagaacatgaagaggaggcacagcgagctggagctgaacatcgcccagaacatggtgtcccaggtgaaggactttgtgaagaagctgcagagcaagcaggcctctgtgaacaccatcatcgagaaggtgaacaagctgaccaagaaggaggagagccctgagcacaaggagatcaaccacctgaatgaccagtggctggacctgtgccggcagagcaacaacctgtgcctgcagcgggaggaggacctgcagaggacccgggactaccatgactgcatgaatgtggtggaggtgttcctggagaagttcaccacagagtgggacaacctggcccggagtgatgctgagagcacagctgtgcacctggaggccctgaagaagctggccctggccctgcaggagaggaaatatgccatcgaggacctgaaggaccagaagcagaagatgattgagcacctgaacctggatgacaaggagctggtgaaggagcagaccagccacctggagcagcgctggttccagctggaggacctgatcaagaggaagatccaggtgtctgtgaccaacctggaggagctgaatgtggtgcagagccgcttccaggagctgatggagtgggccgaggagcagcagcccaacattgctgaggccctgaagcagagccccccaccagacatggcccagaacctgctgatggaccacctggccatctgcagcgagctggaggccaagcagatgctgctgaagagcctcatcaaggatgctgacagagtgatggctgacctgggcctgaatgaaaggcaggtgatccagaaggccctgagtgatgcccagagccacgtgaactgcctgagtgacctggtgggccagaggaggaagtacctgaacaaggccctgtctgagaagacccagttcctgatggctgtgttccaggccaccagccagatccagcagcacgagaggaagatcatgttccgggagcacatctgcctgctgcctgatgatgtgtccaagcaggtgaagacctgcaagagcgcccaggccagcctgaagacctaccagaatgaggtgacaggcctgtgggcccagggccgggagctgatgaaggaggtgacagagcaggagaagtctgaggtgctgggcaagctgcaggagctgcagagcgtgtatgattctgtgctgcagaagtgcagccaccggctgcaggagctggagaagaacctggtgtccaggaagcacttcaaggaggactttgacaaggcctgccactggctgaagcaggccgacatcgtgaccttccctgagatcaacctgatgaatgaaagcagcgagctgcacacccagctggccaagtaccagaacatcctggagcagagcccagaatatgagaacctgctgctgaccctgcagaggacaggccagaccatcctgcccagcctgaatgaggtggaccacagctacctgtctgagaagctgaatgccctgccccggcagttcaacgtgattgtggccctggccaaggacaagttctacaaggtgcaggaggccatcctggccaggaaggagtatgccagcctcatcgagctgaccacccagagcctgtctgagctggaggcccagttcctgaggatgagcaaggtgcccacagacctggccgtggaggaggccctgagcctgcaggacggctgccgggccatcctggatgaggtggccggcctgggggaggccgtggatgagctgaaccagaagaaggagggcttccgcagcacaggccagccctggcagcctgacaagatgctgcacctggtgaccctgtaccaccggctgaagaggcagacagagcagagggtgtccctgctggaggacaccaccagcgcctaccaggagcacgagaagatgtgccagcagctggagcggcagctgaagtctgtgaaggaggagcagagcaaggtgaatgaggagaccctgcctgctgaggagaagctgaagatgtaccacagcctggccggcagcctgcaggacagcggcatcgtgctgaagagggtgaccatccacctggaggacctggccccccacctggaccccctggcctatgagaaggcccggcaccagatccagagctggcagggcgagctgaagctgctgaccagcgccatcggggagaccgtgacagaatgtgagagcaggatggtgcagagcattgacttccagacagagatgagccgcagcctggactggctgcggcgggtgaaggccgagctgagcggccctgtgtacctggacctgaacctgcaggacatccaggaggagatcaggaagatccagatccaccaggaggaggtgcagagcagcctgcgcatcatgaatgccctgagccacaaggagaaggagaagttcaccaaggccaaggagctgatctctgctgacctggagcacagcctggccgagctgtctgagctggatggagacatccaggaggccctgcggacccggcaggccaccctgacagagatctacagccagtgccagcgctactaccaggtgttccaggccgccaatgactggctggaggatgcccaggagctgctgcagctggccggaaatggcctggatgtggagagcgctgaggagaacctgaagagccacatggagttcttcagcacagaggaccagttccacagcaacctggaggagctgcacagcctggtggccaccctggaccccctcatcaagcccaccgggaaggaggacctggagcagaaggtggccagcctggagctgcggagccagaggatgagccgggacagcggggcccaggtggacctgctgcagcgctgcacagcccagtggcatgactaccagaaggcccgggaggaggtgattgagctgatgaatgacacagagaagaagctgtctgagttcagcctgctgaagaccagcagcagccatgaggccgaggagaagctgtctgagcacaaggccctggtgtctgtggtgaacagcttccacgagaagatcgtggccctggaggagaaggccagccagctggagaagacaggaaatgatgccagcaaggccaccctgagccgctccatgaccaccgtgtggcagcgctggacccggctgcgggctgtggcccaggaccaggagaagatcctggaggatgctgtggatgagtggacaggcttcaacaacaaggtgaagaaggccacagagatgattgaccagctgcaggacaagctgcccggcagcagcgctgagaaggccagcaaggccgagctgctgaccctgctggagtaccatgacacctttgtgctggagctggagcagcagcagagcgccctgggcatgctgcggcagcagaccctgtccatgctgcaggatggagctgcccccaccccaggagaggagccccccctgatgcaggagatcacagccatgcaggaccgctgcctgaacatgcaggagaaggtgaagaccaacgggaagctggtgaagcaggagctgaaggaccgggagatggtggagacccagatcaacagcgtgaagtgctgggtgcaggagaccaaggagtacctgggcaaccccaccattgaaattgatgcccagctggaggagctgcagatcctgctgacagaggccaccaaccaccggcagaacatcgagaagatggccgaggagcagaaggagaagtacctgggcctgtacaccatcctgcccagcgagctgagcctgcagctggccgaggtggccctggacctgaagatccgggaccagatccaggacaagatcaaggaggtggagcagagcaaggccaccagccaggagctgagccggcagatccagaagctggccaaggacctgaccaccatcctgaccaagctgaaggccaagacagacaacgtggtgcaggccaagacagaccagaaggtgctgggggaggagctggatggctgcaacagcaagctgatggagctggatgctgctgtgcagaagttcctggagcagaatggccagctgggcaagcccctggccaagaagattggcaagctgacagagctgcaccagcagaccatccggcaggccgagaaccggctgagcaagctgaaccaggccgccagccacctggaggagtacaatgagatgctggagctgatcctgaagtggattgagaaggccaaggtgctggcccacggcaccatcgcctggaacagcgccagccagctgcgggagcagtacatcctgcaccagaccctgctggaggagagcaaggagattgattctgagctggaggccatgacagagaagctgcagtacctgacctctgtgtactgcacagagaagatgagccagcaggtggccgagctgggccgggagacagaggagctgcggcagatgatcaagatccggctgcagaacctgcaggatgctgccaaggacatgaagaagtttgaagctgagctgaagaagctgcaggccgccctggagcaggcccaggccaccctgaccagccctgaggtgggccgcctgagcctgaaggagcagctgagccaccggcagcacctgctgtctgagatggagagcctgaagcccaaggtgcaggccgtgcagctgtgccagagcgccctgcgcatcccagaagatgtggtggccagcctgcccctgtgccacgccgccctgcggctgcaggaggaggccagccggctgcagcacacagccatccagcagtgcaacatcatgcaggccgctgtggtgcagtatgagcagtatgagcaggagatgaagcacctgcagcagctgattgagggcgcccaccgggagattgaggacaagcctgtggccaccagcaacatccaggagctgcaggcccagatcagcagacatgaggagctggcccagaagatcaagggctaccaggagcagatcgccagcctgaacagcaagtgcaagatgctgaccatgaaggccaagcacgccaccatgctgctgactgtgacagaggtggagggcctggccgagggcacagaggacctggatggagagctgctgcccacccccagcgcccaccccagcgtggtgatgatgacagctggccgctgccacaccctgctgagccctgtgacagaggagagcggggaggagggcaccaacagcgagatcagcagccccccagcctgccgcagccccagccctgtggccaacacagatgcctctgtgaaccaggacatcgcctactaccaggccctgtctgctgagcggctgcagacagatgctgccaagatccaccccagcaccagcgccagccaggagttctatgagcccggcctggagcccagcgccacagccaagctgggggacctgcagaggtcctgggagaccctgaagaatgtcatcagcgagaagcagaggaccctgtatgaggccctggagcggcagcagaagtaccaggacagcctgcagagcatcagcaccaagatggaggccatcgagctgaagctgtctgagagccctgagcccggccgcagccctgagagccagatggccgagcaccaggccctgatggatgagatcctgatgctgcaggatgagatcaatgagctgcagagcagcctggccgaggagctggtgtctgagagctgtgaggccgaccctgctgagcagctggccctgcagagcaccctgactgtgctggccgagaggatgagcaccatccgcatgaaggccagcggcaagaggcagctgctggaggagaagctgaatgaccagctggaggagcagaggcaggagcaggccctgcagcgctaccgctgtgaggctgatgagctggacagctggctgctgagcaccaaggccaccctggacacagccctgagcccccccaaggagcccatggacatggaggcccagctgatggactgccagaacatgctggtggagattgagcagaaggtggtggccctgtctgagctgtctgtgcacaatgaaaacctgctgctggagggcaaggcccacaccaaggatgaggccgagcagctggccggcaagctgcggcggctgaagggcagcctgctggagctgcagagggccctgcatgacaagcagctgaacatgcagggcacagcccaggagaaggaggagagtgatgtggacctgacagccacccagagccctggggtgcaggagtggctggcccaggcccggaccacctggacccagcagaggcagagcagcctgcagcagcagaaggagctggagcaggagctggccgagcagaagagcctgctgcggtctgtggccagcagaggagaggagatcctgatccagcacagcgctgctgagaccagcggagatgctggggagaagccagatgtgctgagccaggagctgggcatggagggggagaagagcagcgctgaggaccagatgaggatgaagtgggagagcctgcaccaggagttcagcaccaagcagaagctgctgcagaatgtgctggagcaggagcaggagcaggtgctgtacagccggcccaaccggctgctgagcggcgtgcccctgtacaagggagatgtgcccacccaggacaagtctgctgtgaccagcctgctggatggcctgaaccaggcctttgaggaggtgagcagccagagcggcggggccaagaggcagagcatccacctggagcagaagctgtatgatggagtgtctgccaccagcacctggctggatgatgtggaggagcggctgtttgtggccacagccctgctgcctgaggagacagagacctgcctcttcaaccaggagatcctggccaaggacatcaaggagatgtctgaggagatggacaagaacaagaacctcttcagccaggccttcccagaaaatggagacaacagagatgtgattgaggacaccctgggctgcctgctgggccgcctgagcctgctggacagcgtggtgaaccagcgctgccaccagatgaaggagcggctgcagcagatcctgaacttccagaatgacctgaaggtgctcttcaccagcctggccgacaacaagtacatcatcctgcagaagctggccaacgtgtttgagcagcctgtggccgagcagatcgaggccatccagcaggccgaggatggcctgaaggagtttgatgctggcatcatcgagctgaagagaagaggagacaagctgcaggtggagcagcccagcatgcaggagctgagcaagctgcaggacatgtatgatgagctgatgatgatcatcggcagcagaagaagtggcctgaaccagaacctgaccctgaagagccagtatgagcgggccctgcaggacctggccgacctgctggagaccggccaggagaagatggccggggaccagaagatcatcgtgagcagcaaggaggagatccagcagctgctggacaagcacaaggagtacttccagggcctggagagccacatgatcctgacagagaccctcttcaggaagatcatcagctttgctgtgcagaaggagacccagttccacacagagctgatggcccaggccagcgctgtgctgaagagggcccacaagaggggcgtggagctggagtacatcctggagacctggagccacctggatgaggaccagcaggagctgagccggcagctggaggtggtggagagcagcatccccagcgtgggcctggtggaggagaatgaagatcggctgattgaccgcatcaccctgtaccagcacctgaagagcagcctgaatgagtaccagcccaagctgtaccaggtgctggatgatggcaagaggctgctgatcagcatcagctgcagcgacctggagagccagctgaaccagctgggggagtgctggctgagcaacaccaacaagatgagcaaggagctgcaccggctggagaccatcctgaagcactggacccgctaccagagcgagagcgctgacctgatccactggctgcagagcgccaaggaccggctggagttctggacccagcagagcgtgacagtgccccaggagctggagatggtgcgggaccacctgaatgccttcctggagttcagcaaggaggtggatgcccagagcagcctgaagagctctgtgctgagcacaggcaaccagctgctgcggctgaagaaggtggacacagccaccctgcggtctgagctgagcagaattgacagccagtggacagacctgctgaccaacatcccagctgtgcaggagaagctgcaccagctgcagatggacaagctgcccagcagacatgccatcagcgaggtgatgtcctggatcagcctgatggagaatgtcatccagaaggatgaggacaacatcaagaacagcatcggctacaaggccatccacgagtacctgcagaagtacaagggcttcaagattgacatcaactgcaagcagctgactgtggactttgtgaaccagagcgtgctgcagatcagcagccaggatgtggagagcaagagaagtgacaagacagactttgctgagcagctgggcgccatgaacaagtcctggcagatcctgcagggcctggtgacagagaagatccagctgctggagggcctgctggagagctggagcgaatatgagaacaacgtgcagtgcctgaagacctggtttgagacccaggagaagaggctgaagcagcagcacagaattggagaccaggcctctgtgcagaatgccctgaaggactgccaggacctggaggacctgatcaaggccaaggagaaggaggtggagaagattgagcagaatggcctggccctgatccagaacaagaaggaggatgtgagcagcatcgtgatgagcaccctgcgggagctgggccagacctgggccaacctggaccacatggtgggccagctgaagatcctgctgaagtctgtgctggaccagtggagcagccacaaggtggcctttgacaagatcaacagctacctgatggaggcccgctacagcctgagccgcttccggctgctgaccggcagcctggaggccgtgcaggtgcaggtggacaacctgcagaacctgcaggatgacctggagaagcaggagaggagcctgcagaagtttggcagcatcaccaaccagctgctgaaggagtgccacccccctgtgacagagaccctgaccaacaccctgaaggaggtgaacatgcgctggaacaacctgctggaggagattgctgagcagctgcagagcagcaaggccctgctgcagctgtggcagcgctacaaggactacagcaagcagtgtgccagcacagtgcagcagcaggaggacaggaccaatgagctgctgaaggccgccaccaacaaggacattgctgatgatgaggtggccacctggatccaggactgcaatgacctgctgaagggcctgggcaccgtgaaggacagcctcttcttcctgcacgagctgggggagcagctgaagcagcaggtggatgccagcgctgccagcgccatccagagcgaccagctgagcctgagccagcacctgtgtgccctggagcaggccctgtgcaagcagcagaccagcctgcaggccggcgtgctggactatgagacctttgccaagagcctggaggccctggaggcctggatcgtggaggccgaggagatcctgcagggccaggaccccagccacagcagtgacctgagcaccatccaggagaggatggaggagctgaagggccagatgctgaagttcagctccatggccccagacctggaccggctgaatgagctgggctaccgcctgcccctgaatgacaaggagatcaagaggatgcagaacctgaacagacactggagcctcatcagcagccagaccacagagcgcttcagcaagctgcagagcttcctgctgcagcaccagaccttcctggagaagtgtgagacctggatggagttcctggtgcagacagagcagaagctggccgtggagatcagcggcaactaccagcacctgctggagcagcagagggcccacgagctgttccaggccgagatgttcagccggcagcagatcctgcacagcatcatcattgatggccagaggctgctggagcagggccaggtggatgacagagatgagttcaacctgaagctgaccctgctgagcaaccagtggcagggcgtcatcagaagagcccagcagaggcggggcatcatcgacagccagatccggcagtggcagcgctaccgggagatggccgagaagctgaggaagtggctggtggaggtgtcctacctgcccatgagcggcctgggctctgtgcccatccccctgcagcaggcccggaccctgtttgatgaggtgcagttcaaggagaaggtgttcctgcggcagcagggcagctacatcctgactgtggaggccggcaagcagctgctgctgtctgctgacagcggggctgaggccgccctgcaggccgagctggccgagatccaggagaagtggaagagcgcctccatgaggctggaggagcagaagaagaagctggccttcctgctgaaggactgggagaagtgtgagaagggcattgctgacagcctggagaagctgcggaccttcaagaagaagctgagccagagcctgcctgaccaccacgaggagctgcatgctgagcagatgcgctgcaaggagctggagaatgctgtgggctcctggacagatgacctgacccagctgagcctgctgaaggacaccctgagcgcctacatctctgcagatgacatcagcatcctgaatgaaagagtggagctgctgcagaggcagtgggaggagctgtgccaccagctgagcctgcggcggcagcagattggagagcggctgaatgagtgggccgtgttcagcgagaagaacaaggagctgtgtgagtggctgacccagatggagagcaaggtgtcccagaatggagacatcctgattgaggagatgattgagaagctgaagaaggactaccaggaggagatcgccatcgcccaggagaacaagatccagctgcagcagatgggagagcggctggccaaggccagccatgagagcaaggccagcgagattgagtacaagctgggcaaggtgaatgaccgctggcagcacctgctggacctgattgctgcccgggtgaagaagctgaaggagaccctggtggccgtgcagcagctggacaagaacatgagcagcctgcggacctggctggcccacatcgagagcgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagcggggtcatctacacagtggccaaggaggagctgaagaagtttgaggccttccagaggcaggtgcatgaatgtctgacccagctggagctgatcaacaagcagtaccgccgcctggccagagaaaatagaacagacagcgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171269 - DNA, 25230 bp, Artificial Sequence
  Description of Artificial Sequence: Synthetic coding sequence
atggccaccagcagaggagccagccgctgcccccgggacatcgccaacgtgatgcagaggctgcaggatgagcaggagatcgtgcagaagaggaccttcaccaagtggatcaacagccacctggccaagaggaagccacccatggtggtggatgacctgtttgaggacatgaaggatggagtgaagctgctggccctgctggaggtgctgagcggccagaagctgccctgtgagcagggccgcaggatgaagagaattcatgctgtggccaacatcggcacagccctgaagttcctggagggcaggaagatcaagctggtgaacatcaacagcacagacattgctgatggccggcccagcatcgtgctgggcctgatgtggaccatcatcctgtacttccagatcgaggagctgaccagcaacctgccccagctgcagagcctgagcagcagcgccagctctgtggacagcatcgtgtcctctgagacccccagcccccccagcaagaggaaggtgaccaccaagatccagggcaatgccaagaaggccctgctgaagtgggtgcagtacacagctgggaagcagacaggcatcgaggtgaaggactttgggaagtcctggaggtctggagtggccttccacagcgtcatccacgccatccggcctgagctggtggacctggagaccgtgaagggccgcagcaaccgggagaacctggaggatgccttcaccatcgccgagacagagctgggcatcccccggctgctggaccctgaagatgtggatgtggacaagccagatgagaagagcatcatgacctacgtggcccagttcctgaagcactacccagacatccacaatgccagcacagatggccaggaggatgatgagatcctgcccggcttccccagctttgccaacagcgtgcagaacttcaagagagaagatagagtcatcttcaaggagatgaaggtgtggattgagcagtttgagcgggacctgacccgggcccagatggtggagagcaacctgcaggacaagtaccagagcttcaagcacttccgggtgcagtatgagatgaagaggaagcagatcgagcacctgatccagcccctgcacagagatggcaagctgagcctggaccaggccctggtgaagcagagctgggacagagtgaccagccggctgtttgactggcacatccagctggacaagagcctgcctgcccccctgggcaccatcggggcctggctgtacagagctgaggtggccctgcgggaggagatcaccgtgcagcaggtgcatgaggagacagccaacaccatccagaggaagctggagcagcacaagaggaagctgagaaatgtgattgacctgctgcagaacacagatgcccacaagagggccttccacgagatctaccgcaccaggtctgtgaatggcatccctgtgcccccagaccagctggaggacatggccgagcgcttccactttgtgagcagcaccagcgagctgcacctgatgaagatggagttcctggagctgaagtaccgcctgctgagcctgctggtgctggccgagagcaagctgaagtcctggatcatcaagtatggaagaagagagagcgtggagcagctgctgcagaactacgtgtccttcatcgagaacagcaagttctttgagcagtatgaggtgacctaccagatcctgaagcagacagctgagatgtatgtgaaggcagatggctctgtggaggaggccgagaatgtgatgaagttcatgaatgagaccacagcccagtggaggaacctgtctgtggaggtgcgctctgtgcgctccatgctggaggaggtgatcagcaactgggacagatatggcaacacagtggccagcctgcaggcctggctggaggatgctgagaagatgctgaaccagagtgaaaatgccaagaaggacttcttcaggaacctgccccactggatccagcagcacacagccatgaatgatgctggcaacttcctgattgagacctgtgatgagatggtgtcccgggacctgaagcagcagctgctgctgctgaatggccgctggagggagctgttcatggaggtgaagcagtatgcccaggctgatgagatggacaggatgaagaaggagtacacagactgtgtggtgaccctgagcgcctttgccacagaggcccacaagaagctgtctgagcccctggaggtgtccttcatgaatgtgaagctgctgatccaggacctggaggacatcgagcagagggtgcctgtgatggatgcccagtacaagatcatcaccaagacagcccacctgatcaccaaggagagcccccaggaggagggcaaggagatgtttgccaccatgagcaagctgaaggagcagctgaccaaggtgaaggagtgctacagccccctgctgtatgagagccagcagctgctgatccccctggaggagctggagaagcagatgaccagcttctatgacagcctgggcaagatcaatgagatcatcaccgtgctggagcgggaggcccagagcagcgccctcttcaagcagaagcaccagctgcgcatcctgaagtgcaagtggtgcaacagcagccagaagatgaccctgtgcctggtgctgggctccatgatctccatgctgagcacagccaagatcaccatcgccggctacaagtctgaggtggaggtgtctgagctgctggcctgccaggagaactgcaagaagaccctgaccctcatcgagaagggcagccagagcgtgcagaagtttgtgaccctgagcaatgtgctgaagcactttgaccagacccggctgcagacagactgccgctacagctgctgcttctctgtgatgaggaagcagcaccacatcatgattgtgttccacatcaagtccatggtgaagaagacaggagactggaagaagcacgtggagaccaacagccggctgatgaagaagtttgaggagagcagagctgagctggagaaggtgctgagaattgcccaggagggcctggaggagaagggggaccctgaggagctgctgcggcggcacacagagttcttcagccagctggaccagagggtgctgaatgccttcctgaaggcctgtgatgagctgacagacatcctgcctgagcaggagcagcagggcctgcaggaggccgtgaggaagctgcacaagcagtggaaggacctgcagggcgaggccccctaccacctgctgcacctgaagattgatgtggagaagaaccgcttcctggcctctgtggaggagtgcaggacagagctggaccgggagaccaagctgatgccccaggagggcagcgagaagatcatcaaggagcacagggtcttcttcagtgacaagggcccccaccacctgtgtgagaagaggctgcagctgattgaggagctgtgtgtgaagctgcctgtgcgggaccctgtgcgggacaccccaggcacctgccacgtgaccctgaaggagctgcgggccgccatcgacagcacctacaggaagctgatggaggaccctgacaagtggaaggactacaccagccgcttcagcgagttcagctcctggatcagcaccaatgagacccagctgaagggcatcaagggggaggccatcgacacagccaaccacggggaggtgaagagagctgtggaggagatcagaaatggagtgaccaagagaggagagaccctgtcctggctgaagagccggctgaaggtgctgacagaggtgtccagtgaaaatgaggcccagaagcagggagatgagctggccaagctgagcagcagcttcaaggccctggtgaccctgctgtctgaggtggagaagatgctgagcaactttggagactgtgtgcagtacaaggagatcgtgaagaacagcctggaggagctgatcagcggcagcaaggaggtgcaggagcaggccgagaagatcctggacacagagaacctgtttgaggcccagcagctgctgctgcaccaccagcagaagaccaagaggatcagcgccaagaagagagatgtgcagcagcagatcgcccaggcccagcagggcgagggcggcctgcctgaccggggccacgaggagctgaggaagctggagagcaccctggatggcctggagaggagccgggagcggcaggagcggcgcatccaggtgaccctgaggaagtgggagagatttgagaccaacaaggagaccgtggtgcgctacctgttccagacaggcagcagccatgagcgcttcctgtccttcagcagcctggagagcctgagcagcgagctggagcagaccaaggagttcagcaagaggacagagagcattgctgtgcaggccgagaacctggtgaaggaggccagcgagatccccctgggcccccagaacaagcagctgctgcagcagcaggccaagagcatcaaggagcaggtgaagaagctggaggacaccctggaggaggagtatgtgattgacaacaagaccatggagatggtgaagaccaagtgggaccacttcggcagcaactttgagaccctgtctgtgtggatcacagagaaggagaaggagctgaatgccctggagaccagcagcagcgccatggacatgcagatcagccagatcaaggtgaccatccaggagattgagagcaagctgagcagcatcgtgggcctggaggaggaggcccagagctttgcccagtttgtgaccaccggggagagcgcccgcatcaaggccaagctgacccagatccgccgctacggggaggagctgcgggagcacgcccagtgcctggagggcaccatcctgggccacctgagccagcagcagaagtttgaggagaacctgaggaagatccagcagagcgtgtctgaatttgaggacaagctggccgtgcccatcaagatctgcagcagcgccacagagacctacaaggtgctgcaggagcacatggacctgtgccaggccctggagagcctgagcagcgccatcacagccttcagcgccagcgccaggaaggtggtgaacagagacagctgtgtgcaggaggccgccgccctgcagcagcagtatgaggacatcctgcggcgggccaaggagcggcagacagccctggagaacctgctggcccactggcagaggctggagaaggagctgagcagcttcctgacctggctggagcggggggaggccaaggccagcagccctgagatggacatctctgctgacagagtgaaggtggaggccagcaaggatgatgtgaagatgatgaagctgcacctggagcagctggatgagcgctggagggacctgccccagatcatcaacaagaggatcaacttcctgcagagcgtggtggccgagcaccagcagtttgatgagctgctgctgtccttctctgtgtggatcaagctgttcctgtctgagctgcagaccaccagcgagatcagcatcatggaccaccaggtggccctgaccaggcacaaggaccatgctgctgaggtggagagcaagaagggggagctgcagagcctgcagggccacctggccaagctgggcagcctgggccgggcagaggacctgcacctgctgcagggcaaggccgaggactgcttccagctgtttgaggaggccagccaggtggtggagcggcggcagctggccctgagccacctggccgagttcctgcagagccacgccagcctgagcggcatcctgcggcagctgcggcagacagtggaggccaccaacagcatgaacaagaatgaaagtgacctgattgagaaggacctgaatgatgccctgcagaatgccaaggccctggagagcgctgctgtgtccctggatggcatcctgagcaaggcccagtaccacctgaagattggcagcagcgagcagaggaccagctgccgggccacagctgaccagctgtgtggggaggtggagcgcatccagaacctgctgggcaccaagcagagcgaggctgatgccctggccgtgctgaagaaggccttccaggaccagaaggaggagctgctgaagagcattgaggacatcgaggagaggacagacaaggagcggctgaaggagcccacccggcaggccctgcagcagaggctgcgggtcttcaaccagctggaggatgagctgaacagccatgagcacgagctgtgctggctgaaggacaaggccaagcagatcgcccagaaggatgtggcctttgcccctgaggtggaccgggagatcaaccggctggaggtgacctgggatgacaccaagaggctcatccacgagaaccagggccagtgctgcggcctgattgacctgatgagggagtaccagaacctgaagtctgctgtgtccaaggtgctggagaatgccagcagcgtcatcgtgaccaggaccaccatcaaggaccaggaggacctgaagtgggccttcagcaagcatgaaacagccaagaacaagatgaactacaagcagaaggacctggacaacttcaccagcaagggcaagcacctgctgtctgagctgaagaagatccacagcagtgacttcagcctggtgaagacagacatggagagcacagtggacaagtggctggatgtgtctgagaagctggaggagaacatggaccggctgcgggtgtccctgagcatctgggatgatgtgctgagcaccagagatgaaattgagggctggagcaacaactgtgtgccccagatggccgagaacatcagcaacctggacaaccacctgcgggcagaggagctgctgaaggagtttgaaagtgaggtgaagaacaaggccctgcggctggaggagctgcacagcaaggtgaatgacctgaaggagctgaccaagaacctggagaccccaccagacctgcagttcatcgaggccgacctgatgcagaagctggagcacgccaaggagatcacagaggtggccaagggcaccctgaaggacttcaccgcccagagcacccaggtggagaagttcatcaatgacatcaccacctggttcaccaaggtggaggagagcctgatgaactgtgcccagaatgagacctgtgaggccctgaagaaggtgaaggacatccagaaggagctgcagagccagcagagcaacatcagcagcacccaggagaacctgaacagcctgtgcaggaagtaccacagcgctgagctggagagcctgggccgggccatgacaggcctcatcaagaagcatgaggccgtgtcccagctgtgcagcaagacccaggccagcctgcaggagagcctggagaagcacttcagcgaggagagcatgcaggagttccaggagtggttcctgggcgccaaggccgccgccaaggagagcagtgacagaactggagacagcaaggtgctggaggccaagctgcatgacctgcagcagaacatcctggacagcgtgtctgatggccagagcaagctggatgctgtgacccaggagggccagaccctgtatgcccacctgagcaagcagatcgtgagcagcatccaggagcagatcaccaaggccaatgaggagttccaggccttcctgaagcagtgcctgaaggacaagcaggccctgcaggactgtgccagcgagctgggcagctttgaggaccagcacaggaagctgaacctgtggattcatgagatggaggagcgcttcaacacagagaacctgggggagagcaagcagcacatccctgagaagaagaatgaggtgcacaaggtggagatgttcctgggggagctgctggccgcccgggagagcctggacaagctgagccagaggggccagctgctgtctgaggagggccacggggccggccaggagggccgcctgtgcagccagctgctgaccagccaccagaacctgctgaggatgaccaaggagaagctgcggagctgccaggtggccctgcaggagcacgaggccctggaggaggccctgcagagcatgtggttctgggtgaaggccatccaggaccggctggcctgtgccgagagcaccctgggcagcaaggacaccctggagaagaggctgagccagatccaggacatcctgctgatgaagggggagggggaggtgaagctgaacatggccatcggcaagggggagcaggccctgcggagcagcaacaaggagggccagagggtcatccagacccagctggagaccctgaaggaggtgtgggccgacatcatgagcagctctgtgcacgcccagagcaccctggagagcgtcatcagccagtggaatgactatgtggagaggaagaaccagctggagcagtggatggagagcgtggaccagaagattgagcaccccctgcagccccagcccggcctgaaggagaagtttgtgctgctggaccacctgcagagcatcctgtctgaggccgaggaccacacccgggccctgcaccggctgattgccaagagccgggagctgtatgagaagacagaagatgagagcttcaaggacacagcccaggaggagctgaagacccagttcaatgacatcatgacagtggccaaggagaagatgaggaaggtggaggagatcgtgaaggaccacctgatgtacctggatgctgtgcatgagttcacagactggctgcacagcgccaaggaggagctgcaccgctggagcgacatgtctggggacagcagcgccacccagaagaagctgagcaagatcaaggagctgattgacagccgggagattggagccagccggctgagccgggtggagagcctggcccctgaggtgaagcagaacaccacagccagcggctgtgagctgatgcacacagagatgcaggccctgcgggctgactggaagcagtgggaggacagcgtcttccagacccagagctgcctggagaacctggtgtcccagatggccctgtctgagcaggagttcagcggccaggtggcccagctggagcaggccctggagcagttcagcgccctgctgaagacctgggcccagcagctgaccctgctggagggcaagaacacagatgaggagatcgtggagtgctggcacaagggccaggagatcctggatgccctgcagaaggccgagcccaggacagaggacctgaagagccagctgaatgagctgtgccgcttcagccgggacctgagcacctacagcggcaaggtgtctggcctcatcaaggagtacaactgcctgtgcctgcaggccagcaagggctgccagaacaaggagcagatcctgcagcagcgcttcaggaaggccttccgggacttccagcagtggctggtgaatgccaagatcaccacagccaagtgctttgacatcccccagaacatcagcgaggtgtccaccagcctgcagaagatccaggagttcctgtctgagagtgaaaatggccagcacaagctgaacatgatgctgagcaagggggagctgctgagcaccctgctgaccaaggagaaggccaagggcatccaggccaaggtgacagctgccaaggaggactggaagaacttccacagcaacctgcaccagaaggagagcgccctggagaacctgaagatccagatgaaggactttgaggtgtctgctgagcccatccaggactggctgagcaagacagagaagatggtgcatgagagcagcaaccggctgtatgacctgcctgccaagagaagagagcagcagaagctgcagagcgtgctggaggagatccactgctatgagccccagctgaaccggctgaaggagaaggcccagcagctgtgggagggccaggccgccagcaagagcttccgccaccgggtgtcccagctgagcagccagtacctggccctgagcaacctgaccaaggagaaggtgtcccggctggacagaattgtggccgagcacaaccagttcagcctgggcatcaaggagctgcaggactggatgacagatgccatccacatgctggacagctactgccaccccaccagtgacaagtctgtgctggacagcaggaccctgaagctggaggccctgctgtctgtgaagcaggagaaggagatccagatgaagatgattgtgaccagaggagagagcgtgctgcagaacaccagccctgagggcatccccaccatccagcagcagctgcagagcgtgaaggacatgtgggccagcctgctgtctgctggcatccgctgcaagagggtgcggctgccctgtgcctacatcgccctgaagctgcgggtgcaccagcacgccgagctgcgggacaagaccaccatgctgggcaaggccaaggaggccgtgaccaagtctgagaagctggtgcggctgcaccaggagtaccagagggacctgaaggcctttgaggtgtggctgggccaggagcaggagaagctggaccagtacagcgtgctggagggagatgcccacacccatgagaccaccctgcgggacctgcaggagctgcaggtgcactgtgccgagggccaggccctgctgaacagcgtgctgcacacccgggaggatgtgatccccagcggcatcccccaggctgaagatcgggccctggagagcctgcggcaggactggcaggcctaccagcaccggctgtctgagaccaggacccagttcaacaacgtggtgaacaagctgcggctgatggagcagaagttccagcaggtggatgagtggctgaagacagctgaggagaaggtgagccccaggacccggcggcagagcaacagagccaccaaggagatccagctgcaccagatgaagaagtggcatgaggaggtgacagcctacagagatgaggtggaggaggtgggcgcccgggcccaggagatcctggatgagagccacgtgaacagcaggatgggctgccaggccacccagctgaccagccgctaccaggccctgctgctgcaggtgctggagcagatcaagttcctggaggaggagatccagagcctggaggagagcgagagcagcctgagcagctacagcgactggtacggcagcacccacaagaacttcaagaatgtggccaccaagattgacaaggtggacacagtgatgatgggcaagaagctgaagaccctggaggtgctgctgaaggacatggagaagggccacagcctgctgaagagcgcccgggagaagggggagagagctgtgaagtacctggaggagggggaggccgagcggctgaggaaggagatccatgaccacatggagcagctgaaggagctgaccagcacagtgaggaaggagcacatgaccctggagaagagcctgcagcagacagtgctgagccatgagcccagcgtgaagtctgtgcgggagaagggggaggccctgctggagctggtgcaggatgtgaccctgaaggacaagattgaccagctgcagagcgactaccaggacctgtgcagcatcggcaaggagcacgtgttcagcctggaggccaaggtgaaggaccacgaggactacaacagcgagctgcaggaggtggagaagtggctgctgcagatgagcggccgcctggtggccccagacctgctggagaccagcagcctggagaccatcacccagcagctggcccaccacaagatgtaccagagcctggagcacgagctgcagaagcacgtgtcccggcaggacaccctgcagcagtgccaggcctggctgtctgctgtgcagcctgacctggagcccagcccccagccccccctgagcagagctgaggccatcaagcaggtgaagcacttccgggccctgcaggagcaggcccggacctacctggacctgctgtgcagcatgtgtgacctgagcaatgcctctgtgaagaccacagccaaggacatccagcagacagagcagaccatcgagcagaagctggtgcaggcccagaacctgacccagggctgggaggagatcaagcacctgaagtctgagctgtggatctacctgcaggatgctgaccagcagctgcagaacatgaagagaagacacagcgagctggagctgaacatcgcccagaacatggtgtcccaggtgaaggactttgtgaagaagctgcagagcaagcaggcctctgtgaacaccatcatcgagaaggtgaacaagctgaccaagaaggaggagagccctgagcacaaggagatcaaccacctgaatgaccagtggctggacctgtgccggcagagcaacaacctgtgcctgcagcgggaggaggacctgcagaggacccgggactaccatgactgcatgaatgtggtggaggtgttcctggagaagttcaccacagagtgggacaacctggcccggagtgatgctgagagcacagctgtgcacctggaggccctgaagaagctggccctggccctgcaggagaggaaatatgccatcgaggacctgaaggaccagaagcagaagatgattgagcacctgaacctggatgacaaggagctggtgaaggagcagaccagccacctggagcagcgctggttccagctggaggacctgatcaagaggaagatccaggtgtctgtgaccaacctggaggagctgaatgtggtgcagagccgcttccaggagctgatggagtgggccgaggagcagcagcccaacattgctgaggccctgaagcagagccccccaccagacatggcccagaacctgctgatggaccacctggccatctgcagcgagctggaggccaagcagatgctgctgaagagcctcatcaaggatgctgacagagtgatggctgacctgggcctgaatgaaaggcaggtgatccagaaggccctgagtgatgcccagagccacgtgaactgcctgagtgacctggtgggccagaggaggaagaagcacttcaaggaggactttgacaaggcctgccactggctgaagcaggccgacatcgtgaccttccctgagatcaacctgatgaatgaatcttctgagctgcacacccagctggccaagtaccagaacatcctggagcagagcccagaatatgagaacctgctgctgaccctgcagaggacaggccagaccatcctgcccagcctgaatgaggtggaccacagctacctgtctgagaagctgaatgccctgccccggcagttcaacgtcatcgtggccctggccaaggacaagttctacaaggtgcaggaggccatcctggccaggaaggagtatgccagcctgattgagctgaccacccagagcctgtctgagctggaggcccagttcctgaggatgagcaaggtgcccacagacctggccgtggaggaggccctgagcctgcaggacggctgccgggccatcctggatgaggtggccggcctgggggaggccgtggatgagctgaaccagaagaaggagggcttccgcagcacaggccagccctggcagcctgacaagatgctgcacctggtgaccctgtaccaccggctgaagaggcagacagagcagagggtgtccctgctggaggacaccaccagcgcctaccaggagcacgagaagatgtgccagcagctggagcggcagctgaagtctgtgaaggaggagcagagcaaggtgaatgaggagaccctgcctgctgaggagaagctgaagatgtaccacagcctggccggcagcctgcaggacagcggcatcgtgctgaagagggtgaccatccacctggaggacctggccccccacctggaccccctggcctatgagaaggcccggcaccagatccagagctggcagggcgagctgaagctgctgaccagcgccatcggggagaccgtgacagaatgtgagagcaggatggtgcagagcattgacttccagacagagatgagccgcagcctggactggctgcggcgggtgaaggccgagctgagcggccctgtgtacctggacctgaacctgcaggacatccaggaggagatcaggaagatccagatccaccaggaggaggtgcagagcagcctgcgcatcatgaatgccctgagccacaaggagaaggagaagttcaccaaggccaaggagctgatctctgctgacctggagcacagcctggccgagctgtctgagctggatggagacatccaggaggccctgcggacccggcaggccaccctgacagagatctacagccagtgccagcgctactaccaggtgttccaggccgccaatgactggctggaggatgcccaggagctgctgcagctggccggaaatggcctggatgtggagagcgctgaggagaacctgaagagccacatggagttcttcagcacagaggaccagttccacagcaacctggaggagctgcacagcctggtggccaccctggaccccctcatcaagcccaccgggaaggaggacctggagcagaaggtggccagcctggagctgcggagccagaggatgagccgggacagcggggcccaggccctggtgtctgtggtgaacagcttccacgagaagatcgtggccctggaggagaaggccagccagctggagaagacaggaaatgatgccagcaaggccaccctgagccgctccatgaccaccgtgtggcagcgctggacccggctgcgggctgtggcccaggaccaggagaagatcctggaggatgctgtggatgagtggacaggcttcaacaacaaggtgaagaaggccacagagatgattgaccagctgcaggacaagctgcccggcagcagcgctgagaaggccagcaaggccgagctgctgaccctgctggagtaccatgacacctttgtgctggagctggagcagcagcagagcgccctgggcatgctgcggcagcagaccctgtccatgctgcaggatggagctgcccccaccccaggagaggagccccccctgatgcaggagatcacagccatgcaggaccgctgcctgaagatggtggagacccagatcaacagcgtgaagtgctgggtgcaggagaccaaggagtacctgggcaaccccaccatcgagattgatgcccagctggaggagctgcagatcctgctgacagaggccaccaaccaccggcagaacatcgagaagatggccgaggagcagaaggagaagtacctgggcctgtacaccatcctgcccagcgagctgagcctgcagctggccgaggtggccctggacctgaagatccgggaccagatccaggacaagatcaaggaggtggagcagagcaaggccaccagccaggagctgagccggcagatccagaagctggccaaggacctgaccaccatcctgaccaagctgaaggccaagacagacaacgtggtgcaggccaagacagaccagaaggccgccagccacctggaggagtacaatgagatgctggagctgatcctgaagtggattgagaaggccaaggtgctggcccacggcaccatcgcctggaacagcgccagccagctgcgggagcagtacatcctgcaccagaccctgctggaggagagcaaggagattgattctgagctggaggccatgacagagaagctgcagtacctgacctctgtgtactgcacagagaagatgagccagcaggtggccgagctgggccgggagacagaggagctgcggcagatgatcaagatccggctgcagaacctgcaggatgctgccaaggacatgaagaagtttgaagctgagctgaagaagctgcaggccgccctggagcaggcccaggccaccctgaccagccctgaggtgggccgcctgagcctgaaggagcagctgagccaccggcagcacctgctgtctgagatggagagcctgaagcccaaggtgcaggccgtgcagctgtgccagagcgccctgcgcatcccagaagatgtggtggccagcctgcccctgtgccacgccgccctgcggctgcaggaggaggccagccggctgcagcacacagccatccagcagtgcaacatcatgcaggaggccgtggtgcagtatgagcagtatgagcaggagatgaagcacctgcagcagctgattgagggcgcccaccgggagattgaggacaagcctgtggccaccagcaacatccaggagctgcaggcccagatcagcagacatgaggagctggcccagaagatcaagggctaccaggagcagatcgccagcctgaacagcaagtgcaagatgctgaccatgaaggccaagcacgccaccatgctgctgactgtgacagaggtggagggcctggccgagggcacagaggacctggatggagagctgctgcccacccccagcgcccaccccagcgtggtgatgatgacagctggccgctgccacaccctgctgagccctgtgacagaggagagcggggaggagggcaccaacagcgagatcagcagccccccagcctgccgcagccccagccctgtggccaacacagatgcctctgtgaaccaggacatcgcctactaccaggccctgtctgctgagcggctgcagacagatgctgccaagatccaccccagcaccagcgccagccaggagttctatgagcccggcctggagcccagcgccacagccaagctgggggacctgcagaggtcctgggagaccctgaagaatgtcatcagcgagaagcagaggaccctgtatgaggccctggagcggcagcagaagtaccaggacagcctgcagagcatcagcaccaagatggaggccatcgagctgaagctgtctgagagccctgagcccggccgcagccctgagagccagatggccgagcaccaggccctgatggatgagatcctgatgctgcaggatgagatcaatgagctgcagagcagcctggccgaggagctggtgtctgagagctgtgaggccgaccctgctgagcagctggccctgcagagcaccctgactgtgctggccgagaggatgagcaccatccgcatgaaggccagcggcaagaggcagctgctggaggagaagctgaatgaccagctggaggagcagaggcaggagcaggccctgcagcgctaccgctgtgaggctgatgagctggacagctggctgctgagcaccaaggccaccctggacacagccctgagcccccccaaggagcccatggacatggaggcccagctgatggactgccagaacatgctggtggagattgagcagaaggtggtggccctgtctgagctgtctgtgcacaatgaaaacctgctgctggagggcaaggcccacaccaaggatgaggccgagcagctggccggcaagctgcggcggctgaagggcagcctgctggagctgcagagggccctgcatgacaagcagctgaacatgcagggcacagcccaggagaaggaggagagtgatgtggacctgacagccacccagagccctggggtgcaggagtggctggcccaggcccggaccacctggacccagcagaggcagagcagcctgcagcagcagaaggagctggagcaggagctggccgagcagaagagcctgctgcggtctgtggccagcagaggagaggagatcctgatccagcacagcgctgctgagaccagcggagatgctggggagaagccagatgtgctgagccaggagctgggcatggagggggagaagagcagcgctgaggaccagatgaggatgaagtgggagagcctgcaccaggagttcagcaccaagcagaagctgctgcagaatgtgctggagcaggagcaggagcaggtgctgtacagccggcccaaccggctgctgagcggcgtgcccctgtacaagggagatgtgcccacccaggacaagtctgctgtgaccagcctgctggatggcctgaaccaggcctttgaggaggtgagcagccagagcggcggggccaagaggcagagcatccacctggagcagaagctgtatgatggagtgtctgccaccagcacctggctggatgatgtggaggagcggctgtttgtggccacagccctgctgcctgaggagacagagacctgcctcttcaaccaggagatcctggccaaggacatcaaggagatgtctgaggagatggacaagaacaagaacctcttcagccaggccttcccagaaaatggagacaacagagatgtgattgaggacaccctgggctgcctgctgggccgcctgagcctgctggacagcgtggtgaaccagcgctgccaccagatgaaggagcggctgcagcagatcctgaacttccagaatgacctgaaggtgctcttcaccagcctggccgacaacaagtacatcatcctgcagaagctggccaacgtgtttgagcagcctgtggccgagcagatcgaggccatccagcaggccgaggatggcctgaaggagtttgatgctggcatcatcgagctgaagagaagaggagacaagctgcaggtggagcagcccagcatgcaggagctgagcaagctgcaggacatgtatgatgagctgatgatgatcatcggcagcagaagaagtggcctgaaccagaacctgaccctgaagagccagtatgagcgggccctgcaggacctggccgacctgctggagaccggccaggagaagatggccggggaccagaagatcatcgtgagcagcaaggaggagatccagcagctgctggacaagcacaaggagtacttccagggcctggagagccacatgatcctgacagagaccctcttcaggaagatcatcagctttgctgtgcagaaggagacccagttccacacagagctgatggcccaggccagcgctgtgctgaagagggcccacaagaggggcgtggagctggagtacatcctggagacctggagccacctggatgaggaccagcaggagctgagccggcagctggaggtggtggagagcagcatccccagcgtgggcctggtggaggagaatgaagatcggctgattgaccgcatcaccctgtaccagcacctgaagagcagcctgaatgagtaccagcccaagctgtaccaggtgctggatgatggcaagaggctgctgatcagcatcagctgcagcgacctggagagccagctgaaccagctgggggagtgctggctgagcaacaccaacaagatgagcaaggagctgcaccggctggagaccatcctgaagcactggacccgctaccagagcgagagcgctgacctgatccactggctgcagagcgccaaggaccggctggagttctggacccagcagagcgtgacagtgccccaggagctggagatggtgcgggaccacctgaatgccttcctggagttcagcaaggaggtggatgcccagagcagcctgaagagctctgtgctgagcacaggcaaccagctgctgcggctgaagaaggtggacacagccaccctgcggtctgagctgagcagaattgacagccagtggacagacctgctgaccaacatcccagctgtgcaggagaagctgcaccagctgcagatggacaagctgcccagcagacatgccatcagcgaggtgatgtcctggatcagcctgatggagaatgtcatccagaaggatgaggacaacatcaagaacagcatcggctacaaggccatccacgagtacctgcagaagtacaagggcttcaagattgacatcaactgcaagcagctgactgtggactttgtgaaccagagcgtgctgcagatcagcagccaggatgtggagagcaagagaagtgacaagacagactttgctgagcagctgggcgccatgaacaagtcctggcagatcctgcagggcctggtgacagagaagatccagctgctggagggcctgctggagagctggagcgaatatgagaacaacgtgcagtgcctgaagacctggtttgagacccaggagaagaggctgaagcagcagcacagaattggagaccaggcctctgtgcagaatgccctgaaggactgccaggacctggaggacctgatcaaggccaaggagaaggaggtggagaagattgagcagaatggcctggccctgatccagaacaagaaggaggatgtgagcagcatcgtgatgagcaccctgcgggagctgggccagacctgggccaacctggaccacatggtgggccagctgaagatcctgctgaagtctgtgctggaccagtggagcagccacaaggtggcctttgacaagatcaacagctacctgatggaggcccgctacagcctgagccgcttccggctgctgaccggcagcctggaggccgtgcaggtgcaggtggacaacctgcagaacctgcaggatgacctggagaagcaggagaggagcctgcagaagtttggcagcatcaccaaccagctgctgaaggagtgccacccccctgtgacagagaccctgaccaacaccctgaaggaggtgaacatgcgctggaacaacctgctggaggagattgctgagcagctgcagagcagcaaggccctgctgcagctgtggcagcgctacaaggactacagcaagcagtgtgccagcacagtgcagcagcaggaggacaggaccaatgagctgctgaaggccgccaccaacaaggacattgctgatgatgaggtggccacctggatccaggactgcaatgacctgctgaagggcctgggcaccgtgaaggacagcctcttcttcctgcacgagctgggggagcagctgaagcagcaggtggatgccagcgctgccagcgccatccagagcgaccagctgagcctgagccagcacctgtgtgccctggagcaggccctgtgcaagcagcagaccagcctgcaggccggcgtgctggactatgagacctttgccaagagcctggaggccctggaggcctggatcgtggaggccgaggagatcctgcagggccaggaccccagccacagcagtgacctgagcaccatccaggagaggatggaggagctgaagggccagatgctgaagttcagctccatggccccagacctggaccggctgaatgagctgggctaccgcctgcccctgaatgacaaggagatcaagaggatgcagaacctgaacagacactggagcctcatcagcagccagaccacagagcgcttcagcaagctgcagagcttcctgctgcagcaccagaccttcctggagaagtgtgagacctggatggagttcctggtgcagacagagcagaagctggccgtggagatcagcggcaactaccagcacctgctggagcagcagagggcccacgagctgttccaggccgagatgttcagccggcagcagatcctgcacagcatcatcattgatggccagaggctgctggagcagggccaggtggatgacagagatgagttcaacctgaagctgaccctgctgagcaaccagtggcagggcgtcatcagaagagcccagcagaggcggggcatcatcgacagccagatccggcagtggcagcgctaccgggagatggccgagaagctgaggaagtggctggtggaggtgtcctacctgcccatgagcggcctgggctctgtgcccatccccctgcagcaggcccggaccctgtttgatgaggtgcagttcaaggagaaggtgttcctgcggcagcagggcagctacatcctgactgtggaggccggcaagcagctgctgctgtctgctgacagcggggctgaggccgccctgcaggccgagctggccgagatccaggagaagtggaagagcgcctccatgaggctggaggagcagaagaagaagctggccttcctgctgaaggactgggagaagtgtgagaagggcattgctgacagcctggagaagctgcggaccttcaagaagaagctgagccagagcctgcctgaccaccacgaggagctgcatgctgagcagatgcgctgcaaggagctggagaatgctgtgggctcctggacagatgacctgacccagctgagcctgctgaaggacaccctgagcgcctacatctctgcagatgacatcagcatcctgaatgaaagagtggagctgctgcagaggcagtgggaggagctgtgccaccagctgagcctgcggcggcagcagattggagagcggctgaatgagtgggccgtgttcagcgagaagaacaaggagctgtgtgagtggctgacccagatggagagcaaggtgtcccagaatggagacatcctgattgaggagatgattgagaagctgaagaaggactaccaggaggagatcgccatcgcccaggagaacaagatccagctgcagcagatgggagagcggctggccaaggccagccatgagagcaaggccagcgagattgagtacaagctgggcaaggtgaatgaccgctggcagcacctgctggacctgattgctgcccgggtgaagaagctgaaggagaccctggtggccgtgcagcagctggacaagaacatgagcagcctgcggacctggctggcccacatcgagagcgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagcggggtcatctacacagtggccaaggaggagctgaagaagtttgaggccttccagaggcaggtgcatgaatgtctgacccagctggagctgatcaacaagcagtaccgccgcctggccagagaaaatagaacagacagcgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171270 - DNA, 9966 bp, Artificial Sequence
  Description of Artificial Sequence: Synthetic coding sequence
atggagctggatgctgctgtgcagaagttcctggagcagaatggccagctgggcaagcccctggccaagaagattggcaagctgacagagctgcaccagcagaccatccggcaggccgagaaccggctgagcaagctgaaccaggccgccagccacctggaggagtacaatgagatgctggagctgatcctgaagtggattgagaaggccaaggtgctggcccacggcaccatcgcctggaacagcgccagccagctgcgggagcagtacatcctgcaccagaccctgctggaggagagcaaggagattgattctgagctggaggccatgacagagaagctgcagtacctgacctctgtgtactgcacagagaagatgagccagcaggtggccgagctgggccgggagacagaggagctgcggcagatgatcaagatccggctgcagaacctgcaggatgctgccaaggacatgaagaagtttgaagctgagctgaagaagctgcaggccgccctggagcaggcccaggccaccctgaccagccctgaggtgggccgcctgagcctgaaggagcagctgagccaccggcagcacctgctgtctgagatggagagcctgaagcccaaggtgcaggccgtgcagctgtgccagagcgccctgcgcatcccagaagatgtggtggccagcctgcccctgtgccacgccgccctgcggctgcaggaggaggccagccggctgcagcacacagccatccagcagtgcaacatcatgcaggccgctgtggtgcagtatgagcagtatgagcaggagatgaagcacctgcagcagctgattgagggcgcccaccgggagattgaggacaagcctgtggccaccagcaacatccaggagctgcaggcccagatcagcagacatgaggagctggcccagaagatcaagggctaccaggagcagatcgccagcctgaacagcaagtgcaagatgctgaccatgaaggccaagcacgccaccatgctgctgactgtgacagaggtggagggcctggccgagggcacagaggacctggatggagagctgctgcccacccccagcgcccaccccagcgtggtgatgatgacagctggccgctgccacaccctgctgagccctgtgacagaggagagcggggaggagggcaccaacagcgagatcagcagccccccagcctgccgcagccccagccctgtggccaacacagatgcctctgtgaaccaggacatcgcctactaccaggccctgtctgctgagcggctgcagacagatgctgccaagatccaccccagcaccagcgccagccaggagttctatgagcccggcctggagcccagcgccacagccaagctgggggacctgcagaggtcctgggagaccctgaagaatgtcatcagcgagaagcagaggaccctgtatgaggccctggagcggcagcagaagtaccaggacagcctgcagagcatcagcaccaagatggaggccatcgagctgaagctgtctgagagccctgagcccggccgcagccctgagagccagatggccgagcaccaggccctgatggatgagatcctgatgctgcaggatgagatcaatgagctgcagagcagcctggccgaggagctggtgtctgagagctgtgaggccgaccctgctgagcagctggccctgcagagcaccctgactgtgctggccgagaggatgagcaccatccgcatgaaggccagcggcaagaggcagctgctggaggagaagctgaatgaccagctggaggagcagaggcaggagcaggccctgcagcgctaccgctgtgaggctgatgagctggacagctggctgctgagcaccaaggccaccctggacacagccctgagcccccccaaggagcccatggacatggaggcccagctgatggactgccagaacatgctggtggagattgagcagaaggtggtggccctgtctgagctgtctgtgcacaatgaaaacctgctgctggagggcaaggcccacaccaaggatgaggccgagcagctggccggcaagctgcggcggctgaagggcagcctgctggagctgcagagggccctgcatgacaagcagctgaacatgcagggcacagcccaggagaaggaggagagtgatgtggacctgacagccacccagagccctggggtgcaggagtggctggcccaggcccggaccacctggacccagcagaggcagagcagcctgcagcagcagaaggagctggagcaggagctggccgagcagaagagcctgctgcggtctgtggccagcagaggagaggagatcctgatccagcacagcgctgctgagaccagcggagatgctggggagaagccagatgtgctgagccaggagctgggcatggagggggagaagagcagcgctgaggaccagatgaggatgaagtgggagagcctgcaccaggagttcagcaccaagcagaagctgctgcagaatgtgctggagcaggagcaggagcaggtgctgtacagccggcccaaccggctgctgagcggcgtgcccctgtacaagggagatgtgcccacccaggacaagtctgctgtgaccagcctgctggatggcctgaaccaggcctttgaggaggtgagcagccagagcggcggggccaagaggcagagcatccacctggagcagaagctgtatgatggagtgtctgccaccagcacctggctggatgatgtggaggagcggctgtttgtggccacagccctgctgcctgaggagacagagacctgcctcttcaaccaggagatcctggccaaggacatcaaggagatgtctgaggagatggacaagaacaagaacctcttcagccaggccttcccagaaaatggagacaacagagatgtgattgaggacaccctgggctgcctgctgggccgcctgagcctgctggacagcgtggtgaaccagcgctgccaccagatgaaggagcggctgcagcagatcctgaacttccagaatgacctgaaggtgctcttcaccagcctggccgacaacaagtacatcatcctgcagaagctggccaacgtgtttgagcagcctgtggccgagcagatcgaggccatccagcaggccgaggatggcctgaaggagtttgatgctggcatcatcgagctgaagagaagaggagacaagctgcaggtggagcagcccagcatgcaggagctgagcaagctgcaggacatgtatgatgagctgatgatgatcatcggcagcagaagaagtggcctgaaccagaacctgaccctgaagagccagtatgagcgggccctgcaggacctggccgacctgctggagaccggccaggagaagatggccggggaccagaagatcatcgtgagcagcaaggaggagatccagcagctgctggacaagcacaaggagtacttccagggcctggagagccacatgatcctgacagagaccctcttcaggaagatcatcagctttgctgtgcagaaggagacccagttccacacagagctgatggcccaggccagcgctgtgctgaagagggcccacaagaggggcgtggagctggagtacatcctggagacctggagccacctggatgaggaccagcaggagctgagccggcagctggaggtggtggagagcagcatccccagcgtgggcctggtggaggagaatgaagatcggctgattgaccgcatcaccctgtaccagcacctgaagagcagcctgaatgagtaccagcccaagctgtaccaggtgctggatgatggcaagaggctgctgatcagcatcagctgcagcgacctggagagccagctgaaccagctgggggagtgctggctgagcaacaccaacaagatgagcaaggagctgcaccggctggagaccatcctgaagcactggacccgctaccagagcgagagcgctgacctgatccactggctgcagagcgccaaggaccggctggagttctggacccagcagagcgtgacagtgccccaggagctggagatggtgcgggaccacctgaatgccttcctggagttcagcaaggaggtggatgcccagagcagcctgaagagctctgtgctgagcacaggcaaccagctgctgcggctgaagaaggtggacacagccaccctgcggtctgagctgagcagaattgacagccagtggacagacctgctgaccaacatcccagctgtgcaggagaagctgcaccagctgcagatggacaagctgcccagcagacatgccatcagcgaggtgatgtcctggatcagcctgatggagaatgtcatccagaaggatgaggacaacatcaagaacagcatcggctacaaggccatccacgagtacctgcagaagtacaagggcttcaagattgacatcaactgcaagcagctgactgtggactttgtgaaccagagcgtgctgcagatcagcagccaggatgtggagagcaagagaagtgacaagacagactttgctgagcagctgggcgccatgaacaagtcctggcagatcctgcagggcctggtgacagagaagatccagctgctggagggcctgctggagagctggagcgaatatgagaacaacgtgcagtgcctgaagacctggtttgagacccaggagaagaggctgaagcagcagcacagaattggagaccaggcctctgtgcagaatgccctgaaggactgccaggacctggaggacctgatcaaggccaaggagaaggaggtggagaagattgagcagaatggcctggccctgatccagaacaagaaggaggatgtgagcagcatcgtgatgagcaccctgcgggagctgggccagacctgggccaacctggaccacatggtgggccagctgaagatcctgctgaagtctgtgctggaccagtggagcagccacaaggtggcctttgacaagatcaacagctacctgatggaggcccgctacagcctgagccgcttccggctgctgaccggcagcctggaggccgtgcaggtgcaggtggacaacctgcagaacctgcaggatgacctggagaagcaggagaggagcctgcagaagtttggcagcatcaccaaccagctgctgaaggagtgccacccccctgtgacagagaccctgaccaacaccctgaaggaggtgaacatgcgctggaacaacctgctggaggagattgctgagcagctgcagagcagcaaggccctgctgcagctgtggcagcgctacaaggactacagcaagcagtgtgccagcacagtgcagcagcaggaggacaggaccaatgagctgctgaaggccgccaccaacaaggacattgctgatgatgaggtggccacctggatccaggactgcaatgacctgctgaagggcctgggcaccgtgaaggacagcctcttcttcctgcacgagctgggggagcagctgaagcagcaggtggatgccagcgctgccagcgccatccagagcgaccagctgagcctgagccagcacctgtgtgccctggagcaggccctgtgcaagcagcagaccagcctgcaggccggcgtgctggactatgagacctttgccaagagcctggaggccctggaggcctggatcgtggaggccgaggagatcctgcagggccaggaccccagccacagcagtgacctgagcaccatccaggagaggatggaggagctgaagggccagatgctgaagttcagctccatggccccagacctggaccggctgaatgagctgggctaccgcctgcccctgaatgacaaggagatcaagaggatgcagaacctgaacagacactggagcctcatcagcagccagaccacagagcgcttcagcaagctgcagagcttcctgctgcagcaccagaccttcctggagaagtgtgagacctggatggagttcctggtgcagacagagcagaagctggccgtggagatcagcggcaactaccagcacctgctggagcagcagagggcccacgagctgttccaggccgagatgttcagccggcagcagatcctgcacagcatcatcattgatggccagaggctgctggagcagggccaggtggatgacagagatgagttcaacctgaagctgaccctgctgagcaaccagtggcagggcgtcatcagaagagcccagcagaggcggggcatcatcgacagccagatccggcagtggcagcgctaccgggagatggccgagaagctgaggaagtggctggtggaggtgtcctacctgcccatgagcggcctgggctctgtgcccatccccctgcagcaggcccggaccctgtttgatgaggtgcagttcaaggagaaggtgttcctgcggcagcagggcagctacatcctgactgtggaggccggcaagcagctgctgctgtctgctgacagcggggctgaggccgccctgcaggccgagctggccgagatccaggagaagtggaagagcgcctccatgaggctggaggagcagaagaagaagctggccttcctgctgaaggactgggagaagtgtgagaagggcattgctgacagcctggagaagctgcggaccttcaagaagaagctgagccagagcctgcctgaccaccacgaggagctgcatgctgagcagatgcgctgcaaggagctggagaatgctgtgggctcctggacagatgacctgacccagctgagcctgctgaaggacaccctgagcgcctacatctctgcagatgacatcagcatcctgaatgaaagagtggagctgctgcagaggcagtgggaggagctgtgccaccagctgagcctgcggcggcagcagattggagagcggctgaatgagtgggccgtgttcagcgagaagaacaaggagctgtgtgagtggctgacccagatggagagcaaggtgtcccagaatggagacatcctgattgaggagatgattgagaagctgaagaaggactaccaggaggagatcgccatcgcccaggagaacaagatccagctgcagcagatgggagagcggctggccaaggccagccatgagagcaaggccagcgagattgagtacaagctgggcaaggtgaatgaccgctggcagcacctgctggacctgattgctgcccgggtgaagaagctgaaggagaccctggtggccgtgcagcagctggacaagaacatgagcagcctgcggacctggctggcccacatcgagagcgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagcggggtcatctacacagtggccaaggaggagctgaagaagtttgaggccttccagaggcaggtgcatgaatgtctgacccagctggagctgatcaacaagcagtaccgccgcctggccagagaaaatagaacagacagcgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171271 - DNA, 2934 bp, Artificial Sequence
  Description of Artificial Sequence: Synthetic coding sequence
atggtggtggccgaggacctgagcgccctgaggatggccgaggacagctgtgtggatgctgacctgcctgactgcaactgtgatgtgacccggcagagggtgaagaagctgaaggagaccctggtggccgtgcagcagctggacaagaacatgagcagcctgcggacctggctggcccacattgaaagtgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagtggagtcatctacacagtggccaaggaggagctgaagaagtttgaggccttccagaggcaggtgcatgagtgcctgacccagctggagctgatcaacaagcagtacagaaggctggcccgggagaacagaacagattctgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagtgatgtgatgatccctgagagccctgaggcctacgtgaagctgacagaaaatgccatcaagaacaccagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171272 - DNA, 26394 bp, Artificial Sequence
  Description of Artificial Sequence: Synthetic coding sequence
atggccaccagcagaggagccagccgctgcccccgggacatcgccaacgtgatgcagaggctgcaggatgagcaggagatcgtgcagaagaggaccttcaccaagtggatcaacagccacctggccaagaggaagccacccatggtggtggatgacctgtttgaggacatgaaggatggagtgaagctgctggccctgctggaggtgctgagcggccagaagctgccctgtgagcagggccgcaggatgaagagaattcatgctgtggccaacatcggcacagccctgaagttcctggagggcaggaagatcaagctggtgaacatcaacagcacagacattgctgatggccggcccagcatcgtgctgggcctgatgtggaccatcatcctgtacttccagatcgaggagctgaccagcaacctgccccagctgcagagcctgagcagcagcgccagctctgtggacagcatcgtgtcctctgagacccccagcccccccagcaagaggaaggtgaccaccaagatccagggcaatgccaagaaggccctgctgaagtgggtgcagtacacagctgggaagcagacaggcatcgaggtgaaggactttgggaagtcctggaggtctggagtggccttccacagcgtcatccacgccatccggcctgagctggtggacctggagaccgtgaagggccgcagcaaccgggagaacctggaggatgccttcaccatcgccgagacagagctgggcatcccccggctgctggaccctgaagatgtggatgtggacaagccagatgagaagagcatcatgacctacgtggcccagttcctgaagcactacccagacatccacaatgccagcacagatggccaggaggatgatgagatcctgcccggcttccccagctttgccaacagcgtgcagaacttcaagagagaagatagagtcatcttcaaggagatgaaggtgtggattgagcagtttgagcgggacctgacccgggcccagatggtggagagcaacctgcaggacaagtaccagagcttcaagcacttccgggtgcagtatgagatgaagaggaagcagatcgagcacctgatccagcccctgcacagagatggcaagctgagcctggaccaggccctggtgaagcagagctgggacagagtgaccagccggctgtttgactggcacatccagctggacaagagcctgcctgcccccctgggcaccatcggggcctggctgtacagagctgaggtggccctgcgggaggagatcaccgtgcagcaggtgcatgaggagacagccaacaccatccagaggaagctggagcagcacaaggacctgctgcagaacacagatgcccacaagagggccttccacgagatctaccgcaccaggtctgtgaatggcatccctgtgcccccagaccagctggaggacatggccgagcgcttccactttgtgagcagcaccagcgagctgcacctgatgaagatggagttcctggagctgaagtaccgcctgctgagcctgctggtgctggccgagagcaagctgaagtcctggatcatcaagtatggccggcgggagagcgtggagcagctgctgcagaactacgtgtccttcatcgagaacagcaagttctttgagcagtatgaggtgacctaccagatcctgaagcagacagctgagatgtatgtgaaggcagatggctctgtggaggaggctgaaaatgtgatgaagttcatgaatgagaccacagcccagtggaggaacctgtctgtggaggtgcgctctgtgcgctccatgctggaggaggtgatcagcaactgggacagatatggcaacacagtggccagcctgcaggcctggctggaggatgctgagaagatgctgaaccagagtgaaaatgccaagaaggacttcttcaggaacctgccccactggatccagcagcacacagccatgaatgatgctggcaacttcctgattgagacctgtgatgagatggtgtcccgggacctgaagcagcagctgctgctgctgaatggccgctggagggagctgttcatggaggtgaagcagtatgcccaggctgatgagatggacaggatgaagaaggagtacacagactgtgtggtgaccctgagcgcctttgccacagaggcccacaagaagctgtctgagcccctggaggtgtccttcatgaatgtgaagctgctgatccaggacctggaggacatcgagcagagggtgcctgtgatggatgcccagtacaagatcatcaccaagacagcccacctgatcaccaaggagagcccccaggaggagggcaaggagatgtttgccaccatgagcaagctgaaggagcagctgaccaaggtgaaggagtgctacagccccctgctgtatgagagccagcagctgctgatccccctggaggagctggagaagcagatgaccagcttctatgacagcctgggcaagatcaatgagatcatcaccgtgctggagcgggaggcccagagcagcgccctcttcaagcagaagcaccaggagctgctggcctgccaggagaactgcaagaagaccctgaccctcatcgagaagggcagccagagcgtgcagaagtttgtgaccctgagcaatgtgctgaagcactttgaccagacccggctgcagaggcagattgctgacatccacgtggccttccagagcatggtgaagaagacaggagactggaagaagcacgtggagaccaacagccggctgatgaagaagtttgaggagagcagagctgagctggagaaggtgctgagaattgcccaggagggcctggaggagaagggggaccctgaggagctgctgcggcggcacacagagttcttcagccagctggaccagagggtgctgaatgccttcctgaaggcctgtgatgagctgacagacatcctgcctgagcaggagcagcagggcctgcaggaggccgtgaggaagctgcacaagcagtggaaggacctgcagggcgaggccccctaccacctgctgcacctgaagattgatgtggagaagaaccgcttcctggcctctgtggaggagtgcaggacagagctggaccgggagaccaagctgatgccccaggagggcagcgagaagatcatcaaggagcacagggtcttcttcagtgacaagggcccccaccacctgtgtgagaagaggctgcagctgattgaggagctgtgtgtgaagctgcctgtgcgggaccctgtgcgggacaccccaggcacctgccacgtgaccctgaaggagctgcgggccgccatcgacagcacctacaggaagctgatggaggaccctgacaagtggaaggactacaccagccgcttcagcgagttcagctcctggatcagcaccaatgagacccagctgaagggcatcaagggggaggccatcgacacagccaaccacggggaggtgaagagagctgtggaggagatcagaaatggagtgaccaagagaggagagaccctgtcctggctgaagagccggctgaaggtgctgacagaggtgtccagtgaaaatgaggcccagaagcagggagatgagctggccaagctgagcagcagcttcaaggccctggtgaccctgctgtctgaggtggagaagatgctgagcaactttggagactgtgtgcagtacaaggagatcgtgaagaacagcctggaggagctgatcagcggcagcaaggaggtgcaggagcaggccgagaagatcctggacacagagaacctgtttgaggcccagcagctgctgctgcaccaccagcagaagaccaagaggatcagcgccaagaagagagatgtgcagcagcagatcgcccaggcccagcagggcgagggcggcctgcctgaccggggccacgaggagctgaggaagctggagagcaccctggatggcctggagaggagccgggagcggcaggagcggcgcatccaggtgaccctgaggaagtgggagagatttgagaccaacaaggagaccgtggtgcgctacctgttccagacaggcagcagccatgagcgcttcctgtccttcagcagcctggagagcctgagcagcgagctggagcagaccaaggagttcagcaagaggacagagagcattgctgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaactttgagaccctgtctgtgtggatcacagagaaggagaaggagctgaatgccctggagaccagcagcagcgccatggacatgcagatcagccagatcaaggtgaccatccaggagattgagagcaagctgagcagcatcgtgggcctggaggaggaggcccagagctttgcccagtttgtgaccaccggggagagcgcccgcatcaaggccaagctgacccagatccgccgctacggggaggagctgcgggagcacgcccagtgcctggagggcaccatcctgggccacctgagccagcagcagaagtttgaggagaacctgaggaagatccagcagagcgtgtctgaatttgaggacaagctggccgtgcccatcaagatctgcagcagcgccacagagacctacaaggtgctgcaggagcacatggacctgtgccaggccctggagagcctgagcagcgccatcacagccttcagcgccagcgccaggaaggtggtgaacagagacagctgtgtgcaggaggccgccgccctgcagcagcagtatgaggacatcctgcggcgggccaaggagcggcagacagccctggagaacctgctggcccactggcagaggctggagaaggagctgagcagcttcctgacctggctggagcggggggaggccaaggccagcagccctgagatggacatctctgctgacagagtgaaggtggagggggagctgcagctgatccaggccctgcagaatgaggtggtgtcccaggccagcttctacagcaagctgctgcagctgaaggagagcctcttctctgtggccagcaaggatgatgtgaagatgatgaagctgcacctggagcagctggatgagcgctggagggacctgccccagatcatcaacaagaggatcaacttcctgcagagcgtggtggccgagcaccagcagtttgatgagctgctgctgtccttctctgtgtggatcaagctgttcctgtctgagctgcagaccaccagcgagatcagcatcatggaccaccaggtggccctgaccaggcacaaggaccacgccgctgaggtggagagcaagaagggggagctgcagagcctgcagggccacctggccaagctgggcagcctgggccgggcagaggacctgcacctgctgcagggcaaggccgaggactgcttccagctgtttgaggaggccagccaggtggtggagcggcggcagctggccctgagccacctggccgagttcctgcagagccacgccagcctgagcggcatcctgcggcagctgcggcagacagtggaggccaccaacagcatgaacaagaatgaaagtgacctgattgagaaggacctgaatgatgccctgcagaatgccaaggccctggagagcgctgctgtgtccctggatggcatcctgagcaaggcccagtaccacctgaagattggcagcagcgagcagaggaccagctgccgggccacagctgaccagctgtgtggggaggtggagcgcatccagaacctgctgggcaccaagcagagcgaggctgatgccctggccgtgctgaagaaggccttccaggaccagaaggaggagctgctgaagagcattgaagatattgaggagaggacagacaaggagcggctgaaggagcccacccggcaggccctgcagcagaggctgcgggtcttcaaccagctggaggatgagctgaacagccatgaacatgagctgtgctggctgaaggacaaggccaagcagatcgcccagaaggatgtggcctttgcccctgaggtggaccgggagatcaaccggctggaggtgacctgggatgacaccaagaggctcatccacgagaaccagggccagtgctgcggcctgattgacctgatgagggagtaccagaacctgaagtctgctgtgtccaaggtgctggagaatgccagctctgtgattgtgaccaggaccaccatcaaggaccaggaggacctgaagtgggccttcagcaagcatgaaacagccaagaacaagatgaactacaagcagaaggacctggacaacttcaccagcaagggcaagcacctgctgtctgagctgaagaagatccacagcagtgacttcagcctggtgaagacagacatggagagcacagtggacaagtggctggatgtgtctgagaagctggaggagaacatggaccggctgcgggtgtccctgagcatctgggatgatgtgctgagcaccagagatgaaattgagggctggagcaacaactgtgtgccccagatggccgagaacatcagcaacctggacaaccacctgcgggcagaggagctgctgaaggagtttgagagcgaggtgaagaacaaggccctgcggctggaggagctgcacagcaaggtgaatgacctgaaggagctgaccaagaacctggagaccccaccagacctgcagttcattgaagctgacctgatgcagaagctggagcacgccaaggagatcacagaggtggccaagggcaccctgaaggacttcaccgcccagagcacccaggtggagaagttcatcaatgacatcaccacctggttcaccaaggtggaggagagcctgatgaactgtgcccagaatgagacctgtgaggccctgaagaaggtgaaggacatccagaaggagctgcagagccagcagagcaacatcagcagcacccaggagaacctgaacagcctgtgcaggaagtaccacagcgctgagctggagagcctgggccgggccatgacaggcctcatcaagaagcatgaagctgtgtcccagctgtgcagcaagacccaggccagcctgcaggagagcctggagaagcacttcagcgagagcatgcaggagttccaggagtggttcctgggcgccaaggccgccgccaaggagagcagtgacagaactggagacagcaaggtgctggaggccaagctgcatgacctgcagaacatcctggacagcgtgtctgatggccagagcaagctggatgctgtgacccaggagggccagaccctgtatgcccacctgagcaagcagatcgtgagcagcatccaggagcagatcaccaaggccaatgaggagttccaggccttcctgaagcagtgcctgaaggacaagcaggccctgcaggactgtgccagcgagctgggcagctttgaggaccagcacaggaagctgaacctgtggatccacgagatggaggagcgcttcaacacagagaacctgggggagagcaagcagcacatccctgagaagaagaatgaggtgcacaaggtggagatgttcctgggggagctgctggccgcccgggagagcctggacaagctgagccagaggggccagctgctgtctgaggagggccatggagctggccaggagggccgcctgtgcagccagctgctgaccagccaccagaacctgctgaggatgaccaaggagaagctgcggagctgccaggtggccctgcaggagcacgaggccctggaggaggccctgcagagcatgtggttctgggtgaaggccatccaggaccggctggcctgtgccgagagcaccctgggcagcaaggacaccctggagaagaggctgagccagatccaggacatcctgctgatgaagggggagggggaggtgaagctgaacatggccatcggcaaaggagagcaggccctgcggagcagcaacaaggagggccagagggtcatccagacccagctggagaccctgaaggaggtgtgggccgacatcatgagcagctctgtgcacgcccagagcaccctggagagcgtcatcagccagtggaatgactatgtggagaggaagaaccagctggagcagtggatggagagcgtggaccagaagattgagcaccccctgcagccccagcccggcctgaaggagaagtttgtgctgctggaccacctgcagagcatcctgtctgaggccgaggaccacacccgggccctgcacaggctcatcgccaagagccgggagctgtatgagaagacagaagatgagagcttcaaggacacagcccaggaggagctgaagacccagttcaatgacatcatgacagtggccaaggagaagatgaggaaggtggaggagatcgtgaaggaccacctgatgtacctggatgctgtgcatgagttcacagactggctgcacagcgccaaggaggagctgcaccgctggagcgacatgtctggggacagcagcgccacccagaagaagctgagcaagatcaaggagctgattgacagccgggagatcggggccagccggctgagccgggtggagagcctggcccctgaggtgaagcagaacaccacagccagcggctgtgagctgatgcacacagagatgcaggccctgcgggctgactggaagcagtgggaggacagcgtcttccagacccagagctgcctggagaacctggtgtcccagatggccctgtctgagcaggagttcagcggccaggtggcccagctggagcaggccctggagcagttcagcgccctgctgaagacctgggcccagcagctgaccctgctggagggcaagaacacagatgaggagatcgtggagtgctggcacaagggccaggagatcctggatgccctgcagaaggccgagcccaggacagaggacctgaagagccagctgaatgagctgtgccgcttcagccgggacctgagcacctacagcggcaaggtgtctggcctcatcaaggagtacaactgcctgtgcctgcaggccagcaagggctgccagaacaaggagcagatcctgcagcagcgcttcaggaaggccttccgggacttccagcagtggctggtgaatgccaagatcaccacagccaagtgctttgacatcccccagaacatcagcgaggtgtccaccagcctgcagaagatccaggagttcctgtctgagagtgaaaatggccagcacaagctgaacatgatgctgagcaaaggagagctgctgagcaccctgctgaccaaggagaaggccaagggcatccaggccaaggtgacagctgccaaggaggactggaagaacttccacagcaacctgcaccagaaggagagcgccctggagaacctgaagatccagatgaaggactttgaggtgtctgctgagcccatccaggactggctgagcaagacagagaagatggtgcatgagagcagcaaccggctgtatgacctgcctgccaagaggcgggagcagcagaagctgcagagcgtgctggaggagatccactgctatgagccccagctgaaccggctgaaggagaaggcccagcagctgtgggagggccaggccgccagcaagagcttccgccaccgggtgtcccagctgagcagccagtacctggccctgagcaacctgaccaaggagaaggtgtcccggctggaccgcatcgtggccgagcacaaccagttcagcctgggcatcaaggagctgcaggactggatgacagatgccatccacatgctggacagctactgccaccccaccagtgacaagtctgtgctggacagcaggaccctgaagctggaggccctgctgtctgtgaagcaggagaaggagatccagatgaagatgattgtgaccagaggagagagcgtgctgcagaacaccagccctgagggcatccccaccatccagcagcagctgcagagcgtgaaggacatgtgggccagcctgctgtctgctggcatccgctgcaagagccagctggagggcgccctgagcaagtggaccagctaccaggatggagtgcggcagttcagcggctggatggacagcatggaggccaacctgaatgaaagtgagcggcagcacgccgagctgcgggacaagaccaccatgctgggcaaggccaagctgctgaatgaggaggtgctgagctacagcagcctgctggagaccatcgaggtgaagggggccggcatgacagagcactacgtgacccagctggagctgcaggacctgcaggagcgctaccgggccatccaggagcgggccaaggaggccgtgaccaagtctgagaagctggtgcggctgcaccaggagtaccagagggacctgaaggcctttgaggtgtggctgggccaggagcaggagaagctggaccagtacagcgtgctggagggagatgcccacacccatgagaccaccctgcgggacctgcaggagctgcaggtgcactgtgccgagggccaggccctgctgaacagcgtgctgcacaccagagaagatgtgatccccagcggcatcccccaggccgaggaccgggccctggagagcctgcggcaggactggcaggcctaccagcaccggctgtctgagaccaggacccagttcaacaacgtggtgaacaagctgcggctgatggagcagaagttccagcaggtggatgagtggctgaagacagctgaggagaaggtgagccccaggacccggcggcagagcaacagagccaccaaggagatccagctgcaccagatgaagaagtggcatgaggaggtgacagcctacagagatgaggtggaggaggtgggcgcccgggcccaggagatcctggatgagagccacgtgaacagcaggatgggctgccaggccacccagctgaccagccgctaccaggccctgctgctgcaggtgctggagcagatcaagttcctggaggaggagatccagagcctggaggagagcgagagcagcctgagcagctacagcgactggtacggcagcacccacaagaacttcaagaatgtggccaccaagattgacaaggtggacacagtgatgatgggcaagaagctgaagaccctggaggtgctgctgaaggacatggagaagggccacagcctgctgaagagcgcccgggagaagggggagagagctgtgaagtacctggaggagggggaggccgagcggctgaggaaggagatccatgaccacatggagcagctgaaggagctgaccagcacagtgaggaaggagcacatgaccctggagaagggcctgcacctggccaaggagttcagtgacaagtgcaaggccctgacccagtggattgctgagtaccaggagatcctgcacgtgcctgaggagcccaagatggagctgtatgagaagaaggcccagctgagcaagtacaagagcctgcagcagacagtgctgagccatgagcccagcgtgaagtctgtgcgggagaagggggaggccctgctggagctggtgcaggatgtgaccctgaaggacaagattgaccagctgcagagcgactaccaggacctgtgcagcatcggcaaggagcacgtgttcagcctggaggccaaggtgaaggaccacgaggactacaacagcgagctgcaggaggtggagaagtggctgctgcagatgagcggccgcctggtggccccagacctgctggagaccagcagcctggagaccatcacccagcagctggcccaccacaaggccatgatggaggagattgctggctttgaagatcggctgaacaacctgcagatgaagggggacaccctgattggccagtgtgccgaccacctgcaggccaagctgaagcagaatgtgcacgcccacctgcagggcaccaaggacagctacagcgccatctgcagcacagcccagaggatgtaccagagcctggagcacgagctgcagaagcacgtgtcccggcaggacaccctgcagcagtgccaggcctggctgtctgctgtgcagcctgacctggagcccagcccccagccccccctgagcagagctgaggccatcaagcaggtgaagcacttccgggccctgcaggagcaggcccggacctacctggacctgctgtgcagcatgtgtgacctgagcaatgcctctgtgaagaccacagccaaggacatccagcagacagagcagaccatcgagcagaagctggtgcaggcccagaacctgacccagggctgggaggagatcaagcacctgaagtctgagctgtggatctacctgcaggatgctgaccagcagctgcagaacatgaagaggaggcacagcgagctggagctgaacatcgcccagaacatggtgtcccaggtgaaggactttgtgaagaagctgcagagcaagcaggcctctgtgaacaccatcatcgagaaggtgaacaagctgaccaagaaggaggagagccctgagcacaaggagatcaaccacctgaatgaccagtggctggacctgtgccggcagagcaacaacctgtgcctgcagcgggaggaggacctgcagaggacccgggactaccatgactgcatgaatgtggtggaggtgttcctggagaagttcaccacagagtgggacaacctggcccggagtgatgctgagagcacagctgtgcacctggaggccctgaagaagctggccctggccctgcaggagaggaaatatgccatcgaggacctgaaggaccagaagcagaagatgattgagcacctgaacctggatgacaaggagctggtgaaggagcagaccagccacctggagcagcgctggttccagctggaggacctgatcaagaggaagatccaggtgtctgtgaccaacctggaggagctgaatgtggtgcagagccgcttccaggagctgatggagtgggccgaggagcagcagcccaacattgctgaggccctgaagcagagccccccaccagacatggcccagaacctgctgatggaccacctggccatctgcagcgagctggaggccaagcagatgctgctgaagagcctcatcaaggatgctgacagagtgatggctgacctgggcctgaatgaaaggcaggtgatccagaaggccctgagtgatgcccagagccacgtgaactgcctgagtgacctggtgggccagaggaggaagtacctgaacaaggccctgtctgagaagacccagttcctgatggctgtgttccaggccaccagccagatccagcagcacgagaggaagatcatgttccgggagcacatctgcctgctgcctgatgatgtgtccaagcaggtgaagacctgcaagagcgcccaggccagcctgaagacctaccagaatgaggtgacaggcctgtgggcccagggccgggagctgatgaaggaggtgacagagcaggagaagtctgaggtgctgggcaagctgcaggagctgcagagcgtgtatgattctgtgctgcagaagtgcagccaccggctgcaggagctggagaagaacctggtgtccaggaagcacttcaaggaggactttgacaaggcctgccactggctgaagcaggccgacatcgtgaccttccctgagatcaacctgatgaatgaaagcagcgagctgcacacccagctggccaagtaccagaacatcctggagcagagcccagaatatgagaacctgctgctgaccctgcagaggacaggccagaccatcctgcccagcctgaatgaggtggaccacagctacctgtctgagaagctgaatgccctgccccggcagttcaacgtgattgtggccctggccaaggacaagttctacaaggtgcaggaggccatcctggccaggaaggagtatgccagcctcatcgagctgaccacccagagcctgtctgagctggaggcccagttcctgaggatgagcaaggtgcccacagacctggccgtggaggaggccctgagcctgcaggacggctgccgggccatcctggatgaggtggccggcctgggggaggccgtggatgagctgaaccagaagaaggagggcttccgcagcacaggccagccctggcagcctgacaagatgctgcacctggtgaccctgtaccaccggctgaagaggcagacagagcagagggtgtccctgctggaggacaccaccagcgcctaccaggagcacgagaagatgtgccagcagctggagcggcagctgaagtctgtgaaggaggagcagagcaaggtgaatgaggagaccctgcctgctgaggagaagctgaagatgtaccacagcctggccggcagcctgcaggacagcggcatcgtgctgaagagggtgaccatccacctggaggacctggccccccacctggaccccctggcctatgagaaggcccggcaccagatccagagctggcagggcgagctgaagctgctgaccagcgccatcggggagaccgtgacagaatgtgagagcaggatggtgcagagcattgacttccagacagagatgagccgcagcctggactggctgcggcgggtgaaggccgagctgagcggccctgtgtacctggacctgaacctgcaggacatccaggaggagatcaggaagatccagatccaccaggaggaggtgcagagcagcctgcgcatcatgaatgccctgagccacaaggagaaggagaagttcaccaaggccaaggagctgatctctgctgacctggagcacagcctggccgagctgtctgagctggatggagacatccaggaggccctgcggacccggcaggccaccctgacagagatctacagccagtgccagcgctactaccaggtgttccaggccgccaatgactggctggaggatgcccaggagctgctgcagctggccggaaatggcctggatgtggagagcgctgaggagaacctgaagagccacatggagttcttcagcacagaggaccagttccacagcaacctggaggagctgcacagcctggtggccaccctggaccccctcatcaagcccaccgggaaggaggacctggagcagaaggtggccagcctggagctgcggagccagaggatgagccgggacagcggggcccaggtggacctgctgcagcgctgcacagcccagtggcatgactaccagaaggcccgggaggaggtgattgagctgatgaatgacacagagaagaagctgtctgagttcagcctgctgaagaccagcagcagccatgaggccgaggagaagctgtctgagcacaaggccctggtgtctgtggtgaacagcttccacgagaagatcgtggccctggaggagaaggccagccagctggagaagacaggaaatgatgccagcaaggccaccctgagccgctccatgaccaccgtgtggcagcgctggacccggctgcgggctgtggcccaggaccaggagaagatcctggaggatgctgtggatgagtggacaggcttcaacaacaaggtgaagaaggccacagagatgattgaccagctgcaggacaagctgcccggcagcagcgctgagaaggccagcaaggccgagctgctgaccctgctggagtaccatgacacctttgtgctggagctggagcagcagcagagcgccctgggcatgctgcggcagcagaccctgtccatgctgcaggatggagctgcccccaccccaggagaggagccccccctgatgcaggagatcacagccatgcaggaccgctgcctgaacatgcaggagaaggtgaagaccaacgggaagctggtgaagcaggagctgaaggaccgggagatggtggagacccagatcaacagcgtgaagtgctgggtgcaggagaccaaggagtacctgggcaaccccaccattgaaattgatgcccagctggaggagctgcagatcctgctgacagaggccaccaaccaccggcagaacatcgagaagatggccgaggagcagaaggagaagtacctgggcctgtacaccatcctgcccagcgagctgagcctgcagctggccgaggtggccctggacctgaagatccgggaccagatccaggacaagatcaaggaggtggagcagagcaaggccaccagccaggagctgagccggcagatccagaagctggccaaggacctgaccaccatcctgaccaagctgaaggccaagacagacaacgtggtgcaggccaagacagaccagaaggtgctgggggaggagctggatggctgcaacagcaagctgatggagctggatgctgctgtgcagaagttcctggagcagaatggccagctgggcaagcccctggccaagaagattggcaagctgacagagctgcaccagcagaccatccggcaggccgagaaccggctgagcaagctgaaccaggccgccagccacctggaggagtacaatgagatgctggagctgatcctgaagtggattgagaaggccaaggtgctggcccacggcaccatcgcctggaacagcgccagccagctgcgggagcagtacatcctgcaccagaccctgctggaggagagcaaggagattgattctgagctggaggccatgacagagaagctgcagtacctgacctctgtgtactgcacagagaagatgagccagcaggtggccgagctgggccgggagacagaggagctgcggcagatgatcaagatccggctgcagaacctgcaggatgctgccaaggacatgaagaagtttgaagctgagctgaagaagctgcaggccgccctggagcaggcccaggccaccctgaccagccctgaggtgggccgcctgagcctgaaggagcagctgagccaccggcagcacctgctgtctgagatggagagcctgaagcccaaggtgcaggccgtgcagctgtgccagagcgccctgcgcatcccagaagatgtggtggccagcctgcccctgtgccacgccgccctgcggctgcaggaggaggccagccggctgcagcacacagccatccagcagtgcaacatcatgcaggaggccgtggtgcagtatgagcagtatgagcaggagatgaagcacctgcagcagctgattgagggcgcccaccgggagattgaggacaagcctgtggccaccagcaacatccaggagctgcaggcccagatcagcagacatgaggagctggcccagaagatcaagggctaccaggagcagatcgccagcctgaacagcaagtgcaagatgctgaccatgaaggccaagcacgccaccatgctgctgactgtgacagaggtggagggcctggccgagggcacagaggacctggatggagagctgctgcccacccccagcgcccaccccagcgtggtgatgatgacagctggccgctgccacaccctgctgagccctgtgacagaggagagcggggaggagggcaccaacagcgagatcagcagccccccagcctgccgcagccccagccctgtggccaacacagatgcctctgtgaaccaggacatcgcctactaccaggccctgtctgctgagcggctgcagacagatgctgccaagatccaccccagcaccagcgccagccaggagttctatgagcccggcctggagcccagcgccacagccaagctgggggacctgcagaggtcctgggagaccctgaagaatgtcatcagcgagaagcagaggaccctgtatgaggccctggagcggcagcagaagtaccaggacagcctgcagagcatcagcaccaagatggaggccatcgagctgaagctgtctgagagccctgagcccggccgcagccctgagagccagatggccgagcaccaggccctgatggatgagatcctgatgctgcaggatgagatcaatgagctgcagagcagcctggccgaggagctggtgtctgagagctgtgaggccgaccctgctgagcagctggccctgcagagcaccctgactgtgctggccgagaggatgagcaccatccgcatgaaggccagcggcaagaggcagctgctggaggagaagctgaatgaccagctggaggagcagaggcaggagcaggccctgcagcgctaccgctgtgaggctgatgagctggacagctggctgctgagcaccaaggccaccctggacacagccctgagcccccccaaggagcccatggacatggaggcccagctgatggactgccagaacatgctggtggagattgagcagaaggtggtggccctgtctgagctgtctgtgcacaatgaaaacctgctgctggagggcaaggcccacaccaaggatgaggccgagcagctggccggcaagctgcggcggctgaagggcagcctgctggagctgcagagggccctgcatgacaagcagctgaacatgcagggcacagcccaggagaaggaggagagtgatgtggacctgacagccacccagagccctggggtgcaggagtggctggcccaggcccggaccacctggacccagcagaggcagagcagcctgcagcagcagaaggagctggagcaggagctggccgagcagaagagcctgctgcggtctgtggccagcagaggagaggagatcctgatccagcacagcgctgctgagaccagcggagatgctggggagaagccagatgtgctgagccaggagctgggcatggagggggagaagagcagcgctgaggaccagatgaggatgaagtgggagagcctgcaccaggagttcagcaccaagcagaagctgctgcagaatgtgctggagcaggagcaggagcaggtgctgtacagccggcccaaccggctgctgagcggcgtgcccctgtacaagggagatgtgcccacccaggacaagtctgctgtgaccagcctgctggatggcctgaaccaggcctttgaggaggtgagcagccagagcggcggggccaagaggcagagcatccacctggagcagaagctgtatgatggagtgtctgccaccagcacctggctggatgatgtggaggagcggctgtttgtggccacagccctgctgcctgaggagacagagacctgcctcttcaaccaggagatcctggccaaggacatcaaggagatgtctgaggagatggacaagaacaagaacctcttcagccaggccttcccagaaaatggagacaacagagatgtgattgaggacaccctgggctgcctgctgggccgcctgagcctgctggacagcgtggtgaaccagcgctgccaccagatgaaggagcggctgcagcagatcctgaacttccagaatgacctgaaggtgctcttcaccagcctggccgacaacaagtacatcatcctgcagaagctggccaacgtgtttgagcagcctgtggccgagcagatcgaggccatccagcaggccgaggatggcctgaaggagtttgatgctggcatcatcgagctgaagagaagaggagacaagctgcaggtggagcagcccagcatgcaggagctgagcaagctgcaggacatgtatgatgagctgatgatgatcatcggcagcagaagaagtggcctgaaccagaacctgaccctgaagagccagtatgagcgggccctgcaggacctggccgacctgctggagaccggccaggagaagatggccggggaccagaagatcatcgtgagcagcaaggaggagatccagcagctgctggacaagcacaaggagtacttccagggcctggagagccacatgatcctgacagagaccctcttcaggaagatcatcagctttgctgtgcagaaggagacccagttccacacagagctgatggcccaggccagcgctgtgctgaagagggcccacaagaggggcgtggagctggagtacatcctggagacctggagccacctggatgaggaccagcaggagctgagccggcagctggaggtggtggagagcagcatccccagcgtgggcctggtggaggagaatgaagatcggctgattgaccgcatcaccctgtaccagcacctgaagagcagcctgaatgagtaccagcccaagctgtaccaggtgctggatgatggcaagaggctgctgatcagcatcagctgcagcgacctggagagccagctgaaccagctgggggagtgctggctgagcaacaccaacaagatgagcaaggagctgcaccggctggagaccatcctgaagcactggacccgctaccagagcgagagcgctgacctgatccactggctgcagagcgccaaggaccggctggagttctggacccagcagagcgtgacagtgccccaggagctggagatggtgcgggaccacctgaatgccttcctggagttcagcaaggaggtggatgcccagagcagcctgaagagctctgtgctgagcacaggcaaccagctgctgcggctgaagaaggtggacacagccaccctgcggtctgagctgagcagaattgacagccagtggacagacctgctgaccaacatcccagctgtgcaggagaagctgcaccagctgcagatggacaagctgcccagcagacatgccatcagcgaggtgatgtcctggatcagcctgatggagaatgtcatccagaaggatgaggacaacatcaagaacagcatcggctacaaggccatccacgagtacctgcagaagtacaagggcttcaagattgacatcaactgcaagcagctgactgtggactttgtgaaccagagcgtgctgcagatcagcagccaggatgtggagagcaagagaagtgacaagacagactttgctgagcagctgggcgccatgaacaagtcctggcagatcctgcagggcctggtgacagagaagatccagctgctggagggcctgctggagagctggagcgaatatgagaacaacgtgcagtgcctgaagacctggtttgagacccaggagaagaggctgaagcagcagcacagaattggagaccaggcctctgtgcagaatgccctgaaggactgccaggacctggaggacctgatcaaggccaaggagaaggaggtggagaagattgagcagaatggcctggccctgatccagaacaagaaggaggatgtgagcagcatcgtgatgagcaccctgcgggagctgggccagacctgggccaacctggaccacatggtgggccagctgaagatcctgctgaagtctgtgctggaccagtggagcagccacaaggtggcctttgacaagatcaacagctacctgatggaggcccgctacagcctgagccgcttccggctgctgaccggcagcctggaggccgtgcaggtgcaggtggacaacctgcagaacctgcaggatgacctggagaagcaggagaggagcctgcagaagtttggcagcatcaccaaccagctgctgaaggagtgccacccccctgtgacagagaccctgaccaacaccctgaaggaggtgaacatgcgctggaacaacctgctggaggagattgctgagcagctgcagagcagcaaggccctgctgcagctgtggcagcgctacaaggactacagcaagcagtgtgccagcacagtgcagcagcaggaggacaggaccaatgagctgctgaaggccgccaccaacaaggacattgctgatgatgaggtggccacctggatccaggactgcaatgacctgctgaagggcctgggcaccgtgaaggacagcctcttcttcctgcacgagctgggggagcagctgaagcagcaggtggatgccagcgctgccagcgccatccagagcgaccagctgagcctgagccagcacctgtgtgccctggagcaggccctgtgcaagcagcagaccagcctgcaggccggcgtgctggactatgagacctttgccaagagcctggaggccctggaggcctggatcgtggaggccgaggagatcctgcagggccaggaccccagccacagcagtgacctgagcaccatccaggagaggatggaggagctgaagggccagatgctgaagttcagctccatggccccagacctggaccggctgaatgagctgggctaccgcctgcccctgaatgacaaggagatcaagaggatgcagaacctgaacagacactggagcctcatcagcagccagaccacagagcgcttcagcaagctgcagagcttcctgctgcagcaccagaccttcctggagaagtgtgagacctggatggagttcctggtgcagacagagcagaagctggccgtggagatcagcggcaactaccagcacctgctggagcagcagagggcccacgagctgttccaggccgagatgttcagccggcagcagatcctgcacagcatcatcattgatggccagaggctgctggagcagggccaggtggatgacagagatgagttcaacctgaagctgaccctgctgagcaaccagtggcagggcgtcatcagaagagcccagcagaggcggggcatcatcgacagccagatccggcagtggcagcgctaccgggagatggccgagaagctgaggaagtggctggtggaggtgtcctacctgcccatgagcggcctgggctctgtgcccatccccctgcagcaggcccggaccctgtttgatgaggtgcagttcaaggagaaggtgttcctgcggcagcagggcagctacatcctgactgtggaggccggcaagcagctgctgctgtctgctgacagcggggctgaggccgccctgcaggccgagctggccgagatccaggagaagtggaagagcgcctccatgaggctggaggagcagaagaagaagctggccttcctgctgaaggactgggagaagtgtgagaagggcattgctgacagcctggagaagctgcggaccttcaagaagaagctgagccagagcctgcctgaccaccacgaggagctgcatgctgagcagatgcgctgcaaggagctggagaatgctgtgggctcctggacagatgacctgacccagctgagcctgctgaaggacaccctgagcgcctacatctctgcagatgacatcagcatcctgaatgaaagagtggagctgctgcagaggcagtgggaggagctgtgccaccagctgagcctgcggcggcagcagattggagagcggctgaatgagtgggccgtgttcagcgagaagaacaaggagctgtgtgagtggctgacccagatggagagcaaggtgtcccagaatggagacatcctgattgaggagatgattgagaagctgaagaaggactaccaggaggagatcgccatcgcccaggagaacaagatccagctgcagcagatgggagagcggctggccaaggccagccatgagagcaaggccagcgagattgagtacaagctgggcaaggtgaatgaccgctggcagcacctgctggacctgattgctgcccgggtgaagaagctgaaggagaccctggtggccgtgcagcagctggacaagaacatgagcagcctgcggacctggctggcccacatcgagagcgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagcggggtcatctacacagtggccaaggaggagctgaagaagtttgaggccttccagaggcaggtgcatgaatgtctgacccagctggagctgatcaacaagcagtaccgccgcctggccagagaaaatagaacagacagcgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171273 - DNA, 26250 bp, Artificial Sequence
  Description of Artificial Sequence: Synthetic coding sequence
atggccaccagcagaggagccagccgctgcccccgggacatcgccaacgtgatgcagaggctgcaggatgagcaggagatcgtgcagaagaggaccttcaccaagtggatcaacagccacctggccaagaggaagccacccatggtggtggatgacctgtttgaggacatgaaggatggagtgaagctgctggccctgctggaggtgctgagcggccagaagctgccctgtgagcagggccgcaggatgaagagaattcatgctgtggccaacatcggcacagccctgaagttcctggagggcaggaagtccatgcaccggggcagccccatcaagctggtgaacatcaacagcacagacattgctgatggccggcccagcatcgtgctgggcctgatgtggaccatcatcctgtacttccagatcgaggagctgaccagcaacctgccccagctgcagagcctgagcagcagcgccagctctgtggacagcatcgtgagcagcgagacccccagcccccccagcaagaggaaggtgaccaccaagatccagggcaatgccaagaaggccctgctgaagtgggtgcagtacacagctgggaagcagacaggaattgaggtgaaggactttgggaagtcctggaggtctggagtggccttccacagcgtcatccacgccatccggcctgagctggtggacctggagaccgtgaagggccgcagcaaccgggagaacctggaggatgccttcaccatcgccgagacagagctgggcatcccccggctgctggaccctgaagatgtggatgtggacaagccagatgagaagagcatcatgacctacgtggcccagttcctgaagcactacccagacatccacaatgccagcacagatggccaggaggatgatgagatcctgcccggcttccccagctttgccaacagcgtgcagaacttcaagcgggaggacagagtcatcttcaaggagatgaaggtgtggattgagcagtttgagcgggacctgacccgggcccagatggtggagagcaacctgcaggacaagtaccagagcttcaagcacttccgggtgcagtatgagatgaagaggaagcagatcgagcacctgatccagcccctgcacagagatggcaagctgagcctggaccaggccctggtgaagcagagctgggacagagtgaccagccggctgtttgactggcacatccagctggacaagagcctgcctgcccccctgggcaccatcggggcctggctgtacagagctgaggtggccctgcgggaggagatcaccgtgcagcaggtgcatgaggagacagccaacaccatccagaggaagctggagcagcacaaggacctgctgcagaacacagatgcccacaagagggccttccacgagatctaccgcaccaggtctgtgaatggcatccctgtgcccccagaccagctggaggacatggccgagcgcttccactttgtgagcagcaccagcgagctgcacctgatgaagatggagttcctggagctgaagtaccgcctgctgagcctgctggtgctggccgagagcaagctgaagtcctggatcatcaagtatggaagaagagagagcgtggagcagctgctgcagaactacgtgtccttcatcgagaacagcaagttctttgagcagtatgaggtgacctaccagatcctgaagcagacagctgagatgtatgtgaaggcagatggctctgtggaggaggccgagaatgtgatgaagttcatgaatgagaccacagcccagtggaggaacctgtctgtggaggtgcgctctgtgcgctccatgctggaggaggtgatcagcaactgggacagatatggcaacacagtggccagcctgcaggcctggctggaggatgctgagaagatgctgaaccagagtgaaaatgccaagaaggacttcttcaggaacctgccccactggatccagcagcacacagccatgaatgatgctggcaacttcctgattgagacctgtgatgagatggtgtcccgggacctgaagcagcagctgctgctgctgaatggccgctggagggagctgttcatggaggtgaagcagtatgcccaggctgatgagatggacaggatgaagaaggagtacacagactgtgtggtgaccctgagcgcctttgccacagaggcccacaagaagctgtctgagcccctggaggtgtccttcatgaatgtgaagctgctgatccaggacctggaggacatcgagcagagggtgcctgtgatggatgcccagtacaagatcatcaccaagacagcccacctgatcaccaaggagagcccccaggaggagggcaaggagatgtttgccaccatgagcaagctgaaggagcagctgaccaaggtgaaggagtgctacagccccctgctgtatgagagccagcagctgctgatccccctggaggagctggagaagcagatgaccagcttctatgacagcctgggcaagatcaatgagatcatcaccgtgctggagcgggaggcccagagcagcgccctcttcaagcagaagcaccaggagctgctggcctgccaggagaactgcaagaagaccctgaccctgattgagaagggcagccagagcgtgcagaagtttgtgaccctgagcaatgtgctgaagcactttgaccagacccggctgcagaggcagattgctgacatccacgtggccttccagagcatggtgaagaagacaggagactggaagaagcacgtggagaccaacagccggctgatgaagaagtttgaggagagcagagctgagctggagaaggtgctgcgcatcgcccaggagggcctggaggagaagggggaccctgaggagctgctgcggcggcacacagagttcttcagccagctggaccagagggtgctgaatgccttcctgaaggcctgtgatgagctgacagacatcctgcctgagcaggagcagcagggcctgcaggaggccgtgaggaagctgcacaagcagtggaaggacctgcagggcgaggccccctaccacctgctgcacctgaagattgatgtggagaagaaccgcttcctggcctctgtggaggagtgcaggacagagctggaccgggagaccaagctgatgccccaggagggcagcgagaagatcatcaaggagcacagggtcttcttcagtgacaagggcccccaccacctgtgtgagaagaggctgcagctgattgaggagctgtgtgtgaagctgcctgtgcgggaccctgtgcgggacaccccaggcacctgccacgtgaccctgaaggagctgcgggccgccatcgacagcacctacaggaagctgatggaggaccctgacaagtggaaggactacaccagccgcttcagcgagttcagctcctggatcagcaccaatgagacccagctgaagggcatcaagggggaggccatcgacacagccaaccacggggaggtgaagagagctgtggaggagatcagaaatggagtgaccaagagaggagagaccctgtcctggctgaagagccggctgaaggtgctgacagaggtgtccagtgaaaatgaggcccagaagcagggagatgagctggccaagctgagcagcagcttcaaggccctggtgaccctgctgtctgaggtggagaagatgctgagcaactttggagactgtgtgcagtacaaggagatcgtgaagaacagcctggaggagctgatcagcggcagcaaggaggtgcaggagcaggccgagaagatcctggacacagagaacctgtttgaggcccagcagctgctgctgcaccaccagcagaagaccaagaggatcagcgccaagaagagagatgtgcagcagcagatcgcccaggcccagcagggcgagggcggcctgcctgaccggggccacgaggagctgaggaagctggagagcaccctggatggcctggagaggagccgggagcggcaggagcggcgcatccaggtgaccctgaggaagtgggagagatttgagaccaacaaggagaccgtggtgcgctacctgttccagacaggcagcagccatgagcgcttcctgtccttcagcagcctggagagcctgagcagcgagctggagcagaccaaggagttcagcaagaggacagagagcattgctgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaactttgagaccctgtctgtgtggatcacagagaaggagaaggagctgaatgccctggagaccagcagcagcgccatggacatgcagatcagccagatcaaggtgaccatccaggagattgagagcaagctgagcagcatcgtgggcctggaggaggaggcccagagctttgcccagtttgtgaccactggagagagcgcccgcatcaaggccaagctgacccagatcagaagatatggagaggagctgcgggagcacgcccagtgcctggagggcaccatcctgggccacctgagccagcagcagaagtttgaggagaacctgaggaagatccagcagagcgtgtctgaatttgaggacaagctggccgtgcccatcaagatctgcagcagcgccacagagacctacaaggtgctgcaggagcacatggacctgtgccaggccctggagagcctgagcagcgccatcacagccttcagcgccagcgccaggaaggtggtgaacagagacagctgtgtgcaggaggccgccgccctgcagcagcagtatgaggacatcctgcggcgggccaaggagcggcagacagccctggagaacctgctggcccactggcagaggctggagaaggagctgagcagcttcctgacctggctggagcggggggaggccaaggccagcagccctgagatggacatctctgctgacagagtgaaggtggagggggagctgcagctgatccaggccctgcagaatgaggtggtgtcccaggccagcttctacagcaagctgctgcagctgaaggagagcctcttctctgtggccagcaaggatgatgtgaagatgatgaagctgcacctggagcagctggatgagcgctggagggacctgccccagatcatcaacaagaggatcaacttcctgcagagcgtggtggccgagcaccagcagtttgatgagctgctgctgtccttctctgtgtggatcaagctgttcctgtctgagctgcagaccaccagcgagatcagcatcatggaccaccaggtggccctgaccaggcacaaggaccatgctgctgaggtggagagcaagaagggggagctgcagagcctgcagggccacctggccaagctgggcagcctgggccgggcagaggacctgcacctgctgcagggcaaggccgaggactgcttccagctgtttgaggaggccagccaggtggtggagcggcggcagctggccctgagccacctggccgagttcctgcagagccacgccagcctgagcggcatcctgcggcagctgcggcagacagtggaggccaccaacagcatgaacaagaatgaaagtgacctgattgagaaggacctgaatgatgccctgcagaatgccaaggccctggagagcgctgctgtgtccctggatggcatcctgagcaaggcccagtaccacctgaagattggcagcagcgagcagaggaccagctgccgggccacagctgaccagctgtgtggggaggtggagcgcatccagaacctgctgggcaccaagcagagcgaggctgatgccctggccgtgctgaagaaggccttccaggaccagaaggaggagctgctgaagagcattgaggacatcgaggagaggacagacaaggagcggctgaaggagcccacccggcaggccctgcagcagaggctgcgggtcttcaaccagctggaggatgagctgaacagccatgagcacgagctgtgctggctgaaggacaaggccaagcagatcgcccagaaggatgtggcctttgcccctgaggtggaccgggagatcaaccggctggaggtgacctgggatgacaccaagaggctcatccacgagaaccagggccagtgctgcggcctgattgacctgatgagggagtaccagaacctgaagtctgctgtgtccaaggtgctggagaatgccagcagcgtcatcgtgaccaggaccaccatcaaggaccaggaggacctgaagtgggccttcagcaagcatgaaacagccaagaacaagatgaactacaagcagaaggacctggacaacttcaccagcaagggcaagcacctgctgtctgagctgaagaagatccacagcagtgacttcagcctggtgaagacagacatggagagcacagtggacaagtggctggatgtgtctgagaagctggaggagaacatggaccggctgcgggtgtccctgagcatctgggatgatgtgctgagcaccagagatgaaattgagggctggagcaacaactgtgtgccccagatggccgagaacatcagcaacctggacaaccacctgcgggcagaggagctgctgaaggagtttgaaagtgaggtgaagaacaaggccctgcggctggaggagctgcacagcaaggtgaatgacctgaaggagctgaccaagaacctggagaccccaccagacctgcagttcatcgaggccgacctgatgcagaagctggagcacgccaaggagatcacagaggtggccaagggcaccctgaaggacttcaccgcccagagcacccaggtggagaagttcatcaatgacatcaccacctggttcaccaaggtggaggagagcctgatgaactgtgcccagaatgagacctgtgaggccctgaagaaggtgaaggacatccagaaggagctgcagagccagcagagcaacatcagcagcacccaggagaacctgaacagcctgtgcaggaagtaccacagcgctgagctggagagcctgggccgggccatgacaggcctcatcaagaagcatgaggccgtgtcccagctgtgcagcaagacccaggccagcctgcaggagagcctggagaagcacttcagcgagagcatgcaggagttccaggagtggttcctgggcgccaaggctgctgccaaggagagcagtgacagaactggagacagcaaggtgctggaggccaagctgcatgacctgcagaacatcctggacagcgtgtctgatggccagagcaagctggatgctgtgacccaggagggccagaccctgtatgcccacctgagcaagcagatcgtgagcagcatccaggagcagatcaccaaggccaatgaggagttccaggccttcctgaagcagtgcctgaaggacaagcaggccctgcaggactgtgccagcgagctgggcagctttgaggaccagcacaggaagctgaacctgtggattcatgagatggaggagcgcttcaacacagagaacctgggggagagcaagcagcacatccctgagaagaagaatgaggtgcacaaggtggagatgttcctgggggagctgctggccgcccgggagagcctggacaagctgagccagaggggccagctgctgtctgaggagggccacggggccggccaggagggccgcctgtgcagccagctgctgaccagccaccagaacctgctgaggatgaccaaggagaagctgcggagctgccaggtggccctgcaggagcacgaggccctggaggaggccctgcagagcatgtggttctgggtgaaggccatccaggaccggctggcctgtgccgagagcaccctgggcagcaaggacaccctggagaagaggctgagccagatccaggacatcctgctgatgaagggggagggggaggtgaagctgaacatggccatcggcaagggggagcaggccctgcggagcagcaacaaggagggccagagggtcatccagacccagctggagaccctgaaggaggtgtgggccgacatcatgagcagctctgtgcacgcccagagcaccctggagagcgtcatcagccagtggaatgactatgtggagaggaagaaccagctggagcagtggatggagagcgtggaccagaagattgagcaccccctgcagccccagcccggcctgaaggagaagtttgtgctgctggaccacctgcagagcatcctgtctgaggccgaggaccacacccgggccctgcaccggctgattgccaagagccgggagctgtatgagaagacagaagatgagagcttcaaggacacagcccaggaggagctgaagacccagttcaatgacatcatgacagtggccaaggagaagatgaggaaggtggaggagatcgtgaaggaccacctgatgtacctggatgctgtgcatgagttcacagactggctgcacagcgccaaggaggagctgcaccgctggagcgacatgtctggggacagcagcgccacccagaagaagctgagcaagatcaaggagctgattgacagccgggagattggagccagccggctgagccgggtggagagcctggcccctgaggtgaagcagaacaccacagccagcggctgtgagctgatgcacacagagatgcaggccctgcgggctgactggaagcagtgggaggacagcgtcttccagacccagagctgcctggagaacctggtgtcccagatggccctgtctgagcaggagttcagcggccaggtggcccagctggagcaggccctggagcagttcagcgccctgctgaagacctgggcccagcagctgaccctgctggagggcaagaacacagatgaggagatcgtggagtgctggcacaagggccaggagatcctggatgccctgcagaaggccgagcccaggacagaggacctgaagagccagctgaatgagctgtgccgcttcagccgggacctgagcacctacagcggcaaggtgtctggcctcatcaaggagtacaactgcctgtgcctgcaggccagcaagggctgccagaacaaggagcagatcctgcagcagcgcttcaggaaggccttccgggacttccagcagtggctggtgaatgccaagatcaccacagccaagtgctttgacatcccccagaacatcagcgaggtgtccaccagcctgcagaagatccaggagttcctgtctgagagtgaaaatggccagcacaagctgaacatgatgctgagcaagggggagctgctgagcaccctgctgaccaaggagaaggccaagggcatccaggccaaggtgacagctgccaaggaggactggaagaacttccacagcaacctgcaccagaaggagagcgccctggagaacctgaagatccagatgaaggactttgaggtgtctgctgagcccatccaggactggctgagcaagacagagaagatggtgcatgagagcagcaaccggctgtatgacctgcctgccaagagaagagagcagcagaagctgcagagcgtgctggaggagatccactgctatgagccccagctgaaccggctgaaggagaaggcccagcagctgtgggagggccaggccgccagcaagagcttccgccaccgggtgtcccagctgagcagccagtacctggccctgagcaacctgaccaaggagaaggtgtcccggctggacagaattgtggccgagcacaaccagttcagcctgggcatcaaggagctgcaggactggatgacagatgccatccacatgctggacagctactgccaccccaccagtgacaagtctgtgctggacagcaggaccctgaagctggaggccctgctgtctgtgaagcaggagaaggagatccagatgaagatgattgtgaccagaggagagagcgtgctgcagaacaccagccctgagggcatccccaccatccagcagcagctgcagagcgtgaaggacatgtgggccagcctgctgtctgctggcatccgctgcaagagccagctggagggcgccctgagcaagtggaccagctaccaggatggagtgcggcagttcagcggctggatggacagcatggaggccaacctgaatgaaagtgagcggcagcacgccgagctgcgggacaagaccaccatgctgggcaaggccaagctgctgaatgaggaggtgctgagctacagcagcctgctggagaccatcgaggtgaagggagctggcatgacagagcactacgtgacccagctggagctgcaggacctgcaggagcgctaccgggccatccaggagcgggccaaggaggccgtgaccaagtctgagaagctggtgcggctgcaccaggagtaccagagggacctgaaggcctttgaggtgtggctgggccaggagcaggagaagctggaccagtacagcgtgctggagggagatgcccacacccatgagaccaccctgcgggacctgcaggagctgcaggtgcactgtgccgagggccaggccctgctgaacagcgtgctgcacacccgggaggatgtgatccccagcggcatcccccaggctgaagatcgggccctggagagcctgcggcaggactggcaggcctaccagcaccggctgtctgagaccaggacccagttcaacaacgtggtgaacaagctgcggctgatggagcagaagttccagcaggtggatgagtggctgaagacagctgaggagaagaagtggcatgaggaggtgacagcctacagagatgaggtggaggaggtgggcgcccgggcccaggagatcctggatgagagccacgtgaacagcaggatgggctgccaggccacccagctgaccagccgctaccaggccctgctgctgcaggtgctggagcagatcaagttcctggaggaggagatccagagcctggaggagagcgagagcagcctgagcagctacagcgactggtacggcagcacccacaagaacttcaagaatgtggccaccaagattgacaaggtggacacagtgatgatgggcaagaagctgaagaccctggaggtgctgctgaaggacatggagaagggccacagcctgctgaagagcgcccgggagaagggggagagagctgtgaagtacctggaggagggggaggccgagcggctgaggaaggagatccatgaccacatggagcagctgaaggagctgaccagcacagtgaggaaggagcacatgaccctggagaagggcctgcacctggccaaggagttcagtgacaagtgcaaggccctgacccagtggattgctgagtaccaggagatcctgcacgtgcctgaggagcccaagatggagctgtatgagaagaaggcccagctgagcaagtacaagagcctgcagcagacagtgctgagccatgagcccagcgtgaagtctgtgcgggagaagggggaggccctgctggagctggtgcaggatgtgaccctgaaggacaagattgaccagctgcagagcgactaccaggacctgtgcagcatcggcaaggccatgatggaggagattgctggctttgaggaccggctgaacaacctgcagatgaagggggacaccctcatcggccagtgtgccgaccacctgcaggccaagctgaagcagaatgtgcacgcccacctgcagggcaccaaggacagctacagcgccatctgcagcacagcccagaggatgtaccagagcctggagcacgagctgcagaagcacgtgtcccggcaggacaccctgcagcagtgccaggcctggctgtctgctgtgcagcctgacctggagcccagcccccagccccccctgagcagagctgaggccatcaagcaggtgaagcacttccgggccctgcaggagcaggcccggacctacctggacctgctgtgcagcatgtgtgacctgagcaatgcctctgtgaagaccacagccaaggacatccagcagacagagcagaccatcgagcagaagctggtgcaggcccagaacctgacccagggctgggaggagatcaagcacctgaagtctgagctgtggatctacctgcaggatgctgaccagcagctgcagaacatgaagagaagacacagcgagctggagctgaacatcgcccagaacatggtgtcccaggtgaaggactttgtgaagaagctgcagagcaagcaggcctctgtgaacaccatcatcgagaaggtgaacaagctgaccaagaaggaggagagccctgagcacaaggagatcaaccacctgaatgaccagtggctggacctgtgccggcagagcaacaacctgtgcctgcagcgggaggaggacctgcagaggacccgggactaccatgactgcatgaatgtggtggaggtgttcctggagaagttcaccacagagtgggacaacctggcccggagtgatgctgagagcacagctgtgcacctggaggccctgaagaagctggccctggccctgcaggagaggaaatatgccatcgaggacctgaaggaccagaagcagaagatgattgagcacctgaacctggatgacaaggagctggtgaaggagcagaccagccacctggagcagcgctggttccagctggaggacctgatcaagaggaagatccaggtgtctgtgaccaacctggaggagctgaatgtggtgcagagccgcttccaggagctgatggagtgggccgaggagcagcagcccaacattgctgaggccctgaagcagagccccccaccagacatggcccagaacctgctgatggaccacctggccatctgcagcgagctggaggccaagcagatgctgctgaagagcctcatcaaggatgctgacagagtgatggctgacctgggcctgaatgaaaggcaggtgatccagaaggccctgagtgatgcccagagccacgtgaactgcctgagtgacctggtgggccagaggaggaagtacctgaacaaggccctgtctgagaagacccagttcctgatggctgtgttccaggccaccagccagatccagcagcacgagaggaagatcatgttccgggagcacatctgcctgctgcctgatgatgtgtccaagcaggtgaagacctgcaagagcgcccaggccagcctgaagacctaccagaatgaggtgacaggcctgtgggcccagggccgggagctgatgaaggaggtgacagagcaggagaagtctgaggtgctgggcaagctgcaggagctgcagagcgtgtatgacagcgtgctgcagaagtgcagccaccggctgcaggagctggagaagaacctggtgtccaggaagcacttcaaggaggactttgacaaggcctgccactggctgaagcaggccgacatcgtgaccttccctgagatcaacctgatgaatgaatcttctgagctgcacacccagctggccaagtaccagaacatcctggagcagagcccagaatatgagaacctgctgctgaccctgcagaggacaggccagaccatcctgcccagcctgaatgaggtggaccacagctacctgtctgagaagctgaatgccctgccccggcagttcaacgtcatcgtggccctggccaaggacaagttctacaaggtgcaggaggccatcctggccaggaaggagtatgccagcctgattgagctgaccacccagagcctgtctgagctggaggcccagttcctgaggatgagcaaggtgcccacagacctggccgtggaggaggccctgagcctgcaggacggctgccgggccatcctggatgaggtggccggcctgggggaggccgtggatgagctgaaccagaagaaggagggcttccgcagcacaggccagccctggcagcctgacaagatgctgcacctggtgaccctgtaccaccggctgaagaggcagacagagcagagggtgtccctgctggaggacaccaccagcgcctaccaggagcacgagaagatgtgccagcagctggagcggcagctgaagtctgtgaaggaggagcagagcaaggtgaatgaggagaccctgcctgctgaggagaagctgaagatgtaccacagcctggccggcagcctgcaggacagcggcatcgtgctgaagagggtgaccatccacctggaggacctggccccccacctggaccccctggcctatgagaaggcccggcaccagatccagagctggcagggcgagctgaagctgctgaccagcgccatcggggagaccgtgacagaatgtgagagcaggatggtgcagagcattgacttccagacagagatgagccgcagcctggactggctgcggcgggtgaaggccgagctgagcggccctgtgtacctggacctgaacctgcaggacatccaggaggagatcaggaagatccagatccaccaggaggaggtgcagagcagcctgcgcatcatgaatgccctgagccacaaggagaaggagaagttcaccaaggccaaggagctgatctctgctgacctggagcacagcctggccgagctgtctgagctggatggagacatccaggaggccctgcggacccggcaggccaccctgacagagatctacagccagtgccagcgctactaccaggtgttccaggccgccaatgactggctggaggatgcccaggagctgctgcagctggccggaaatggcctggatgtggagagcgctgaggagaacctgaagagccacatggagttcttcagcacagaggaccagttccacagcaacctggaggagctgcacagcctggtggccaccctggaccccctcatcaagcccaccgggaaggaggacctggagcagaaggtggccagcctggagctgcggagccagaggatgagccgggacagcggggcccaggtggacctgctgcagcgctgcacagcccagtggcatgactaccagaaggcccgggaggaggtgattgagctgatgaatgacacagagaagaagctgtctgagttcagcctgctgaagaccagcagcagccatgaagctgaggagaagctgtctgagcacaaggccctggtgtctgtggtgaacagcttccacgagaagatcgtggccctggaggagaaggccagccagctggagaagacaggaaatgatgccagcaaggccaccctgagccgctccatgaccaccgtgtggcagcgctggacccggctgcgggctgtggcccaggaccaggagaagatcctggaggatgctgtggatgagtggacaggcttcaacaacaaggtgaagaaggccacagagatgattgaccagctgcaggacaagctgcccggcagcagcgctgagaaggccagcaaggccgagctgctgaccctgctggagtaccatgacacctttgtgctggagctggagcagcagcagagcgccctgggcatgctgcggcagcagaccctgtccatgctgcaggatggagctgcccccaccccaggagaggagccccccctgatgcaggagatcacagccatgcaggaccgctgcctgaacatgcaggagaaggtgaagaccaacgggaagctggtgaagcaggagctgaaggaccgggagatggtggagacccagatcaacagcgtgaagtgctgggtgcaggagaccaaggagtacctgggcaaccccaccatcgagattgatgcccagctggaggagctgcagatcctgctgacagaggccaccaaccaccggcagaacatcgagaagatggccgaggagcagaaggagaagtacctgggcctgtacaccatcctgcccagcgagctgagcctgcagctggccgaggtggccctggacctgaagatccgggaccagatccaggacaagatcaaggaggtggagcagagcaaggccaccagccaggagctgagccggcagatccagaagctggccaaggacctgaccaccatcctgaccaagctgaaggccaagacagacaacgtggtgcaggccaagacagaccagaaggtgctgggggaggagctggatggctgcaacagcaagctgatggagctggatgctgctgtgcagaagttcctggagcagaatggccagctgggcaagcccctggccaagaagattggcaagctgacagagctgcaccagcagaccatccggcaggctgaaaatcggctgagcaagctgaaccaggccgccagccacctggaggagtacaatgagatgctggagctgatcctgaagtggattgagaaggccaaggtgctggcccacggcaccatcgcctggaacagcgccagccagctgcgggagcagtacatcctgcaccagaccctgctggaggagagcaaggagattgacagcgagctggaggccatgacagagaagctgcagtacctgacctctgtgtactgcacagagaagatgagccagcaggtggccgagctgggccgggagacagaggagctgcggcagatgatcaagatccggctgcagaacctgcaggatgctgccaaggacatgaagaagtttgaggccgagctgaagaagctgcaggccgccctggagcaggcccaggccaccctgaccagccctgaggtgggccgcctgagcctgaaggagcagctgagccaccggcagcacctgctgtctgagatggagagcctgaagcccaaggtgcaggccgtgcagctgtgccagagcgccctgcgcatcccagaagatgtggtggccagcctgcccctgtgccacgccgccctgcggctgcaggaggaggccagccggctgcagcacacagccatccagcagtgcaacatcatgcaggccgctgtggtgcagtatgagcagtatgagcaggagatgaagcacctgcagcagctgattgaaggagcccaccgggagattgaggacaagcctgtggccaccagcaacatccaggagctgcaggcccagatcagcagacatgaggagctggcccagaagatcaagggctaccaggagcagatcgccagcctgaacagcaagtgcaagatgctgaccatgaaggccaagcacgccaccatgctgctgactgtgacagaggtggagggcctggccgagggcacagaggacctggatggagagctgctgcccaccccatctgcccaccccagcgtggtgatgatgacagctggccgctgccacaccctgctgagccctgtgacagaggagagcggggaggagggcaccaacagcgagatcagcagccccccagcctgccgcagccccagccctgtggccaacacagatgcctctgtgaaccaggacatcgcctactaccaggccctgtctgctgagcggctgcagacagatgctgccaagatccaccccagcaccagcgccagccaggagttctatgagcccggcctggagcccagcgccacagccaagctgggggacctgcagaggtcctgggagaccctgaagaatgtcatcagcgagaagcagaggaccctgtatgaggccctggagcggcagcagaagtaccaggacagcctgcagagcatcagcaccaagatggaggccatcgagctgaagctgtctgagagccctgagcccggccgcagccctgagagccagatggccgagcaccaggccctgatggatgagatcctgatgctgcaggatgagatcaatgagctgcagagcagcctggccgaggagctggtgtctgagagctgtgaggccgaccctgctgagcagctggccctgcagagcaccctgactgtgctggccgagaggatgagcaccatccgcatgaaggccagcggcaagaggcagctgctggaggagaagctgaatgaccagctggaggagcagaggcaggagcaggccctgcagcgctaccgctgtgaggctgatgagctggacagctggctgctgagcaccaaggccaccctggacacagccctgagcccccccaaggagcccatggacatggaggcccagctgatggactgccagaacatgctggtggagattgagcagaaggtggtggccctgtctgagctgtctgtgcacaatgaaaacctgctgctggagggcaaggcccacaccaaggatgaagctgagcagctggccggcaagctgcggcggctgaagggcagcctgctggagctgcagagggccctgcatgacaagcagctgaacatgcagggcacagcccaggagaaggaggagagtgatgtggacctgacagccacccagagccctggggtgcaggagtggctggcccaggcccggaccacctggacccagcagaggcagagcagcctgcagcagcagaaggagctggagcaggagctggccgagcagaagagcctgctgcggtctgtggccagcagaggagaggagatcctgatccagcacagcgctgctgagaccagcggagatgctggggagaagccagatgtgctgagccaggagctgggcatggagggggagaagagcagcgctgaggaccagatgaggatgaagtgggagagcctgcaccaggagttcagcaccaagcagaagctgctgcagaatgtgctggagcaggagcaggagcaggtgctgtacagccggcccaaccggctgctgtctggagtgcccctgtacaagggagatgtgcccacccaggacaagtctgctgtgaccagcctgctggatggcctgaaccaggcctttgaggaggtgagcagccagagcggcggggccaagaggcagagcatccacctggagcagaagctgtatgatggagtgtctgccaccagcacctggctggatgatgtggaggagcggctgtttgtggccacagccctgctgcctgaggagacagagacctgcctcttcaaccaggagatcctggccaaggacatcaaggagatgtctgaggagatggacaagaacaagaacctcttcagccaggccttcccagaaaatggagacaacagagatgtgattgaggacaccctgggctgcctgctgggccgcctgagcctgctggacagcgtggtgaaccagcgctgccaccagatgaaggagcggctgcagcagatcctgaacttccagaatgacctgaaggtgctcttcaccagcctggccgacaacaagtacatcatcctgcagaagctggccaacgtgtttgagcagcctgtggccgagcagatcgaggccatccagcaggctgaagatggcctgaaggagtttgatgctggcatcatcgagctgaagagaagaggagacaagctgcaggtggagcagcccagcatgcaggagctgagcaagctgcaggacatgtatgatgagctgatgatgatcatcggcagccgccgcagcggcctgaaccagaacctgaccctgaagagccagtatgaaagagccctgcaggacctggccgacctgctggagaccggccaggagaagatggccggggaccagaagatcatcgtgagcagcaaggaggagatccagcagctgctggacaagcacaaggagtacttccagggcctggagagccacatgatcctgacagagaccctcttcaggaagatcatcagctttgctgtgcagaaggagacccagttccacacagagctgatggcccaggccagcgctgtgctgaagagggcccacaagaggggcgtggagctggagtacatcctggagacctggagccacctggatgaggaccagcaggagctgagccggcagctggaggtggtggagagcagcatccccagcgtgggcctggtggaggagaatgaagatcggctgattgaccgcatcaccctgtaccagcacctgaagagcagcctgaatgagtaccagcccaagctgtaccaggtgctggatgatggcaagaggctgctgatcagcatcagctgcagcgacctggagagccagctgaaccagctgggggagtgctggctgagcaacaccaacaagatgagcaaggagctgcaccggctggagaccatcctgaagcactggacccgctaccagagcgagagcgctgacctgatccactggctgcagagcgccaaggaccggctggagttctggacccagcagagcgtgacagtgccccaggagctggagatggtgcgggaccacctgaatgccttcctggagttcagcaaggaggtggatgcccagagcagcctgaagagctctgtgctgagcactggaaaccagctgctgcggctgaagaaggtggacacagccaccctgcggtctgagctgagcagaattgacagccagtggacagacctgctgaccaacatcccagctgtgcaggagaagctgcaccagctgcagatggacaagctgcccagcagacatgccatcagcgaggtgatgtcctggatcagcctgatggagaatgtcatccagaaggatgaggacaacatcaagaacagcatcggctacaaggccatccacgagtacctgcagaagtacaagggcttcaagattgacatcaactgcaagcagctgactgtggactttgtgaaccagagcgtgctgcagatcagcagccaggatgtggagagcaagagaagtgacaagacagactttgctgagcagctgggcgccatgaacaagtcctggcagatcctgcagggcctggtgacagagaagatccagctgctggagggcctgctggagagctggagcgaatatgaaaataatgtgcagtgcctgaagacctggtttgagacccaggagaagaggctgaagcagcagcaccgcatcggggaccaggcctctgtgcagaatgccctgaaggactgccaggacctggaggacctgatcaaggccaaggagaaggaggtggagaagattgagcagaatggcctggccctgatccagaacaagaaggaggatgtgagcagcatcgtgatgagcaccctgcgggagctgggccagacctgggccaacctggaccacatggtgggccagctgaagatcctgctgaagtctgtgctggaccagtggagcagccacaaggtggcctttgacaagatcaacagctacctgatggaggcccgctacagcctgagccgcttccggctgctgaccggcagcctggaggccgtgcaggtgcaggtggacaacctgcagaacctgcaggatgacctggagaagcaggagaggagcctgcagaagtttggcagcatcaccaaccagctgctgaaggagtgccacccccctgtgacagagaccctgaccaacaccctgaaggaggtgaacatgcgctggaacaacctgctggaggagattgctgagcagctgcagagcagcaaggccctgctgcagctgtggcagcgctacaaggactacagcaagcagtgtgccagcacagtgcagcagcaggaggacaggaccaatgagctgctgaaggccgccaccaacaaggacattgctgatgatgaggtggccacctggatccaggactgcaatgacctgctgaagggcctgggcaccgtgaaggacagcctcttcttcctgcacgagctgggggagcagctgaagcagcaggtggatgccagcgctgccagcgccatccagagcgaccagctgagcctgagccagcacctgtgtgccctggagcaggccctgtgcaagcagcagaccagcctgcaggccggcgtgctggactatgagacctttgccaagagcctggaggccctggaggcctggatcgtggaggccgaggagatcctgcagggccaggaccccagccacagcagtgacctgagcaccatccaggagaggatggaggagctgaagggccagatgctgaagttcagctccatggccccagacctggaccggctgaatgagctgggctaccgcctgcccctgaatgacaaggagatcaagaggatgcagaacctgaacagacactggagcctcatcagcagccagaccacagagcgcttcagcaagctgcagagcttcctgctgcagcaccagaccttcctggagaagtgtgagacctggatggagttcctggtgcagacagagcagaagctggccgtggagatcagcggcaactaccagcacctgctggagcagcagagggcccacgagctgttccaggccgagatgttcagccggcagcagatcctgcacagcatcatcattgatggccagaggctgctggagcagggccaggtggatgacagagatgagttcaacctgaagctgaccctgctgagcaaccagtggcagggcgtcatccggcgggcccagcagaggcggggcatcatcgacagccagatccggcagtggcagcgctaccgggagatggccgagaagctgaggaagtggctggtggaggtgtcctacctgcccatgagcggcctgggctctgtgcccatccccctgcagcaggcccggaccctgtttgatgaggtgcagttcaaggagaaggtgttcctgcggcagcagggcagctacatcctgactgtggaggccggcaagcagctgctgctgtctgctgacagcggggctgaggccgccctgcaggccgagctggccgagatccaggagaagtggaagagcgcctccatgaggctggaggagcagaagaagaagctggccttcctgctgaaggactgggagaagtgtgagaagggcattgctgacagcctggagaagctgcggaccttcaagaagaagctgagccagagcctgcctgaccaccacgaggagctgcacgccgagcagatgcgctgcaaggagctggagaatgctgtgggctcctggacagatgacctgacccagctgagcctgctgaaggacaccctgagcgcctacatctctgcagatgacatcagcatcctgaatgaaagagtggagctgctgcagaggcagtgggaggagctgtgccaccagctgagcctgcggcggcagcagatcggggagcggctgaatgagtgggccgtgttttctgagaagaacaaggagctgtgtgagtggctgacccagatggagagcaaggtgtcccagaatggagacatcctgattgaggagatgattgagaagctgaagaaggactaccaggaggagatcgccatcgcccaggagaacaagatccagctgcagcagatgggagagcggctggccaaggccagccatgagagcaaggccagcgagattgagtacaagctgggcaaggtgaatgaccgctggcagcacctgctggacctgattgctgcccgggtgaagaagctgaaggagaccctggtggccgtgcagcagctggacaagaacatgagcagcctgcggacctggctggcccacattgaaagtgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagtggagtcatctacacagtggccaaggaggagctgaagaagtttgaggccttccagaggcaggtgcatgagtgcctgacccagctggagctgatcaacaagcagtacagaaggctggcccgggagaacagaacagattctgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagtgatgtgatgatccctgagagccctgaggcctacgtgaagctgacagaaaatgccatcaagaacaccagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171274 - DNA, 26250 bp, Artificial Sequence
  Description of Artificial Sequence: Synthetic coding sequence
atggccaccagcagaggagccagccgctgcccccgggacatcgccaacgtgatgcagaggctgcaggatgagcaggagatcgtgcagaagaggaccttcaccaagtggatcaacagccacctggccaagaggaagccacccatggtggtggatgacctgtttgaggacatgaaggatggagtgaagctgctggccctgctggaggtgctgagcggccagaagctgccctgtgagcagggccgcaggatgaagagaattcatgctgtggccaacatcggcacagccctgaagttcctggagggcaggaagtccatgcaccggggcagccccatcaagctggtgaacatcaacagcacagacattgctgatggccggcccagcatcgtgctgggcctgatgtggaccatcatcctgtacttccagatcgaggagctgaccagcaacctgccccagctgcagagcctgagcagcagcgccagctctgtggacagcatcgtgagcagcgagacccccagcccccccagcaagaggaaggtgaccaccaagatccagggcaatgccaagaaggccctgctgaagtgggtgcagtacacagctgggaagcagacaggaattgaggtgaaggactttgggaagtcctggaggtctggagtggccttccacagcgtcatccacgccatccggcctgagctggtggacctggagaccgtgaagggccgcagcaaccgggagaacctggaggatgccttcaccatcgccgagacagagctgggcatcccccggctgctggaccctgaagatgtggatgtggacaagccagatgagaagagcatcatgacctacgtggcccagttcctgaagcactacccagacatccacaatgccagcacagatggccaggaggatgatgagatcctgcccggcttccccagctttgccaacagcgtgcagaacttcaagcgggaggacagagtcatcttcaaggagatgaaggtgtggattgagcagtttgagcgggacctgacccgggcccagatggtggagagcaacctgcaggacaagtaccagagcttcaagcacttccgggtgcagtatgagatgaagaggaagcagatcgagcacctgatccagcccctgcacagagatggcaagctgagcctggaccaggccctggtgaagcagagctgggacagagtgaccagccggctgtttgactggcacatccagctggacaagagcctgcctgcccccctgggcaccatcggggcctggctgtacagagctgaggtggccctgcgggaggagatcaccgtgcagcaggtgcatgaggagacagccaacaccatccagaggaagctggagcagcacaaggacctgctgcagaacacagatgcccacaagagggccttccacgagatctaccgcaccaggtctgtgaatggcatccctgtgcccccagaccagctggaggacatggccgagcgcttccactttgtgagcagcaccagcgagctgcacctgatgaagatggagttcctggagctgaagtaccgcctgctgagcctgctggtgctggccgagagcaagctgaagtcctggatcatcaagtatggaagaagagagagcgtggagcagctgctgcagaactacgtgtccttcatcgagaacagcaagttctttgagcagtatgaggtgacctaccagatcctgaagcagacagctgagatgtatgtgaaggcagatggctctgtggaggaggccgagaatgtgatgaagttcatgaatgagaccacagcccagtggaggaacctgtctgtggaggtgcgctctgtgcgctccatgctggaggaggtgatcagcaactgggacagatatggcaacacagtggccagcctgcaggcctggctggaggatgctgagaagatgctgaaccagagtgaaaatgccaagaaggacttcttcaggaacctgccccactggatccagcagcacacagccatgaatgatgctggcaacttcctgattgagacctgtgatgagatggtgtcccgggacctgaagcagcagctgctgctgctgaatggccgctggagggagctgttcatggaggtgaagcagtatgcccaggctgatgagatggacaggatgaagaaggagtacacagactgtgtggtgaccctgagcgcctttgccacagaggcccacaagaagctgtctgagcccctggaggtgtccttcatgaatgtgaagctgctgatccaggacctggaggacatcgagcagagggtgcctgtgatggatgcccagtacaagatcatcaccaagacagcccacctgatcaccaaggagagcccccaggaggagggcaaggagatgtttgccaccatgagcaagctgaaggagcagctgaccaaggtgaaggagtgctacagccccctgctgtatgagagccagcagctgctgatccccctggaggagctggagaagcagatgaccagcttctatgacagcctgggcaagatcaatgagatcatcaccgtgctggagcgggaggcccagagcagcgccctcttcaagcagaagcaccaggagctgctggcctgccaggagaactgcaagaagaccctgaccctgattgagaagggcagccagagcgtgcagaagtttgtgaccctgagcaatgtgctgaagcactttgaccagacccggctgcagaggcagattgctgacatccacgtggccttccagagcatggtgaagaagacaggagactggaagaagcacgtggagaccaacagccggctgatgaagaagtttgaggagagcagagctgagctggagaaggtgctgcgcatcgcccaggagggcctggaggagaagggggaccctgaggagctgctgcggcggcacacagagttcttcagccagctggaccagagggtgctgaatgccttcctgaaggcctgtgatgagctgacagacatcctgcctgagcaggagcagcagggcctgcaggaggccgtgaggaagctgcacaagcagtggaaggacctgcagggcgaggccccctaccacctgctgcacctgaagattgatgtggagaagaaccgcttcctggcctctgtggaggagtgcaggacagagctggaccgggagaccaagctgatgccccaggagggcagcgagaagatcatcaaggagcacagggtcttcttcagtgacaagggcccccaccacctgtgtgagaagaggctgcagctgattgaggagctgtgtgtgaagctgcctgtgcgggaccctgtgcgggacaccccaggcacctgccacgtgaccctgaaggagctgcgggccgccatcgacagcacctacaggaagctgatggaggaccctgacaagtggaaggactacaccagccgcttcagcgagttcagctcctggatcagcaccaatgagacccagctgaagggcatcaagggggaggccatcgacacagccaaccacggggaggtgaagagagctgtggaggagatcagaaatggagtgaccaagagaggagagaccctgtcctggctgaagagccggctgaaggtgctgacagaggtgtccagtgaaaatgaggcccagaagcagggagatgagctggccaagctgagcagcagcttcaaggccctggtgaccctgctgtctgaggtggagaagatgctgagcaactttggagactgtgtgcagtacaaggagatcgtgaagaacagcctggaggagctgatcagcggcagcaaggaggtgcaggagcaggccgagaagatcctggacacagagaacctgtttgaggcccagcagctgctgctgcaccaccagcagaagaccaagaggatcagcgccaagaagagagatgtgcagcagcagatcgcccaggcccagcagggcgagggcggcctgcctgaccggggccacgaggagctgaggaagctggagagcaccctggatggcctggagaggagccgggagcggcaggagcggcgcatccaggtgaccctgaggaagtgggagagatttgagaccaacaaggagaccgtggtgcgctacctgttccagacaggcagcagccatgagcgcttcctgtccttcagcagcctggagagcctgagcagcgagctggagcagaccaaggagttcagcaagaggacagagagcattgctgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaactttgagaccctgtctgtgtggatcacagagaaggagaaggagctgaatgccctggagaccagcagcagcgccatggacatgcagatcagccagatcaaggtgaccatccaggagattgagagcaagctgagcagcatcgtgggcctggaggaggaggcccagagctttgcccagtttgtgaccactggagagagcgcccgcatcaaggccaagctgacccagatcagaagatatggagaggagctgcgggagcacgcccagtgcctggagggcaccatcctgggccacctgagccagcagcagaagtttgaggagaacctgaggaagatccagcagagcgtgtctgaatttgaggacaagctggccgtgcccatcaagatctgcagcagcgccacagagacctacaaggtgctgcaggagcacatggacctgtgccaggccctggagagcctgagcagcgccatcacagccttcagcgccagcgccaggaaggtggtgaacagagacagctgtgtgcaggaggccgccgccctgcagcagcagtatgaggacatcctgcggcgggccaaggagcggcagacagccctggagaacctgctggcccactggcagaggctggagaaggagctgagcagcttcctgacctggctggagcggggggaggccaaggccagcagccctgagatggacatctctgctgacagagtgaaggtggagggggagctgcagctgatccaggccagcagcaggaagtttgtgtcccaggccagcttctacagcaagctgctgcagctgaaggagagcctcttctctgtggccagcaaggatgatgtgaagatgatgaagctgcacctggagcagctggatgagcgctggagggacctgccccagatcatcaacaagaggatcaacttcctgcagagcgtggtggccgagcaccagcagtttgatgagctgctgctgtccttctctgtgtggatcaagctgttcctgtctgagctgcagaccaccagcgagatcagcatcatggaccaccaggtggccctgaccaggcacaaggaccatgctgctgaggtggagagcaagaagggggagctgcagagcctgcagggccacctggccaagctgggcagcctgggccgggcagaggacctgcacctgctgcagggcaaggccgaggactgcttccagctgtttgaggaggccagccaggtggtggagcggcggcagctggccctgagccacctggccgagttcctgcagagccacgccagcctgagcggcatcctgcggcagctgcggcagacagtggaggccaccaacagcatgaacaagaatgaaagtgacctgattgagaaggacctgaatgatgccctgcagaatgccaaggccctggagagcgctgctgtgtccctggatggcatcctgagcaaggcccagtaccacctgaagattggcagcagcgagcagaggaccagctgccgggccacagctgaccagctgtgtggggaggtggagcgcatccagaacctgctgggcaccaagcagagcgaggctgatgccctggccgtgctgaagaaggccttccaggaccagaaggaggagctgctgaagagcattgaggacatcgaggagaggacagacaaggagcggctgaaggagcccacccggcaggccctgcagcagaggctgcgggtcttcaaccagctggaggatgagctgaacagccatgagcacgagctgtgctggctgaaggacaaggccaagcagatcgcccagaaggatgtggcctttgcccctgaggtggaccgggagatcaaccggctggaggtgacctgggatgacaccaagaggctcatccacgagaaccagggccagtgctgcggcctgattgacctgatgagggagtaccagaacctgaagtctgctgtgtccaaggtgctggagaatgccagcagcgtcatcgtgaccaggaccaccatcaaggaccaggaggacctgaagtgggccttcagcaagcatgaaacagccaagaacaagatgaactacaagcagaaggacctggacaacttcaccagcaagggcaagcacctgctgtctgagctgaagaagatccacagcagtgacttcagcctggtgaagacagacatggagagcacagtggacaagtggctggatgtgtctgagaagctggaggagaacatggaccggctgcgggtgtccctgagcatctgggatgatgtgctgagcaccagagatgaaattgagggctggagcaacaactgtgtgccccagatggccgagaacatcagcaacctggacaaccacctgcgggcagaggagctgctgaaggagtttgaaagtgaggtgaagaacaaggccctgcggctggaggagctgcacagcaaggtgaatgacctgaaggagctgaccaagaacctggagaccccaccagacctgcagttcatcgaggccgacctgatgcagaagctggagcacgccaaggagatcacagaggtggccaagggcaccctgaaggacttcaccgcccagagcacccaggtggagaagttcatcaatgacatcaccacctggttcaccaaggtggaggagagcctgatgaactgtgcccagaatgagacctgtgaggccctgaagaaggtgaaggacatccagaaggagctgcagagccagcagagcaacatcagcagcacccaggagaacctgaacagcctgtgcaggaagtaccacagcgctgagctggagagcctgggccgggccatgacaggcctcatcaagaagcatgaggccgtgtcccagctgtgcagcaagacccaggccagcctgcaggagagcctggagaagcacttcagcgagagcatgcaggagttccaggagtggttcctgggcgccaaggctgctgccaaggagagcagtgacagaactggagacagcaaggtgctggaggccaagctgcatgacctgcagaacatcctggacagcgtgtctgatggccagagcaagctggatgctgtgacccaggagggccagaccctgtatgcccacctgagcaagcagatcgtgagcagcatccaggagcagatcaccaaggccaatgaggagttccaggccttcctgaagcagtgcctgaaggacaagcaggccctgcaggactgtgccagcgagctgggcagctttgaggaccagcacaggaagctgaacctgtggattcatgagatggaggagcgcttcaacacagagaacctgggggagagcaagcagcacatccctgagaagaagaatgaggtgcacaaggtggagatgttcctgggggagctgctggccgcccgggagagcctggacaagctgagccagaggggccagctgctgtctgaggagggccacggggccggccaggagggccgcctgtgcagccagctgctgaccagccaccagaacctgctgaggatgaccaaggagaagctgcggagctgccaggtggccctgcaggagcacgaggccctggaggaggccctgcagagcatgtggttctgggtgaaggccatccaggaccggctggcctgtgccgagagcaccctgggcagcaaggacaccctggagaagaggctgagccagatccaggacatcctgctgatgaagggggagggggaggtgaagctgaacatggccatcggcaagggggagcaggccctgcggagcagcaacaaggagggccagagggtcatccagacccagctggagaccctgaaggaggtgtgggccgacatcatgagcagctctgtgcacgcccagagcaccctggagagcgtcatcagccagtggaatgactatgtggagaggaagaaccagctggagcagtggatggagagcgtggaccagaagattgagcaccccctgcagccccagcccggcctgaaggagaagtttgtgctgctggaccacctgcagagcatcctgtctgaggccgaggaccacacccgggccctgcaccggctgattgccaagagccgggagctgtatgagaagacagaagatgagagcttcaaggacacagcccaggaggagctgaagacccagttcaatgacatcatgacagtggccaaggagaagatgaggaaggtggaggagatcgtgaaggaccacctgatgtacctggatgctgtgcatgagttcacagactggctgcacagcgccaaggaggagctgcaccgctggagcgacatgtctggggacagcagcgccacccagaagaagctgagcaagatcaaggagctgattgacagccgggagattggagccagccggctgagccgggtggagagcctggcccctgaggtgaagcagaacaccacagccagcggctgtgagctgatgcacacagagatgcaggccctgcgggctgactggaagcagtgggaggacagcgtcttccagacccagagctgcctggagaacctggtgtcccagatggccctgtctgagcaggagttcagcggccaggtggcccagctggagcaggccctggagcagttcagcgccctgctgaagacctgggcccagcagctgaccctgctggagggcaagaacacagatgaggagatcgtggagtgctggcacaagggccaggagatcctggatgccctgcagaaggccgagcccaggacagaggacctgaagagccagctgaatgagctgtgccgcttcagccgggacctgagcacctacagcggcaaggtgtctggcctcatcaaggagtacaactgcctgtgcctgcaggccagcaagggctgccagaacaaggagcagatcctgcagcagcgcttcaggaaggccttccgggacttccagcagtggctggtgaatgccaagatcaccacagccaagtgctttgacatcccccagaacatcagcgaggtgtccaccagcctgcagaagatccaggagttcctgtctgagagtgaaaatggccagcacaagctgaacatgatgctgagcaagggggagctgctgagcaccctgctgaccaaggagaaggccaagggcatccaggccaaggtgacagctgccaaggaggactggaagaacttccacagcaacctgcaccagaaggagagcgccctggagaacctgaagatccagatgaaggactttgaggtgtctgctgagcccatccaggactggctgagcaagacagagaagatggtgcatgagagcagcaaccggctgtatgacctgcctgccaagagaagagagcagcagaagctgcagagcgtgctggaggagatccactgctatgagccccagctgaaccggctgaaggagaaggcccagcagctgtgggagggccaggccgccagcaagagcttccgccaccgggtgtcccagctgagcagccagtacctggccctgagcaacctgaccaaggagaaggtgtcccggctggacagaattgtggccgagcacaaccagttcagcctgggcatcaaggagctgcaggactggatgacagatgccatccacatgctggacagctactgccaccccaccagtgacaagtctgtgctggacagcaggaccctgaagctggaggccctgctgtctgtgaagcaggagaaggagatccagatgaagatgattgtgaccagaggagagagcgtgctgcagaacaccagccctgagggcatccccaccatccagcagcagctgcagagcgtgaaggacatgtgggccagcctgctgtctgctggcatccgctgcaagagccagctggagggcgccctgagcaagtggaccagctaccaggatggagtgcggcagttcagcggctggatggacagcatggaggccaacctgaatgaaagtgagcggcagcacgccgagctgcgggacaagaccaccatgctgggcaaggccaagctgctgaatgaggaggtgctgagctacagcagcctgctggagaccatcgaggtgaagggagctggcatgacagagcactacgtgacccagctggagctgcaggacctgcaggagcgctaccgggccatccaggagcgggccaaggaggccgtgaccaagtctgagaagctggtgcggctgcaccaggagtaccagagggacctgaaggcctttgaggtgtggctgggccaggagcaggagaagctggaccagtacagcgtgctggagggagatgcccacacccatgagaccaccctgcgggacctgcaggagctgcaggtgcactgtgccgagggccaggccctgctgaacagcgtgctgcacacccgggaggatgtgatccccagcggcatcccccaggctgaagatcgggccctggagagcctgcggcaggactggcaggcctaccagcaccggctgtctgagaccaggacccagttcaacaacgtggtgaacaagctgcggctgatggagcagaagttccagcaggtggatgagtggctgaagacagctgaggagaagaagtggcatgaggaggtgacagcctacagagatgaggtggaggaggtgggcgcccgggcccaggagatcctggatgagagccacgtgaacagcaggatgggctgccaggccacccagctgaccagccgctaccaggccctgctgctgcaggtgctggagcagatcaagttcctggaggaggagatccagagcctggaggagagcgagagcagcctgagcagctacagcgactggtacggcagcacccacaagaacttcaagaatgtggccaccaagattgacaaggtggacacagtgatgatgggcaagaagctgaagaccctggaggtgctgctgaaggacatggagaagggccacagcctgctgaagagcgcccgggagaagggggagagagctgtgaagtacctggaggagggggaggccgagcggctgaggaaggagatccatgaccacatggagcagctgaaggagctgaccagcacagtgaggaaggagcacatgaccctggagaagggcctgcacctggccaaggagttcagtgacaagtgcaaggccctgacccagtggattgctgagtaccaggagatcctgcacgtgcctgaggagcccaagatggagctgtatgagaagaaggcccagctgagcaagtacaagagcctgcagcagacagtgctgagccatgagcccagcgtgaagtctgtgcgggagaagggggaggccctgctggagctggtgcaggatgtgaccctgaaggacaagattgaccagctgcagagcgactaccaggacctgtgcagcatcggcaaggccatgatggaggagattgctggctttgaggaccggctgaacaacctgcagatgaagggggacaccctcatcggccagtgtgccgaccacctgcaggccaagctgaagcagaatgtgcacgcccacctgcagggcaccaaggacagctacagcgccatctgcagcacagcccagaggatgtaccagagcctggagcacgagctgcagaagcacgtgtcccggcaggacaccctgcagcagtgccaggcctggctgtctgctgtgcagcctgacctggagcccagcccccagccccccctgagcagagctgaggccatcaagcaggtgaagcacttccgggccctgcaggagcaggcccggacctacctggacctgctgtgcagcatgtgtgacctgagcaatgcctctgtgaagaccacagccaaggacatccagcagacagagcagaccatcgagcagaagctggtgcaggcccagaacctgacccagggctgggaggagatcaagcacctgaagtctgagctgtggatctacctgcaggatgctgaccagcagctgcagaacatgaagagaagacacagcgagctggagctgaacatcgcccagaacatggtgtcccaggtgaaggactttgtgaagaagctgcagagcaagcaggcctctgtgaacaccatcatcgagaaggtgaacaagctgaccaagaaggaggagagccctgagcacaaggagatcaaccacctgaatgaccagtggctggacctgtgccggcagagcaacaacctgtgcctgcagcgggaggaggacctgcagaggacccgggactaccatgactgcatgaatgtggtggaggtgttcctggagaagttcaccacagagtgggacaacctggcccggagtgatgctgagagcacagctgtgcacctggaggccctgaagaagctggccctggccctgcaggagaggaaatatgccatcgaggacctgaaggaccagaagcagaagatgattgagcacctgaacctggatgacaaggagctggtgaaggagcagaccagccacctggagcagcgctggttccagctggaggacctgatcaagaggaagatccaggtgtctgtgaccaacctggaggagctgaatgtggtgcagagccgcttccaggagctgatggagtgggccgaggagcagcagcccaacattgctgaggccctgaagcagagccccccaccagacatggcccagaacctgctgatggaccacctggccatctgcagcgagctggaggccaagcagatgctgctgaagagcctcatcaaggatgctgacagagtgatggctgacctgggcctgaatgaaaggcaggtgatccagaaggccctgagtgatgcccagagccacgtgaactgcctgagtgacctggtgggccagaggaggaagtacctgaacaaggccctgtctgagaagacccagttcctgatggctgtgttccaggccaccagccagatccagcagcacgagaggaagatcatgttccgggagcacatctgcctgctgcctgatgatgtgtccaagcaggtgaagacctgcaagagcgcccaggccagcctgaagacctaccagaatgaggtgacaggcctgtgggcccagggccgggagctgatgaaggaggtgacagagcaggagaagtctgaggtgctgggcaagctgcaggagctgcagagcgtgtatgacagcgtgctgcagaagtgcagccaccggctgcaggagctggagaagaacctggtgtccaggaagcacttcaaggaggactttgacaaggcctgccactggctgaagcaggccgacatcgtgaccttccctgagatcaacctgatgaatgaatcttctgagctgcacacccagctggccaagtaccagaacatcctggagcagagcccagaatatgagaacctgctgctgaccctgcagaggacaggccagaccatcctgcccagcctgaatgaggtggaccacagctacctgtctgagaagctgaatgccctgccccggcagttcaacgtcatcgtggccctggccaaggacaagttctacaaggtgcaggaggccatcctggccaggaaggagtatgccagcctgattgagctgaccacccagagcctgtctgagctggaggcccagttcctgaggatgagcaaggtgcccacagacctggccgtggaggaggccctgagcctgcaggacggctgccgggccatcctggatgaggtggccggcctgggggaggccgtggatgagctgaaccagaagaaggagggcttccgcagcacaggccagccctggcagcctgacaagatgctgcacctggtgaccctgtaccaccggctgaagaggcagacagagcagagggtgtccctgctggaggacaccaccagcgcctaccaggagcacgagaagatgtgccagcagctggagcggcagctgaagtctgtgaaggaggagcagagcaaggtgaatgaggagaccctgcctgctgaggagaagctgaagatgtaccacagcctggccggcagcctgcaggacagcggcatcgtgctgaagagggtgaccatccacctggaggacctggccccccacctggaccccctggcctatgagaaggcccggcaccagatccagagctggcagggcgagctgaagctgctgaccagcgccatcggggagaccgtgacagaatgtgagagcaggatggtgcagagcattgacttccagacagagatgagccgcagcctggactggctgcggcgggtgaaggccgagctgagcggccctgtgtacctggacctgaacctgcaggacatccaggaggagatcaggaagatccagatccaccaggaggaggtgcagagcagcctgcgcatcatgaatgccctgagccacaaggagaaggagaagttcaccaaggccaaggagctgatctctgctgacctggagcacagcctggccgagctgtctgagctggatggagacatccaggaggccctgcggacccggcaggccaccctgacagagatctacagccagtgccagcgctactaccaggtgttccaggccgccaatgactggctggaggatgcccaggagctgctgcagctggccggaaatggcctggatgtggagagcgctgaggagaacctgaagagccacatggagttcttcagcacagaggaccagttccacagcaacctggaggagctgcacagcctggtggccaccctggaccccctcatcaagcccaccgggaaggaggacctggagcagaaggtggccagcctggagctgcggagccagaggatgagccgggacagcggggcccaggtggacctgctgcagcgctgcacagcccagtggcatgactaccagaaggcccgggaggaggtgattgagctgatgaatgacacagagaagaagctgtctgagttcagcctgctgaagaccagcagcagccatgaagctgaggagaagctgtctgagcacaaggccctggtgtctgtggtgaacagcttccacgagaagatcgtggccctggaggagaaggccagccagctggagaagacaggaaatgatgccagcaaggccaccctgagccgctccatgaccaccgtgtggcagcgctggacccggctgcgggctgtggcccaggaccaggagaagatcctggaggatgctgtggatgagtggacaggcttcaacaacaaggtgaagaaggccacagagatgattgaccagctgcaggacaagctgcccggcagcagcgctgagaaggccagcaaggccgagctgctgaccctgctggagtaccatgacacctttgtgctggagctggagcagcagcagagcgccctgggcatgctgcggcagcagaccctgtccatgctgcaggatggagctgcccccaccccaggagaggagccccccctgatgcaggagatcacagccatgcaggaccgctgcctgaacatgcaggagaaggtgaagaccaacgggaagctggtgaagcaggagctgaaggaccgggagatggtggagacccagatcaacagcgtgaagtgctgggtgcaggagaccaaggagtacctgggcaaccccaccatcgagattgatgcccagctggaggagctgcagatcctgctgacagaggccaccaaccaccggcagaacatcgagaagatggccgaggagcagaaggagaagtacctgggcctgtacaccatcctgcccagcgagctgagcctgcagctggccgaggtggccctggacctgaagatccgggaccagatccaggacaagatcaaggaggtggagcagagcaaggccaccagccaggagctgagccggcagatccagaagctggccaaggacctgaccaccatcctgaccaagctgaaggccaagacagacaacgtggtgcaggccaagacagaccagaaggtgctgggggaggagctggatggctgcaacagcaagctgatggagctggatgctgctgtgcagaagttcctggagcagaatggccagctgggcaagcccctggccaagaagattggcaagctgacagagctgcaccagcagaccatccggcaggctgaaaatcggctgagcaagctgaaccaggccgccagccacctggaggagtacaatgagatgctggagctgatcctgaagtggattgagaaggccaaggtgctggcccacggcaccatcgcctggaacagcgccagccagctgcgggagcagtacatcctgcaccagaccctgctggaggagagcaaggagattgacagcgagctggaggccatgacagagaagctgcagtacctgacctctgtgtactgcacagagaagatgagccagcaggtggccgagctgggccgggagacagaggagctgcggcagatgatcaagatccggctgcagaacctgcaggatgctgccaaggacatgaagaagtttgaggccgagctgaagaagctgcaggccgccctggagcaggcccaggccaccctgaccagccctgaggtgggccgcctgagcctgaaggagcagctgagccaccggcagcacctgctgtctgagatggagagcctgaagcccaaggtgcaggccgtgcagctgtgccagagcgccctgcgcatcccagaagatgtggtggccagcctgcccctgtgccacgccgccctgcggctgcaggaggaggccagccggctgcagcacacagccatccagcagtgcaacatcatgcaggccgctgtggtgcagtatgagcagtatgagcaggagatgaagcacctgcagcagctgattgaaggagcccaccgggagattgaggacaagcctgtggccaccagcaacatccaggagctgcaggcccagatcagcagacatgaggagctggcccagaagatcaagggctaccaggagcagatcgccagcctgaacagcaagtgcaagatgctgaccatgaaggccaagcacgccaccatgctgctgactgtgacagaggtggagggcctggccgagggcacagaggacctggatggagagctgctgcccaccccatctgcccaccccagcgtggtgatgatgacagctggccgctgccacaccctgctgagccctgtgacagaggagagcggggaggagggcaccaacagcgagatcagcagccccccagcctgccgcagccccagccctgtggccaacacagatgcctctgtgaaccaggacatcgcctactaccaggccctgtctgctgagcggctgcagacagatgctgccaagatccaccccagcaccagcgccagccaggagttctatgagcccggcctggagcccagcgccacagccaagctgggggacctgcagaggtcctgggagaccctgaagaatgtcatcagcgagaagcagaggaccctgtatgaggccctggagcggcagcagaagtaccaggacagcctgcagagcatcagcaccaagatggaggccatcgagctgaagctgtctgagagccctgagcccggccgcagccctgagagccagatggccgagcaccaggccctgatggatgagatcctgatgctgcaggatgagatcaatgagctgcagagcagcctggccgaggagctggtgtctgagagctgtgaggccgaccctgctgagcagctggccctgcagagcaccctgactgtgctggccgagaggatgagcaccatccgcatgaaggccagcggcaagaggcagctgctggaggagaagctgaatgaccagctggaggagcagaggcaggagcaggccctgcagcgctaccgctgtgaggctgatgagctggacagctggctgctgagcaccaaggccaccctggacacagccctgagcccccccaaggagcccatggacatggaggcccagctgatggactgccagaacatgctggtggagattgagcagaaggtggtggccctgtctgagctgtctgtgcacaatgaaaacctgctgctggagggcaaggcccacaccaaggatgaagctgagcagctggccggcaagctgcggcggctgaagggcagcctgctggagctgcagagggccctgcatgacaagcagctgaacatgcagggcacagcccaggagaaggaggagagtgatgtggacctgacagccacccagagccctggggtgcaggagtggctggcccaggcccggaccacctggacccagcagaggcagagcagcctgcagcagcagaaggagctggagcaggagctggccgagcagaagagcctgctgcggtctgtggccagcagaggagaggagatcctgatccagcacagcgctgctgagaccagcggagatgctggggagaagccagatgtgctgagccaggagctgggcatggagggggagaagagcagcgctgaggaccagatgaggatgaagtgggagagcctgcaccaggagttcagcaccaagcagaagctgctgcagaatgtgctggagcaggagcaggagcaggtgctgtacagccggcccaaccggctgctgtctggagtgcccctgtacaagggagatgtgcccacccaggacaagtctgctgtgaccagcctgctggatggcctgaaccaggcctttgaggaggtgagcagccagagcggcggggccaagaggcagagcatccacctggagcagaagctgtatgatggagtgtctgccaccagcacctggctggatgatgtggaggagcggctgtttgtggccacagccctgctgcctgaggagacagagacctgcctcttcaaccaggagatcctggccaaggacatcaaggagatgtctgaggagatggacaagaacaagaacctcttcagccaggccttcccagaaaatggagacaacagagatgtgattgaggacaccctgggctgcctgctgggccgcctgagcctgctggacagcgtggtgaaccagcgctgccaccagatgaaggagcggctgcagcagatcctgaacttccagaatgacctgaaggtgctcttcaccagcctggccgacaacaagtacatcatcctgcagaagctggccaacgtgtttgagcagcctgtggccgagcagatcgaggccatccagcaggctgaagatggcctgaaggagtttgatgctggcatcatcgagctgaagagaagaggagacaagctgcaggtggagcagcccagcatgcaggagctgagcaagctgcaggacatgtatgatgagctgatgatgatcatcggcagccgccgcagcggcctgaaccagaacctgaccctgaagagccagtatgaaagagccctgcaggacctggccgacctgctggagaccggccaggagaagatggccggggaccagaagatcatcgtgagcagcaaggaggagatccagcagctgctggacaagcacaaggagtacttccagggcctggagagccacatgatcctgacagagaccctcttcaggaagatcatcagctttgctgtgcagaaggagacccagttccacacagagctgatggcccaggccagcgctgtgctgaagagggcccacaagaggggcgtggagctggagtacatcctggagacctggagccacctggatgaggaccagcaggagctgagccggcagctggaggtggtggagagcagcatccccagcgtgggcctggtggaggagaatgaagatcggctgattgaccgcatcaccctgtaccagcacctgaagagcagcctgaatgagtaccagcccaagctgtaccaggtgctggatgatggcaagaggctgctgatcagcatcagctgcagcgacctggagagccagctgaaccagctgggggagtgctggctgagcaacaccaacaagatgagcaaggagctgcaccggctggagaccatcctgaagcactggacccgctaccagagcgagagcgctgacctgatccactggctgcagagcgccaaggaccggctggagttctggacccagcagagcgtgacagtgccccaggagctggagatggtgcgggaccacctgaatgccttcctggagttcagcaaggaggtggatgcccagagcagcctgaagagctctgtgctgagcactggaaaccagctgctgcggctgaagaaggtggacacagccaccctgcggtctgagctgagcagaattgacagccagtggacagacctgctgaccaacatcccagctgtgcaggagaagctgcaccagctgcagatggacaagctgcccagcagacatgccatcagcgaggtgatgtcctggatcagcctgatggagaatgtcatccagaaggatgaggacaacatcaagaacagcatcggctacaaggccatccacgagtacctgcagaagtacaagggcttcaagattgacatcaactgcaagcagctgactgtggactttgtgaaccagagcgtgctgcagatcagcagccaggatgtggagagcaagagaagtgacaagacagactttgctgagcagctgggcgccatgaacaagtcctggcagatcctgcagggcctggtgacagagaagatccagctgctggagggcctgctggagagctggagcgaatatgaaaataatgtgcagtgcctgaagacctggtttgagacccaggagaagaggctgaagcagcagcaccgcatcggggaccaggcctctgtgcagaatgccctgaaggactgccaggacctggaggacctgatcaaggccaaggagaaggaggtggagaagattgagcagaatggcctggccctgatccagaacaagaaggaggatgtgagcagcatcgtgatgagcaccctgcgggagctgggccagacctgggccaacctggaccacatggtgggccagctgaagatcctgctgaagtctgtgctggaccagtggagcagccacaaggtggcctttgacaagatcaacagctacctgatggaggcccgctacagcctgagccgcttccggctgctgaccggcagcctggaggccgtgcaggtgcaggtggacaacctgcagaacctgcaggatgacctggagaagcaggagaggagcctgcagaagtttggcagcatcaccaaccagctgctgaaggagtgccacccccctgtgacagagaccctgaccaacaccctgaaggaggtgaacatgcgctggaacaacctgctggaggagattgctgagcagctgcagagcagcaaggccctgctgcagctgtggcagcgctacaaggactacagcaagcagtgtgccagcacagtgcagcagcaggaggacaggaccaatgagctgctgaaggccgccaccaacaaggacattgctgatgatgaggtggccacctggatccaggactgcaatgacctgctgaagggcctgggcaccgtgaaggacagcctcttcttcctgcacgagctgggggagcagctgaagcagcaggtggatgccagcgctgccagcgccatccagagcgaccagctgagcctgagccagcacctgtgtgccctggagcaggccctgtgcaagcagcagaccagcctgcaggccggcgtgctggactatgagacctttgccaagagcctggaggccctggaggcctggatcgtggaggccgaggagatcctgcagggccaggaccccagccacagcagtgacctgagcaccatccaggagaggatggaggagctgaagggccagatgctgaagttcagctccatggccccagacctggaccggctgaatgagctgggctaccgcctgcccctgaatgacaaggagatcaagaggatgcagaacctgaacagacactggagcctcatcagcagccagaccacagagcgcttcagcaagctgcagagcttcctgctgcagcaccagaccttcctggagaagtgtgagacctggatggagttcctggtgcagacagagcagaagctggccgtggagatcagcggcaactaccagcacctgctggagcagcagagggcccacgagctgttccaggccgagatgttcagccggcagcagatcctgcacagcatcatcattgatggccagaggctgctggagcagggccaggtggatgacagagatgagttcaacctgaagctgaccctgctgagcaaccagtggcagggcgtcatccggcgggcccagcagaggcggggcatcatcgacagccagatccggcagtggcagcgctaccgggagatggccgagaagctgaggaagtggctggtggaggtgtcctacctgcccatgagcggcctgggctctgtgcccatccccctgcagcaggcccggaccctgtttgatgaggtgcagttcaaggagaaggtgttcctgcggcagcagggcagctacatcctgactgtggaggccggcaagcagctgctgctgtctgctgacagcggggctgaggccgccctgcaggccgagctggccgagatccaggagaagtggaagagcgcctccatgaggctggaggagcagaagaagaagctggccttcctgctgaaggactgggagaagtgtgagaagggcattgctgacagcctggagaagctgcggaccttcaagaagaagctgagccagagcctgcctgaccaccacgaggagctgcacgccgagcagatgcgctgcaaggagctggagaatgctgtgggctcctggacagatgacctgacccagctgagcctgctgaaggacaccctgagcgcctacatctctgcagatgacatcagcatcctgaatgaaagagtggagctgctgcagaggcagtgggaggagctgtgccaccagctgagcctgcggcggcagcagatcggggagcggctgaatgagtgggccgtgttttctgagaagaacaaggagctgtgtgagtggctgacccagatggagagcaaggtgtcccagaatggagacatcctgattgaggagatgattgagaagctgaagaaggactaccaggaggagatcgccatcgcccaggagaacaagatccagctgcagcagatgggagagcggctggccaaggccagccatgagagcaaggccagcgagattgagtacaagctgggcaaggtgaatgaccgctggcagcacctgctggacctgattgctgcccgggtgaagaagctgaaggagaccctggtggccgtgcagcagctggacaagaacatgagcagcctgcggacctggctggcccacattgaaagtgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagtggagtcatctacacagtggccaaggaggagctgaagaagtttgaggccttccagaggcaggtgcatgagtgcctgacccagctggagctgatcaacaagcagtacagaaggctggcccgggagaacagaacagattctgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagtgatgtgatgatccctgagagccctgaggcctacgtgaagctgacagaaaatgccatcaagaacaccagcggggaccacagcgccctggagagccagatccggcagctgggcaaggccctggatgacagccgcttccagatccagcagacagagaacatcatccgcagcaagacccccaccggccctgagctggacaccagctacaagggctacatgaagctgctgggagaatgtagcagcagcattgacagcgtgaagaggctggagcacaagctgaaggaggaggaggagagcctgcccggctttgtgaacctgcacagcacagagacccagacagctggggtcatcgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgagatcgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccgctccttccaccccatgctgcgctacaccaacggccccccacccctgtag

SEQ ID NO: 171275 - DNA, 2859 bp, Artificial Sequence
  Description of Artificial Sequence: Synthetic coding sequence
atggtggtggccgaggacctgagcgccctgaggatggccgaggacagctgtgtggatgctgacctgcctgactgcaactgtgatgtgaccagggtgaagaagctgaaggagaccctggtggccgtgcagcagctggacaagaacatgagcagcctgcggacctggctggcccacattgaaagtgagctggccaagcccatcgtgtatgacagctgcaacagcgaggagatccagaggaagctgaatgagcagcaggagctgcagagggacatcgagaagcacagcactggagtggcctctgtgctgaacctgtgtgaggtgctgctgcatgactgtgatgcctgtgccacagatgctgaatgtgacagcatccagcaggccaccaggaacctggaccggcgctggaggaacatctgtgccatgtccatggagcggcggctgaagattgaggagacctggaggctgtggcagaagttcctggatgactacagcagatttgaggactggctgaagagcagcgagaggacagctgccttccccagcagcagtggagtcatctacacagtggccaaggaggagctgaagaagtttgaggccttccagaggcaggtgcatgagtgcctgacccagctggagctgatcaacaagcagtacagaaggctggcccgggagaacagaacagattctgcctgcagcctgaagcagatggtgcatgagggcaaccagcgctgggacaacctgcagaagagggtgaccagcatcctgcggcggctgaagcacttcatcggccagcgggaggagtttgaaacagcccgggacagcatcctggtgtggctgacagagatggacctgcagctgaccaacatcgagcacttctctgaatgtgatgtgcaggccaagatcaagcagctgaaggccttccagcaggagatcagcctgaaccacaacaagattgagcagatcatcgcccagggcgagcagctgattgagaagtctgagcccctggatgctgccatcatcgaggaggagctggatgagctgcggcgctactgccaggaggtgtttggccgggtggagcgctaccacaagaagctgatccggctgcccctgcctgatgatgaacatgacctgagtgaccgggagctggagctggaggacagcgctgccctgagtgacctgcactggcatgacagatctgctgacagcctgctgagcccccagcccagcagcaacctgagcctgagcctggcccagcccctgcggtctgagaggagcggccgggacaccccagcctctgtggacagcatccccctggagtgggaccatgactatgacctgagccgggacctggagagcgccatgagccgggccctgcccagtgaagatgaggagggccaggatgacaaggacttctacctgcggggagctgtgggcctgagcggggaccacagcgccctggagagccagatccggcagctgggcaaggccctggatgacagccgcttccagatccagcagacagagaacatcatccgcagcaagacccccactggacctgagctggacaccagctacaagggctacatgaagctgctgggggagtgcagcagcagcattgattctgtgaagaggctggagcacaagctgaaggaggaggaggagagcctgcccggctttgtgaacctgcacagcacagagacccagacagctggggtgattgaccgctgggagctgctgcaggcccaggccctgagcaaggagctgaggatgaagcagaacctgcagaagtggcagcagttcaacagcgacctgaacagcatctgggcctggctgggggacacagaggaggagctggagcagctgcagaggctggagctgagcacagacatccagaccatcgagctgcagatcaagaagctgaaggagctgcagaaggctgtggaccacaggaaggccatcatcctgagcatcaacctgtgcagccctgagttcacccaggccgacagcaaggagagccgggacctgcaggaccggctgagccagatgaatggccgctgggacagagtgtgcagcctgctggaggagtggaggggcctgctgcaggatgccctgatgcagtgccagggcttccacgagatgagccacggcctgctgctgatgctggagaacatcgacaggaggaagaatgaaattgtgcccatcgacagcaacctggatgctgagatcctgcaggaccaccacaagcagctgatgcagatcaagcatgagctgctggagagccagctgcgggtggccagcctgcaggacatgagctgccagctgctggtgaatgctgagggcacagactgcctggaggccaaggagaaggtgcacgtgattggcaaccggctgaagctgctgctgaaggaggtgagccgccacatcaaggagctggagaagctgctggatgtgagcagcagccagcaggacctgagctcctggagcagcgcagatgagctggacaccagcggctctgtgagccccaccagcggccgcagcacccccaaccggcagaagaccccccggggcaagtgcagcctgagccagcccggccccagcgtgagcagcccccacagccgcagcaccaagggcggcagtgacagcagcctgtctgagcccggccctggccgcagcggccggggcttcctgttccgggtgctgcgggccgccctgcccctgcagctgctgctgctgctgctgattggcctggcctgcctggtgcccatgtctgaggaggactacagctgtgccctgagcaacaactttgcccggagcttccaccccatgctgcgctacaccaatggacctccacccctgtag

SEQ ID NO: 171276 - DNA, 20475 bp, Artificial Sequence
  Description of Artificial Sequence: Synthetic coding sequence
atggccagcagccctgagctgcccacagaagatgagcagggctcctggggcattgatgacctgcacatcagcctgcaggccgagcaggaggacacccagaagaaggccttcacctgctggatcaacagccagctggcccggcacaccagccccagcgtcatcagtgacctcttcacagacatcaagaagggccacgtgctgctggacctgctggaggtgctgagcggccagcagctgccccgggacaagggcagcaacaccttccagtgccgcatcaacatcgagcacgccctgaccttcctgaggaacagaagcatcaagctgatcaacatccacgtgacagacatcattgatggcaaccccagcatcatcctgggcctcatctggaccatcatcctgcacttccacatcgagaagctggcccagaccctgagctgcaactacaaccagcccagcctggatgatgtgtctgtggtggacagcagccctgccagcagccccccagccaagaagtgcagcaaggtgcaggcccgctggcagatgtctgccaggaaggccctgctgctgtgggcccaggagcagtgtgccacctatgagagcgtgaatgtgacagacttcaagagctcctggagaaatggcatggccttcctggccatcatccacgccctgcggccagacctgattgacatgaagtctgtgaagcacaggagcaacaaggacaacctgcgggaggccttcagaattgctgagcaggagctgaagatcccccggctgctggagccagaagatgtggatgtggtggaccctgatgagaagagcatcatgacctacgtggcccagttcctgcagtacagcaaggatgcccctggcactggagaggaggcccagggcaaggtgaaggatgccatgggctggctgaccctgcagaaggagaagctgcagaagctgctgaaggacagtgaaaatgacacctacttcaagaagtacaacagcctgctgtccttcatggagagcttcaatgaggagaagaagagcttcctggatgtgctgagcatcaagagggacctggatgagctggacaaggaccacctgcagctgcgggaggcctgggatggcctggaccaccagatcaatgcctggaagatcaagctgaactatgccctgcccccacccctgcaccagacagaggcctggctgcaggaggtggaggagctgatggatgaggacctgagcgccagccaggaccacagccaggccgtgaccctcatccaggagaagatgaccctcttcaagagcctgatggacagatttgagcaccacagcaacatcctgctgacctttgagaacaaggatgagaaccacctgcccctggtgccccccaacaagctggaggagatgaagaggcgcatcaacaacatcctggagaagaagttcatcctgctgctggagttccactactacaagtgcctggtgctgggcctggtggatgaggtgaagagcaagctggacatctggaacatcaagtatggcagccgggagagcgtggagctgctgctggaggactggcacaagttcatcgaggagaaggagttcctggcccggctggacaccagcttccagaagtgtggggagatctacaagaacctggccggggagtgccagaacatcaacaagcagtacatgatggtgaagagtgatgtgtgcatgtacaggaagaacatctacaacgtgaagagcaccctgcagaaggtgctggcctgctgggccacctacgtggagaacctgcggctgctgcgggcctgctttgaggagaccaagaaggaggagatcaaggaggtgccctttgagaccctggcccagtggaacctggagcacgccaccctgaatgaagctggcaacttcctggtggaggtgtccaatgatgtggtgggcagcagcatcagcaaggagctgcggcggctgaacaagcgctggaggaagctggtgtccaagacccagctggagatgaacctgcccctgatgatcaagaagcaggaccagcccacctttgacaacagcggcaacatcctgagcaaggaggagaaggccaccgtggagttcagcacagacatgtctgtggagctgcctgagaactacaaccagaacatcaaggccggggagaagcatgagaaggaaaatgaggagttcaccggccagctgaaggtggccaaggatgtggagaagctgattggccaggtggagatctgggaggccgaggccaagtctgtgctggaccaggatgatgtggacacctccatggaggagagcctgaagcacctgattgccaagggctccatgtttgatgagctgatggcccggtctgaggacatgctgcagatggacatccagaacatcagcagccaggagagcttccagcacgtgctgaccaccggcctgcaggccaagatccaggaggccaaggagaaggtgcagatcaacgtggtgaagctgattgctgccctgaagaacctgacagatgtgtccccagacctggacatccggctgaagatggaggagagccagaaggagctggagagctacatgatgagggcccagcagctgctgggccagcgggagagccctggagagctgatcagcaagcacaaggaggccctgatcatcagcaacaccaagagcctggccaagtacctgaaggctgtggaggagctgaagaacaacgtgacagaggacatcaagatgagcctggaggagaagagcagagatgtgtgtgccaagtgggagagcctgcaccacgagctgagcctgtatgtgcagcagctgaagattgacatcgagaagggcaagctgagtgacaacatcctgaagctggagaagcagatcaacaaggagaagaagctgatccggcggggccgcaccaagggcctcatcaaggagcacgaggcctgcttcagcgaggagggctgcctgtaccagctgaaccaccacatggaggtgctgcgggagctgtgtgaggagctgcccagccagaagagccagcaggaggtgaagaggctgctgaaggactatgagcagaagattgaaaggctgctgaagtgtgccagcgagatccacatgaccctgcagcccacagctgggggcaccagcaagaatgaaggcaccatcaccaccagcgagaacagaggaggagacccccacagcgaggccccctttgccaagagtgacaaccagcccagcacagagaaggccatggagcccaccatgaagttcagcctggcctctgtgctgcggcccctgcaggaggagagcatcatggagaaggactacagcgccagcatcaacagcctgctggagagatatgacacctacagagacatcctggagcaccacctgcagaacaacaagttccgcatcaccagtgacttcagcagtgaagaagatagaagcagcagctgcctgcaggccaagctgacagacctgcaggtgatcaagaatgaaacagatgcccgctggaaggagtttgagatcatcagcctgaagctggagaaccacgtgaatgacatcaagaagccctttgtgatcaaggagcgggacaccctgaaggagcgggagcgggagctgcagatgaccctgaacaccaggatggagagcctggagacagccctgcggctggtgctgcctgtggagaaggccagcctgctgctgtgtggcagtgacctgcccctgcacaagatggccatccagggcttccacctgattgatgctgaccgcatctaccagcacctgaggaacatccaggacagcatcgccaagcagatcgagatctgcaaccggctggaggagcccggcaactttgtgctgaaggagctgcacccctttgacctgcacgccatgcagaacatcatcctgaagtacaagacccagtttgagggcatgaaccaccgggtgcagaggtctgaggacaccctgaaggccctggaggacttcctggccagcctgaggacagccaagctgtctgctgagcctgtgacagacctgagcgccagtgacacccaggtggcccaggagaacaccctgactgtgaagaacaaggagggggagatccacctgatgaaggacaaggccaagcacctggacaagtgcctgaagatgctggacatgtccttcaaggatgctgagagaggagatgacaccagctgtgagaacctgctggatgccttcagcatcaagctgtctgagacccacggctacggcgtgcaggaggagttcacagaggagaacaagctgctggaggcctgcatcttcaagaacaatgagctgctgaagaacatccaggatgtgcagagccagatcagcaagattggcctgaaggaccccaccgtgcctgctgtgaagcacaggaagaagagcctcatccggctggacaaggtgctggatgaatatgaggaggagaagaggcacctgcaggagatggccaacagcctgccccacttcaaggatggccgggagaagacagtgaaccagcagtgccagaacacagtggtgctgtgggagaacaccaaggccctggtgacagaatgtctggagcagtgtggccgggtgctggagctgctgaagcagtaccagaacttcaagagcatcctgaccaccctcatccagaaggaggagagcgtcatcagcctgcaggccagctacatgggcaaggagaacctgaagaagagaattgctgagattgaaattgtgaaggaggagttcaatgagcacctggaggtggtggacaagatcaaccaggtgtgcaagaacctgcagttctacctgaacaagatgaagacctttgaggagcccccatttgagaaggaggccaacatcatcgtggaccgctggctggacatcaatgagaagacagaggactactatgagaacctgggccgggccctggccctgtgggacaagctgttcaacctgaagaatgtgattgatgagtggacagagaaggccctgcagaagatggagctgcaccagctgacagaagaagatcgggagcggctgaaggaggagctgcaggtgcatgagcagaagaccagcgagttcagccggcgggtggccgagatccagttcctgctgcagagcagcgagatccccctggagctgcaggtgatggagagcagcatcctgaacaagatggagcacgtgcagaagtgcctgactggagagagcaactgccacgccctgagcggcagcacagctgagctgcgggaggacctggaccaggccaagacccagatcggcatgacagagagcctgctgaaggccctgagccccagcgacagcctggagatcttcaccaagctggaggagatccagcagcagatcctgcagcagaagcacagcatgatcctgctggagaaccagatcggctgcctgaccccagagctgtctgagctgaagaagcagtatgagagcgtgtctgacctcttcaacaccaagaagtctgtgctgcaggaccacttcagcaagctgctgaatgaccagtgcaagaacttcaatgactggttcagcaacatcaaggtgaacctgaaggagtgctttgagagcagcgagaccaagaagtctgtggagcagaagctgcagaagctgagtgacttcctgaccctggagggcaggaacagcaagatcaagcaggtggacagcgtgctgaagcacgtgaagaagcacctgcccaaggcccacgtgaaggagctgatctcctggctggtgggccaggagtttgagctggagaagatggagagcatctgccaggcccgggccaaggagctggaggacagcctgcagcagctgctgcggctgcaggatgaccacaggaacctgaggaagtggctgaccaaccaggaggagaagtggaagggcatggaggagcccggggagaagacagagctgttctgccaggccctggccaggaagcgggagcagtttgagagcgtggcccagctgaacaacagcctgaaggagtatggcttcacagaggaggaggagatcatcatggaggccacctgcctgatggaccgctaccagaccctgctgcggcagctgtctgaaattgaggaggaggacaagctgctgcccacagaggaccagagcttcaatgacctggcccatgatgtgatccactggatcaaggagatcaaggagagcctgatggtgctgaacagcagcgagggcaagatgcccctggaggagcgcatccagaagatcaaggagatcatcctgctgaagccagaaggagatgccagaattgagaccatcatgaagcaggccgagagcagcgaggcccccctggtgcagaagaccctgacagacatcagcaaccagtgggacaacaccctgcacctggccagcacctacctgagccaccaggagaagctgctgctggagggggagaagtacctgcagagcaaggaggacctgcggctgatgctgattgagctgaagaagaagcaggaggccggctttgccctgcagcacggcctgcaggagaagaaggcccagctgaagatctacaagaagttcctgaagaaggcccaggacctgaccagcctgctgaaggagctgaagagccagggcaactacctgctggagtgcaccaagaaccccagcttcagcgaggagccctggctggagatcaagcacctgcacgagagcctgctgcagcagctgcaggacagcgtgcagaacctggatggccacgtgcgggagcatgacagctaccaggtgtgtgtgacagacctgaacaccaccctggacaacttcagcaaggagtttgtgtccttcagtgacaagcctgtggaccagattgctgtggaggagaagctgcagaagctgcaggagctggagaaccggctgagcctgcaggacggcaccctgaagaagatcctggccctggccaagtctgtgaagcagaacaccagctctgtgggccagaagatcatcaaggatgacatcaagagcctgcagtgcaagcagaaggacctggagaaccggctggccagcgccaagcaggagatggagtgctgcctgaacagcatcctgaagagcaagaggagcacagagaagaagggcaagttcaccctgcccggccgggagaagcaggccaccagtgatgtgcaggagagcacccaggagagcgctgctgtggagaagctggaggaggactgggagatcaacaagaactttgtggagaatgtgatggctgtgtccaagaactgccaccacagcatgtacatctttgagagcatcgtgaagaacttcatcagtgatgagatgcaggacagcgctgtggagatggccatgagcaagcagctgagcctgaatgcccaggagagcatgaagaacacagaagatgagaggaaggtgaatgagctgcagaaccagcccctggagctggacaccatgctgagaaatgagcagctggaggagattgagaagctgtacacccagctggaggccaagaaggccgccatcaagcccctggagcagacagagtgcctgaacaagacagaaacaggagccctggtgctgcacaacatcggctacagcgcccagcacctggacaacctgctgcaggccctgatcaccctgaagaagaacaaggagagccagtactgtgtgctgcgggacttccaggagtacctggccgctgtggagagctccatgaaggccctgctgacagacaaggagagcctgaaggtgggccccctggacagcgtgacctacctggacaagatcaagaagttcatcgccagcattgagaaggagaaggacagcctgggcaacctgaagatcaagtgggagaacctgagcaaccacgtgacagacatggacaagaagctgctggagagccagatcaagcagctggagcacggctgggagcaggtggagcagcagatccagaagaagtacagccagcaggtggtggagtatgatgagttcaccaccctgatgaacaaggtgcaggacacagagatcagcctgcagcagcagcagcagcacctgcagctgcggctgaagagccctgaggagagagctggcaaccagagcatgattgccctgaccacagacctgcaggccaccaagcacggcttctctgtgctgaagggccaggccgagctgcagatgaagaggatctggggcgagaaggagaagaagaacctggaggatggcatcaacaacctgaagaagcagtgggagaccctggagcccctgcacctggaggccgagaaccagatcaagaagtgtgacatccggaacaagatgaaggagaccatcctgtgggccaagaacctgctgggggagctgaaccccagcatccccctgctgcctgatgacatcctgagccagatcaggaagtgcaaggtgacccatgatggcatcctggcccggcagcagagcgtggagagcctggccgaggaggtgaaggacaaggtgcccagcctgaccacctatgagggcagtgacctgaacaacaccctggaggacctgaggaaccagtaccagatgctggtgctgaagagcacccagaggagccagcagctggagttcaagctggaggagaggagcaacttctttgccatcatcaggaagttccagctgatggtgcaggagagcgagaccctcatcatcccccgggtggagacagctgccacagaagctgagctgaagcaccaccacgtgaccctggaggccagccagaaggagctgcaggagattgacagcggcatcagcacccacctgcaggagctgaccaacatctatgaggagctgaatgtgtttgagcggctcttcctggaggaccagctgaagaacctgaagatccgcaccaaccgcatccagcgcttcatccagaacacctgcaatgaggtggagcacaagatcaagttctgccggcagttccacgagaagaccagcgccctgcaggaggaggccgacagcatccagagaaatgagctgctgctgaaccaggaggtgaacaagggcgtgaaggaggagatctacaacctgaaggaccggctgacagccatcaagtgctgcatcctgcaggtgctgaagctgaagaaggtgtttgactacatcggcctgaactgggacttcagccagctggaccagctgcagacccaggtgtttgagaaggagaaggagctggaggagaagatcaagcagctggacacctttgaggaggagcacggcaagtaccaggccctgctgagcaagatgagggccatcgacctgcagatcaagaagatgacagaggtggtgctgaaggccccagacagcagccctgagagccggcggctgaatgcccagatcctgagccagagaattgagaaggccaagtgcctgtgtgatgagatcatcaagaagctgaatgaaaacaagacctttgatgacagcttcaaggagaaggagatcctgcagatcaagctgaatgctgaggagaatgacaagctgtacaaggtgctgcagaacatggtgctggagctgagccccaaggagctggatgagaagaactgccaggacaagctggagaccagcctgcacgtgctgaaccagatcaagagccagctgcagcagcccctgctgatcaacctggagatcaagcacatccagaatgagaaggacaactgtgaggccttccaggagcaggtgtgggccgagatgtgcagcatcaaggctgtgacagccatcgagaagcagcgggaggagaacagcagcgaggccagtgatgtggagaccaagctgcgggagtttgaggacctgcagatgcagctgaacaccagcattgacctgcggaccaacgtgctgaatgatgcctatgagaacctgacccgctacaaggaggccgtgaccagggctgtggagagcatcaccagcctggaggccatcatcatcccctacagagtggatgtgggcaaccctgaggagagcctggagatgcccctgaggaagcaggaggagctggagagcacagtggcccacatccaggacctgacagagaagctgggcatgatcagcagccctgaggccaagctgcagctgcagtacaccctgcaggagctggtgtccaagaacagcgccatgaaggaggccttcaaggcccaggagacagaagctgagcgctacctggagaactacaagtgctacaggaagatggaggaggacatctacaccaacctgagcaagatggagaccgtgctgggccagagcatgagcagcctgcccctgagctaccgggaggccctggagcggctggagcagagcaaggccctggtgagcaacctgatcagcaccaaggaggagctgatgaagctgcggcagatcctgcggctgctgcggctgcgctgcacagaaaatgatggcatctgcctgctgaagatcgtgtctgccctgtgggagaagtggctgagcctgctggaggccgccaaggagtgggagatgtggtgtgaggagctgaagcaggagtggaagtttgtgtctgaggagattgagcgggaggccatcatcctggacaacctgcaggaggagctgcctgagatcagcaagaccaaggaggccgccaccacagaggagctgtctgagctgctggactgcctgtgccagtacggggagaatgtggagaagcagcagctgctgctgaccctgctgctgcagaggatccgcagcatccagaatgtgcctgagagcagcggggctgtggagaccgtgcctgccttccaggagatcacctccatgaaggagcgctgcaacaagctgctgcagaaggtgcagaagaacaaggagctggtgcagacagagatccaggagcggcacagcttcaccaaggagatcatcgccctgaagaacttcttccagcagaccaccaccagcttccagaacatggccttccaggaccaccctgagaagtctgagcagtttgaggagctgcagagcatcctgaagaagggcaagctgacctttgagaacatcatggagaagctgcgcatcaagtacagcgagatgtacaccatcgtgcctgctgagattgagagccaggtggaggagtgcaggaaggccctggaggacattgatgagaagatcagcaatgaggtgctgaagagcagccccagctatgccatgaggaggaagattgaggagatcaacaacggcctgcacaacgtggagaagatgctgcagcagaagagcaagaacatcgagaaggcccaggagatccagaagaagatgtgggatgagctggacctgtggcacagcaagctgaatgagctggacagcgaggtgcaggacatcgtggagcaggaccccggccaggcccaggagtggatggacaacctgatgatccccttccagcagtaccagcaggtgtcccagagagcagaatgtaggaccagccagctgaacaaggccaccgtgaagatggaggagtacagcgacctgctgaagagcacagaggcctggattgagaacaccagccacctgctggccaacccagctgactatgacagcctgcggaccctgagccaccacgccagcacagtgcagatggccctggaggacagcgagcagaagcacaacctgctgcacagcatcttcatggacctggaggacctgagcatcatctttgaaacagatgagctgacccagagcatccaggagctgagcaaccaggtgacagccctgcagcagaagatcatggagagcctgccccagatccagaggatggctgatgatgtggtggccatcgagagcgaggtgaagtccatggagaagagggtgtccaagatcaagaccatcctgctgagcaaggagatctttgacttcagccctgaggagcacctgaagcacggggaggtgatcctggagaacatccggcccatgaagaagaccatcgccgagatcgtgtcctaccaggtggagctgcggctgccccagacaggcatgaagcccctgcccgtcttccagaggaccaaccagctgctgcaggacatcaagctgctggagaatgtgacccaggagcagaatgagctgctgaaggtggtgatcaagcagaccaatgagtgggatgaggagattgagaacctgaagcagatcctgaacaactacagcgcccagttcagcctggagcacatgagcccagaccaggccgacaagctgccccagctgcagggcgagattgaaagaatggagaagcagatcctgagcctgaaccagaggaaagaagacctgctggtggacctgaaggccaccgtgctgaacctgcaccagcacctgaagcaggagcaggagggcgtggagcgggaccggctgcctgctgtgaccagcgaggagggcggcgtggccgagagagatgccagcgagaggaagctgaacagaagaggctccatgagctacctggccgctgtggaggaggaggtggaggagagctctgtgaagagtgaccatgacaaggacatggaggaggaccgggccagcagcagcagcggcaccatcgtgcaggaggcctacggcaagatcagcaccagtgacaacagcatggcccagatcctgaccccagacagcctgaacacagagcagggccctgagtgcagcctgcggcccaaccagacagaggagggcaccaccccacccatcgaggccgacaccctggacagcagtgatgcccagggcggcctggagccccgggtggagaagaccaggcctgagcccacagaggtgctgcacgcctgcaagacccaggtggccgagctggagctgtggctgcagcaggccaacgtggccgtggagcctgagaccctgaatgctgacatgcagcaggtgctggagcagcagctggtgggctgccaggccatgctgacagaaattgagcacaaggtggccttcctgctggagacctgcaaggaccagggcctgggggacaacggggccacccagcatgaagctgaggccctgagcctgaagctgaagacagtgaagtgcaacctggagaaggtgcagatgatgctgcaggagaagcacagcgaggaccagcaccccaccatcctgaagaagagcagcgagcctgagcaccaggaggccctgcagcctgtgaacctgtctgagctggagagcatcgtgacagagcggccccagttcagccggcagaaggacttccagcagcagcaggtgctggagctgaagcccatggagcagaaggacttcatcaagttcatcgagttcaatgccaagaagatgtggccccagtactgccagcacgacaatgacaccacccaggagagcagcgcccgctaccccaccacagaggagctgaagacctacaccacccagctggaggacctgcggcaggaggccagcaacctgcagacccaggagaacatgacagaggaggcctacatcaacctggacaagaagctgtttgagctgttcctgaccctgagccagtgcctgagctctgtggaggagatgctggagatgccccggctgtaccgggaggatggcagcggccagcaggtgcactatgagaccctggccctggagctgaagaagctgtacctggccctgagtgacaagaagggggacctgctgaaggccatgacctggccaggagagaacaccaacctgctgctggagtgctttgacaacctgcaggtgtgcctggagcacacccaggccgctgctgtgtgccgcagcaagagcctgaaggccggcctggactacaacagaagctaccagaaggcagatgcctacacagtggagctggagaatgctgagagccgggtggccaagctgagagatgaaggagagcggctgcacctgccctatgccctgctgcaggaggtgtacaagctggaggatgtgctggacagcatgtggggcatgctgcgggcccgctacacagagctgagcagcccctttgtgacagagagccagcaggatgccctgctgcagggcatggtggagctggtgaagattggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaaccgggagaccttctgggccgagcaggtgacagaggtgaagatcctggaggagaagagccggcagtgtggcatgaagctgcagagcctgctgcagaagtgggaggagtttgatgagaactatgccagcctggagaaggacctggagatcctgatcagcaccctgcccagcgtgtccctggtggaggagacagaggagcggctggtggagcgcatctccttctaccagcagatcaagagaaatattggaggcaagcacgcccggctgtaccagaccctgaatgaaggcaagcagctggtggcctctgtgtcctgcccagagctggagggccagatcgccaagctggaggagcagtggctgagcctgaacaagaagattgaccacgagctgcaccggctgcaggccctgctgaagcacctgctgcggagcgccttcctgggcgtgtacaacagagacagcgaccagctgaccaagtggctggagagcagccagcacaccctgaactactggaaggagcagagcctgaatgtgtcccaggacctggacaccatccgcagcaacatcaacaacttctttgagttcagcaaggaggtggatgagaagagcagcctgaagacagctgtgatcagcatcggcaaccagctgctgcacctgaaggagacagacacagccaccctgcgggccagcctggcccagtttgagcagaagtggaccatgctgatcacccagctgcctgacatccaggagaagctgcaccagctgcagatggagaagctgcccagcaggaaggccatcacagagatgatctcctggatgaacaacgtggagcaccagaccagtgatgaagattctgtgcacagccccagcagcgccagccaggtgaagcacctgctgcagaagcacaaggagttcaggatggagatggactacaagcagtggatcgtggactttgtgaaccagagcctgctgcagctgagcacctgtgatgtggagagcaagagatatgaaagaacagaatttgctgagcacctgggggagatgaaccggcagtggcaccgggtgcacggcatgctgaacaggaagatccagcacctggagcagctgctggagagcatcacagaaagtgagaacaagatccagatcctgaacaactggctggaggcccaggaggagcggctgaagaccctgcagaagccagagagcgtcatctctgtgcagaagctgctgctggactgccaggacatcgagaaccagctggccatcaagagcaaggccctggatgagctgaagcagagctacctgaccctggagagcggggctgtgcccctgctggaggacacagccagcagaattgatgagctgttccagaagaggagctctgtgctgacccaggtgaaccagctgaagacctccatgcagagcgtgctgcaggagtggaagatctatgaccagctgtatgatgaggtgaacatgatgaccatccgcttctggtactgcatggagcacagcaagcctgtggtgctgagcctggagaccctgcgctgccaggtggagaacctgcagagcctgcaggatgaggccgagagcagcgagggctcctgggagaagctgcaggaggtgattggcaagctgaagggcctgtgccccagcgtggccgagatcatcgaggagaagtgccagaacacccacaagcgctggacccaggtgaaccaggccatcgctgaccagctgcagaaggcccagagcctgctgcagctgtggaaggcctacagcaatgcccatggagaggccgccgcccggctgaagcagcaggaggccaagttccagcagctggccaacatctccatgagcggcaacaacctggccgagatcctgcccccagccctgcaggacatcaaggagctgcagcatgatgtgcagaagaccaaggaggccttcctgcagaacagctctgtgctggaccggctgccccagcctgctgagagcagcacccacatgctgctgcccggccccctgcacagcctgcagagagctgcctacctggagaagatgctgctggtgaaggccaatgaatttgagaaccacgtgctggccctgacagcccagagcccagacatcgagcacctgaatgaggtgtccctgaagctgcccctgagtgatgtggccgtgaagaccctgcagaacatgaaccggcagtggatccgggccacagccacagccctggagcgctgcagcgagctgcagggcatcggcctgaatgagaagttcctgtactgctgtgagaagtggatccagctgctggagaagattgaggaggccctgaaggtggatgtggccaacagcctgcctgagctgctggagcagcagaagacctacaagatgctggaggccgaggtgtccatcaaccagaccatcgctgacagctatgtgacccagagcctgcagctgctggacaccacagaaattgagaacagacctgagttcatcacagagttcagcaagctgacagaccgctggcagaatgctgtgcagggcgtgcggcagaggaaaggagatgtggatggcctgaatgcccacgtggcccgctgtggcggggccagcctgaagaagcaggacctgcgctacagcctgcacacagcctgtggggccgccctgctgtgccgcagcagccacggggccaacaaggagatccacttccagaggaggaggaccacctgtgccctgaccctggaggccggggagaagctgctgctgaccacagacctgaagaccaaggagagcgtgggccgccgcatcagccagctgcaggacagctggaaggacatggagccccagctggccgagatgatcaagcagttccagagcacagtggagacctgggaccagtgtgagaagaagatcaaggagctgaagagccggctgcaggtgctgaaggcccagagcgaggaccccctgcctgagctgcacgaggacctgcacaatgagaaggagctgatcaaggtggccatcaggaagcaggagattgaggaccggctgaacacctgggtggtgttcaatgagaagaacaaggagctgtgtgcctggctggtgcagatggagaacaaggtgctgcagacagctgacatcagcattgaggagatgattgagaagctgcagaagaggacagtgggccgggaggaggtgcctgagcgctgggagtgtgagaccatcgtgtctggccatggaacagaggagagctgcttcctgagcatcaggaagttccaccagggccggggcctgcacatcctgacctgccagctgatcccccaggactgcatggaggagatcaacctcttcagcgagaacaagctgcagctgaagcagatgggagaccagctgatcaaggccagcaacaagagcagagctgctgagattgatgacaagctgaacaagatcaatgaccgctggcagcacctgtttgatgtgattggcagctccatggctgaccagaccaacagccgctggatgttcttccagtggccccggggcatccagaggacagtgacctggccctgggaccacctgtgcagctgtgccagcacaggccacacaggccccttccacagctctgtgctgcgctgctttgagcagcacattgaatttggcatctacagaaggacctacaaggtgaacaaggagctgggcggggacaagaatggccagcgctgccccatcatctacccccacggcctggtgcagtgcatccggctgggggagcccctcatcctgaagagggtgaagaagctgaaggagacctttgccttcatccagcagctggacaagaacatgagcaacctgcggacctggctggccagaattgaaagtgagctgagcaagcctgtggtgtatgatgtgtgtgatgaccaggagatccagaagaggctggccgagcagcaggacctgcagagggacatcgagcagcacagcgctggggtggagagcgtcttcaacatctgtgatgtgctgctgcatgacagtgatgcctgtgccaatgaaacagaatgtgacagcatccagcagaccaccaggagcctggaccggcgctggaggaacatctgtgccatgtccatggagaggaggatgaagattgaggagacctggaggctgtggcagaagttcctggatgactacagcagatttgaggactggctgaagtctgctgagaggacagctgcctgccccaacagcagcgaggtgctgtacaccagcgccaaggaggagctgaagagatttgagcggcagatccacgagcggctgacccagctggagctgatcaacaagcagtaccgccgcctggccagagaaaatagaacagacacagccagccggctgaagcagatggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggagggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaagaagatgaggagggcccctactacagcgccctgagcggcaagagcatcagtgatggccacagctggcacgtgcctgacagccccagctgcccagagcaccactacaagcagatggagggggacagaaatgtgccccctgtgcccccagccagcagcaccccctacaagccaccctacgtgtccctgaacttcaccggcagcacagcctacgtgtgtgcctttgaccgctgggagatgatccaggcccaggagctgcacaacaagctgaagatcaagcagaacctgcagcagctgaacagcgacatcagcgccatcaccacctggctgaagaagacagaggccgagctggagatgctgaagatggccaagccacccagcgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgcagaagagagctgatgcagctggagaaggagctggtggagcggcagccccaggtggacatgctgcaggagatcagcaacagcctgctgatcaagggccatggagaggactgcatcgaggccgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagttcctgtacccagctgtgcagagcagcgagaactacagaagaagaggaggagaccgggagcagggcccccggcagcacacagccacagccctgctgcccctgaagggcggccctggcagccccaccccagctgctgcccctcctgctgctgctgcccctggcctgcctgctgccctgctgcggcggcggctgcagctgcacagcggccagcagctgtgccctgtgctgctgccccacgccgaggtgcaccagtgggccaccccccacatcgagggcattgctggccacagcgccaccccaccagcctag

SEQ ID NO: 171277 - DNA, 20658 bp, Artificial Sequence
  Description of Artificial Sequence: Synthetic coding sequence
atggccagcagccctgagctgcccacagaagatgagcagggctcctggggcattgatgacctgcacatcagcctgcaggccgagcaggaggacacccagaagaaggccttcacctgctggatcaacagccagctggcccggcacaccagccccagcgtcatcagtgacctcttcacagacatcaagaagggccacgtgctgctggacctgctggaggtgctgagcggccagcagctgccccgggacaagggcagcaacaccttccagtgccgcatcaacatcgagcacgccctgaccttcctgaggaacagaagcatcaagctgatcaacatccacgtgacagacatcattgatggcaaccccagcatcatcctgggcctcatctggaccatcatcctgcacttccacatcgagaagctggcccagaccctgagctgcaactacaaccagcccagcctggatgatgtgtctgtggtggacagcagccctgccagcagccccccagccaagaagtgcagcaaggtgcaggcccgctggcagatgtctgccaggaaggccctgctgctgtgggcccaggagcagtgtgccacctatgagagcgtgaatgtgacagacttcaagagctcctggagaaatggcatggccttcctggccatcatccacgccctgcggccagacctgattgacatgaagtctgtgaagcacaggagcaacaaggacaacctgcgggaggccttcagaattgctgagcaggagctgaagatcccccggctgctggagccagaagatgtggatgtggtggaccctgatgagaagagcatcatgacctacgtggcccagttcctgcagtacagcaaggatgcccctggcactggagaggaggcccagggcaaggtgaaggatgccatgggctggctgaccctgcagaaggagaagctgcagaagctgctgaaggacagtgaaaatgacacctacttcaagaagtacaacagcctgctgtccttcatggagagcttcaatgaggagaagaagagcttcctggatgtgctgagcatcaagagggacctggatgagctggacaaggaccacctgcagctgcgggaggcctgggatggcctggaccaccagatcaatgcctggaagatcaagctgaactatgccctgcccccacccctgcaccagacagaggcctggctgcaggaggtggaggagctgatggatgaggacctgagcgccagccaggaccacagccaggccgtgaccctcatccaggagaagatgaccctcttcaagagcctgatggacagatttgagcaccacagcaacatcctgctgacctttgagaacaaggatgagaaccacctgcccctggtgccccccaacaagctggaggagatgaagaggcgcatcaacaacatcctggagaagaagttcatcctgctgctggagttccactactacaagtgcctggtgctgggcctggtggatgaggtgaagagcaagctggacatctggaacatcaagtatggcagccgggagagcgtggagctgctgctggaggactggcacaagttcatcgaggagaaggagttcctggcccggctggacaccagcttccagaagtgtggggagatctacaagaacctggccggggagtgccagaacatcaacaagcagtacatgatggtgaagagtgatgtgtgcatgtacaggaagaacatctacaacgtgaagagcaccctgcagaaggtgctggcctgctgggccacctacgtggagaacctgcggctgctgcgggcctgctttgaggagaccaagaaggaggagatcaaggaggtgccctttgagaccctggcccagtggaacctggagcacgccaccctgaatgaagctggcaacttcctggtggaggtgtccaatgatgtggtgggcagcagcatcagcaaggagctgcggcggctgaacaagcgctggaggaagctggtgtccaagacccagctggagatgaacctgcccctgatgatcaagaagcaggaccagcccacctttgacaacagcggcaacatcctgagcaaggaggagaaggccaccgtggagttcagcacagacatgtctgtggagctgcctgagaactacaaccagaacatcaaggccggggagaagcatgagaaggaaaatgaggagttcaccggccagctgaaggtggccaaggatgtggagaagctgattggccaggtggagatctgggaggccgaggccaagtctgtgctggaccaggatgatgtggacacctccatggaggagagcctgaagcacctgattgccaagggctccatgtttgatgagctgatggcccggtctgaggacatgctgcagatggacatccagaacatcagcagccaggagagcttccagcacgtgctgaccaccggcctgcaggccaagatccaggaggccaaggagaaggtgcagatcaacgtggtgaagctgattgctgccctgaagaacctgacagatgtgtccccagacctggacatccggctgaagatggaggagagccagaaggagctggagagctacatgatgagggcccagcagctgctgggccagcgggagagccctggagagctgatcagcaagcacaaggaggccctgatcatcagcaacaccaagagcctggccaagtacctgaaggctgtggaggagctgaagaacaacgtgacagaggacatcaagatgagcctggaggagaagagcagagatgtgtgtgccaagtgggagagcctgcaccacgagctgagcctgtatgtgcagcagctgaagattgacatcgagaagggcaagctgagtgacaacatcctgaagctggagaagcagatcaacaaggagaagaagctgatccggcggggccgcaccaagggcctcatcaaggagcacgaggcctgcttcagcgaggagggctgcctgtaccagctgaaccaccacatggaggtgctgcgggagctgtgtgaggagctgcccagccagaagagccagcaggaggtgaagaggctgctgaaggactatgagcagaagattgaaaggctgctgaagtgtgccagcgagatccacatgaccctgcagcccacagctgggggcaccagcaagaatgaaggcaccatcaccaccagcgagaacagaggaggagacccccacagcgaggccccctttgccaagagtgacaaccagcccagcacagagaaggccatggagcccaccatgaagttcagcctggcctctgtgctgcggcccctgcaggaggagagcatcatggagaaggactacagcgccagcatcaacagcctgctggagagatatgacacctacagagacatcctggagcaccacctgcagaacaacaagttccgcatcaccagtgacttcagcagtgaagaagatagaagcagcagctgcctgcaggccaagctgacagacctgcaggtgatcaagaatgaaacagatgcccgctggaaggagtttgagatcatcagcctgaagctggagaaccacgtgaatgacatcaagaagccctttgtgatcaaggagcgggacaccctgaaggagcgggagcgggagctgcagatgaccctgaacaccaggatggagagcctggagacagccctgcggctggtgctgcctgtggagaaggccagcctgctgctgtgtggcagtgacctgcccctgcacaagatggccatccagggcttccacctgattgatgctgaccgcatctaccagcacctgaggaacatccaggacagcatcgccaagcagatcgagatctgcaaccggctggaggagcccggcaactttgtgctgaaggagctgcacccctttgacctgcacgccatgcagaacatcatcctgaagtacaagacccagtttgagggcatgaaccaccgggtgcagaggtctgaggacaccctgaaggccctggaggacttcctggccagcctgaggacagccaagctgtctgctgagcctgtgacagacctgagcgccagtgacacccaggtggcccaggagaacaccctgactgtgaagaacaaggagggggagatccacctgatgaaggacaaggccaagcacctggacaagtgcctgaagatgctggacatgtccttcaaggatgctgagagaggagatgacaccagctgtgagaacctgctggatgccttcagcatcaagctgtctgagacccacggctacggcgtgcaggaggagttcacagaggagaacaagctgctggaggcctgcatcttcaagaacaatgagctgctgaagaacatccaggatgtgcagagccagatcagcaagattggcctgaaggaccccaccgtgcctgctgtgaagcacaggaagaagagcctcatccggctggacaaggtgctggatgaatatgaggaggagaagaggcacctgcaggagatggccaacagcctgccccacttcaaggatggccgggagaagacagtgaaccagcagtgccagaacacagtggtgctgtgggagaacaccaaggccctggtgacagaatgtctggagcagtgtggccgggtgctggagctgctgaagcagtaccagaacttcaagagcatcctgaccaccctcatccagaaggaggagagcgtcatcagcctgcaggccagctacatgggcaaggagaacctgaagaagagaattgctgagattgaaattgtgaaggaggagttcaatgagcacctggaggtggtggacaagatcaaccaggtgtgcaagaacctgcagttctacctgaacaagatgaagacctttgaggagcccccatttgagaaggaggccaacatcatcgtggaccgctggctggacatcaatgagaagacagaggactactatgagaacctgggccgggccctggccctgtgggacaagctgttcaacctgaagaatgtgattgatgagtggacagagaaggccctgcagaagatggagctgcaccagctgacagaagaagatcgggagcggctgaaggaggagctgcaggtgcatgagcagaagaccagcgagttcagccggcgggtggccgagatccagttcctgctgcagagcagcgagatccccctggagctgcaggtgatggagagcagcatcctgaacaagatggagcacgtgcagaagtgcctgactggagagagcaactgccacgccctgagcggcagcacagctgagctgcgggaggacctggaccaggccaagacccagatcggcatgacagagagcctgctgaaggccctgagccccagcgacagcctggagatcttcaccaagctggaggagatccagcagcagatcctgcagcagaagcacagcatgatcctgctggagaaccagatcggctgcctgaccccagagctgtctgagctgaagaagcagtatgagagcgtgtctgacctcttcaacaccaagaagtctgtgctgcaggaccacttcagcaagctgctgaatgaccagtgcaagaacttcaatgactggttcagcaacatcaaggtgaacctgaaggagtgctttgagagcagcgagaccaagaagtctgtggagcagaagctgcagaagctgagtgacttcctgaccctggagggcaggaacagcaagatcaagcaggtggacagcgtgctgaagcacgtgaagaagcacctgcccaaggcccacgtgaaggagctgatctcctggctggtgggccaggagtttgagctggagaagatggagagcatctgccaggcccgggccaaggagctggaggacagcctgcagcagctgctgcggctgcaggatgaccacaggaacctgaggaagtggctgaccaaccaggaggagaagtggaagggcatggaggagcccggggagaagacagagctgttctgccaggccctggccaggaagcgggagcagtttgagagcgtggcccagctgaacaacagcctgaaggagtatggcttcacagaggaggaggagatcatcatggaggccacctgcctgatggaccgctaccagaccctgctgcggcagctgtctgaaattgaggaggaggacaagctgctgcccacagaggaccagagcttcaatgacctggcccatgatgtgatccactggatcaaggagatcaaggagagcctgatggtgctgaacagcagcgagggcaagatgcccctggaggagcgcatccagaagatcaaggagatcatcctgctgaagccagaaggagatgccagaattgagaccatcatgaagcaggccgagagcagcgaggcccccctggtgcagaagaccctgacagacatcagcaaccagtgggacaacaccctgcacctggccagcacctacctgagccaccaggagaagctgctgctggagggggagaagtacctgcagagcaaggaggacctgcggctgatgctgattgagctgaagaagaagcaggaggccggctttgccctgcagcacggcctgcaggagaagaaggcccagctgaagatctacaagaagttcctgaagaaggcccaggacctgaccagcctgctgaaggagctgaagagccagggcaactacctgctggagtgcaccaagaaccccagcttcagcgaggagccctggctggagatcaagcacctgcacgagagcctgctgcagcagctgcaggacagcgtgcagaacctggatggccacgtgcgggagcatgacagctaccaggtgtgtgtgacagacctgaacaccaccctggacaacttcagcaaggagtttgtgtccttcagtgacaagcctgtggaccagattgctgtggaggagaagctgcagaagctgcaggagctggagaaccggctgagcctgcaggacggcaccctgaagaagatcctggccctggccaagtctgtgaagcagaacaccagctctgtgggccagaagatcatcaaggatgacatcaagagcctgcagtgcaagcagaaggacctggagaaccggctggccagcgccaagcaggagatggagtgctgcctgaacagcatcctgaagagcaagaggagcacagagaagaagggcaagttcaccctgcccggccgggagaagcaggccaccagtgatgtgcaggagagcacccaggagagcgctgctgtggagaagctggaggaggactgggagatcaacaaggacagcgctgtggagatggccatgagcaagcagctgagcctgaatgcccaggagagcatgaagaacacagaagatgagaggaaggtgaatgagctgcagaaccagcccctggagctggacaccatgctgagaaatgagcagctggaggagattgagaagctgtacacccagctggaggccaagaaggccgccatcaagcccctggagcagacagaatgtctgaacaagacagagaccggggccctggtgctgcacaacatcggctacagcgcccagcacctggacaacctgctgcaggccctgatcaccctgaagaagaacaaggagagccagtactgtgtgctgcgggacttccaggagtacctggccgctgtggagagctccatgaaggccctgctgacagacaaggagagcctgaaggtgggccccctggacagcgtgacctacctggacaagatcaagaagttcatcgccagcattgagaaggagaaggacagcctgggcaacctgaagatcaagtgggagaacctgagcaaccacgtgacagacatggacaagaagctgctggagagccagatcaagcagctggagcacggctgggagcaggtggagcagcagatccagaagaagtacagccagcaggtggtggagtatgatgagttcaccaccctgatgaacaaggtgcaggacacagagatcagcctgcagcagcagcagcagcacctgcagctgcggctgaagagccctgaggagcgggccggcaaccagagcatgattgccctgaccacagacctgcaggccaccaagcacggcttctctgtgctgaagggccaggccgagctgcagatgaagaggatctggggcgagaaggagaagaagaacctggaggatggcatcaacaacctgaagaagcagtgggagaccctggagcccctgcacctggaggccgagaaccagatcaagaagtgtgacatccggaacaagatgaaggagaccatcctgtgggccaagaacctgctgggggagctgaaccccagcatccccctgctgcctgatgacatcctgagccagatcaggaagtgcaaggtgacccatgatggcatcctggcccggcagcagagcgtggagagcctggccgaggaggtgaaggacaaggtgcccagcctgaccacctatgagggcagtgacctgaacaacaccctggaggacctgaggaaccagtaccagatgctggtgctgaagagcacccagaggagccagcagctggagttcaagctggaggagaggagcaacttctttgccatcatcaggaagttccagctgatggtgcaggagagcgagaccctcatcatcccccgggtggagacagctgccacagaggccgagctgaagcaccaccacgtgaccctggaggccagccagaaggagctgcaggagattgattctggcatcagcacccacctgcaggagctgaccaacatctatgaggagctgaatgtgtttgagcggctcttcctggaggaccagctgaagaacctgaagatccgcaccaaccgcatccagcgcttcatccagaacacctgcaatgaggtggagcacaagatcaagttctgccggcagttccacgagaagaccagcgccctgcaggaggaggccgacagcatccagagaaatgagctgctgctgaaccaggaggtgaacaagggcgtgaaggaggagatctacaacctgaaggaccggctgacagccatcaagtgctgcatcctgcaggtgctgaagctgaagaaggtgtttgactacatcggcctgaactgggacttcagccagctggaccagctgcagacccaggtgtttgagaaggagaaggagctggaggagaagatcaagcagctggacacctttgaggaggagcacggcaagtaccaggccctgctgagcaagatgagggccatcgacctgcagatcaagaagatgacagaggtggtgctgaaggccccagacagcagccctgagagccggcggctgaatgcccagatcctgagccagagaattgagaaggccaagtgcctgtgtgatgagatcatcaagaagctgaatgaaaacaagacctttgatgacagcttcaaggagaaggagatcctgcagatcaagctgaatgcagaagaaaatgacaagctgtacaaggtgctgcagaacatggtgctggagctgagccccaaggagctggatgagaagaactgccaggacaagctggagaccagcctgcacgtgctgaaccagatcaagagccagctgcagcagcccctgctgatcaacctggagatcaagcacatccagaatgagaaggacaactgtgaggccttccaggagcaggtgtgggccgagatgtgcagcatcaaggctgtgacagccatcgagaagcagcgggaggagaacagcagcgaggccagtgatgtggagaccaagctgcgggagtttgaggacctgcagatgcagctgaacaccagcattgacctgcggaccaacgtgctgaatgatgcctatgagaacctgacccgctacaaggaggccgtgaccagggctgtggagagcatcaccagcctggaggccatcatcatcccctacagagtggatgtgggcaaccctgaggagagcctggagatgcccctgaggaagcaggaggagctggagagcacagtggcccacatccaggacctgacagagaagctgggcatgatcagcagccctgaggccaagctgcagctgcagtacaccctgcaggagctggtgtccaagaacagcgccatgaaggaggccttcaaggcccaggagacagaggccgagcgctacctggagaactacaagtgctacaggaagatggaggaggacatctacaccaacctgagcaagatggagaccgtgctgggccagagcatgagcagcctgcccctgagctaccgggaggccctggagcggctggagcagagcaaggccctggtgagcaacctgatcagcaccaaggaggagctgatgaagctgcggcagatcctgcggctgctgcggctgcgctgcacagaaaatgatggcatctgcctgctgaagatcgtgtctgccctgtgggagaagtggctgagcctgctggaggccgccaaggagtgggagatgtggtgtgaggagctgaagcaggagtggaagtttgtgtctgaggagattgaaagagaggccatcatcctggacaacctgcaggaggagctgcctgagatcagcaagaccaaggaggccgccaccacagaggagctgtctgagctgctggactgcctgtgccagtatggagaaaatgtggagaagcagcagctgctgctgaccctgctgctgcagaggatccgcagcatccagaatgtgcctgagagcagtggagctgtggagaccgtgcctgccttccaggagatcacctccatgaaggagcgctgcaacaagctgctgcagaaggtgcagaagaacaaggagctggtgcagacagagatccaggagcggcacagcttcaccaaggagatcatcgccctgaagaacttcttccagcagaccaccaccagcttccagaacatggccttccaggaccaccctgagaagtctgagcagtttgaggagctgcagagcatcctgaagaagggcaagctgacctttgagaacatcatggagaagctgcgcatcaagtacagcgagatgtacaccatcgtgcctgctgagattgagagccaggtggaggagtgcaggaaggccctggaggacattgatgagaagatcagcaatgaggtgctgaagagcagccccagctatgccatgaggaggaagattgaggagatcaacaacggcctgcacaacgtggagaagatgctgcagcagaagagcaagaacatcgagaaggcccaggagatccagaagaagatgtgggatgagctggacctgtggcacagcaagctgaatgagctggacagcgaggtgcaggacatcgtggagcaggaccccggccaggcccaggagtggatggacaacctgatgatccccttccagcagtaccagcaggtgtcccagagagctgagtgcaggaccagccagctgaacaaggccaccgtgaagatggaggagtacagcgacctgctgaagagcacagaggcctggattgagaacaccagccacctgctggccaacccagctgactatgacagcctgcggaccctgagccaccacgccagcacagtgcagatggccctggaggacagcgagcagaagcacaacctgctgcacagcatcttcatggacctggaggacctgagcatcatctttgaaacagatgagctgacccagagcatccaggagctgagcaaccaggtgacagccctgcagcagaagatcatggagagcctgccccagatccagaggatggctgatgatgtggtggccattgaaagtgaggtgaagtccatggagaagagggtgtccaagatcaagaccatcctgctgagcaaggagatctttgacttcagccctgaggagcacctgaagcatggagaggtgatcctggagaacatccggcccatgaagaagaccatcgccgagatcgtgtcctaccaggtggagctgcggctgccccagacaggcatgaagcccctgcctgtgttccagaggaccaaccagctgctgcaggacatcaagctgctggagaatgtgacccaggagcagaatgagctgctgaaggtggtgatcaagcagaccaatgagtgggatgaggagattgagaacctgaagcagatcctgaacaactacagcgcccagttcagcctggagcacatgagcccagaccaggccgacaagctgccccagctgcagggcgagattgaaagaatggagaagcagatcctgagcctgaaccagaggaaggaggacctgctggtggacctgaaggccaccgtgctgaacctgcaccagcacctgaagcaggagcaggagggcgtggagcgggaccggctgcctgctgtgaccagcgaggagggcggcgtggccgagagagatgccagcgagaggaagctgaacagaagaggctccatgagctacctggccgctgtggaggaggaggtggaggagagctctgtgaagagtgacaatggagatgagaaggccgagcccagcccccagagctggagcagcctgtggaagcatgacaaggacatggaggaggaccgggccagcagcagcagcggcaccatcgtgcaggaggcctacggcaagatcagcaccagtgacaacagcatggcccagatcctgaccccagacagcctgaacacagagcagggcccagaatgttccctgcggcccaaccagacagaggagggcaccaccccacccattgaagctgacaccctggacagcagtgatgcccagggcggcctggagccccgggtggagaagaccaggcctgagcccacagaggtgctgcacgcctgcaagacccaggtggccgagctggagctgtggctgcagcaggccaacgtggccgtggagcctgagaccctgaatgctgacatgcagcaggtgctggagcagcagctggtgggctgccaggccatgctgacagaaattgagcacaaggtggccttcctgctggagacctgcaaggaccagggcctgggggacaatggagccacccagcacgaggccgaggccctgagcctgaagctgaagacagtgaagtgcaacctggagaaggtgcagatgatgctgcaggagaagcacagcgaggaccagcaccccaccatcctgaagaagagcagcgagcctgagcaccaggaggccctgcagcctgtgaacctgtctgagctggagagcatcgtgacagagcggccccagttcagccggcagaaggacttccagcagcagcaggtgctggagctgaagcccatggagcagaaggacttcatcaagttcatcgagttcaatgccaagaagatgtggccccagtactgccagcacgacaatgacaccacccaggagagcagcgccagcaaccaggccagcagcccagaaaatgatgtgcctgacagcatcctgagcccccagggccagaatggagacaagtggcagtacctgcaccacgagctgagcagcaagatcaagctgcccctgccccagctggtggagccccaggtgtccaccaacatgggcatcctgcccagcgtgaccatgtacaacttccgctaccccaccacagaggagctgaagacctacaccacccagctggaggacctgcggcaggaggccagcaacctgcagacccaggagaacatgacagaggaggcctacatcaacctggacaagaagctgtttgagctgttcctgaccctgagccagtgcctgagctctgtggaggagatgctggagatgccccggctgtacagagaagatggcagcggccagcaggtgcactatgagaccctggccctggagctgaagaagctgtacctggccctgagtgacaagaagggggacctgctgaaggccatgacctggccaggagagaacaccaacctgctgctggagtgctttgacaacctgcaggtgtgcctggagcacacccaggccgctgctgtgtgccgcagcaagagcctgaaggccggcctggactacaacagaagctaccagaatgagatcaagaggctgtaccaccagctgatcaagagcaagaccagcctgcagcagagcctgaatgagatcagcggccagagcgtggccgagcagctgcagaaggcagatgcctacacagtggagctggagaatgctgagagccgggtggccaagctgagagatgaaggagagcggctgcacctgccctatgccctgctgcaggaggtgtacaagctggaggatgtgctggacagcatgtggggcatgctgcgggcccgctacacagagctgagcagcccctttgtgacagagagccagcaggatgccctgctgcagggcatggtggagctggtgaagattggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaaccgggagaccttctgggccgagcaggtgacagaggtgaagatcctggaggagaagagccggcagtgtggcatgaagctgcagagcctgctgcagaagtgggaggagtttgatgaaaattatgccagcctggagaaggacctggagatcctgatcagcaccctgcccagcgtgtccctggtggaggagacagaggagcggctggtggagcgcatctccttctaccagcagatcaagaggaacatcggcggcaagcacgcccggctgtaccagaccctgaatgaaggcaagcagctggtggcctctgtgtcctgcccagagctggagggccagatcgccaagctggaggagcagtggctgagcctgaacaagaagattgaccacgagctgcaccggctgcaggccctgctgaagcacctgctgagctacaacagagacagcgaccagctgaccaagtggctggagagcagccagcacaccctgaactactggaaggagcagagcctgaatgtgtcccaggacctggacaccatccgcagcaacatcaacaacttctttgagttcagcaaggaggtggatgagaagagcagcctgaagacagctgtgatcagcatcggcaaccagctgctgcacctgaaggagacagacacagccaccctgcgggccagcctggcccagtttgagcagaagtggaccatgctgatcacccagctgcctgacatccaggagaagctgcaccagctgcagatggagaagctgcccagcaggaaggccatcacagagatgatctcctggatgaacaacgtggagcaccagaccagtgatgaggacagcgtgcacagccccagcagcgccagccaggtgaagcacctgctgcagaagcacaaggagttcaggatggagatggactacaagcagtggatcgtggactttgtgaaccagagcctgctgcagctgagcacctgtgatgtggagagcaagagatatgaaagaacagaatttgctgagcacctgggggagatgaaccggcagtggcaccgggtgcacggcatgctgaacaggaagatccagcacctggagcagctgctggagagcatcacagaaagtgagaacaagatccagatcctgaacaactggctggaggcccaggaggagcggctgaagaccctgcagaagccagagagcgtcatctctgtgcagaagctgctgctggactgccaggacatcgagaaccagctggccatcaagagcaaggccctggatgagctgaagcagagctacctgaccctggagagcggggctgtgcccctgctggaggacacagccagcagaattgatgagctgttccagaagaggagctctgtgctgacccaggtgaaccagctgaagacctccatgcagagcgtgctgcaggagtggaagatctatgaccagctgtatgatgaggtgaacatgatgaccatccgcttctggtactgcatggagcacagcaagcctgtggtgctgagcctggagaccctgcgctgccaggtggagaacctgcagagcctgcaggatgaagctgagagcagcgagggctcctgggagaagctgcaggaggtgattggcaagctgaagggcctgtgccccagcgtggccgagatcatcgaggagaagtgccagaacacccacaagcgctggacccaggtgaaccaggccatcgctgaccagctgcagaaggcccagagcctgctgcagctgtggaaggcctacagcaatgcccacggggaggccgccgcccggctgaagcagcaggaggccaagttccagcagctggccaacatctccatgagcggcaacaacctggccgagatcctgcccccagccctgcaggacatcaaggagctgcagcatgatgtgcagaagaccaaggaggccttcctgcagaacagctctgtgctggaccggctgccccagcctgctgagagcagcacccacatgctgctgcccggccccctgcacagcctgcagagagctgcctacctggagaagatgctgctggtgaaggccaatgaatttgaatttgtgctgagccagttcaaggactttggagtgcggctggagagcctgaagggcctcatcatgcatgaggaggagaacctggaccggctgcaccagcaggagaaggaaaatccagacagcttcctgaaccacgtgctggccctgacagcccagagcccagacatcgagcacctgaatgaggtgtccctgaagctgcccctgagtgatgtggccgtgaagaccctgcagaacatgaaccggcagtggatccgggccacagccacagccctggagcgctgcagcgagctgcagggcatcggcctgaatgagaagttcctgtactgctgtgagaagtggatccagctgctggagaagattgaggaggccctgaaggtggatgtggccaacagcctgcctgagctgctggagcagcagaagacctacaagatgctggaggccgaggtgtccatcaaccagaccatcgctgacagctatgtgacccagagcctgcagctgctggacaccacagaaattgaaaatagacctgagttcatcacagagttcagcaagctgacagaccgctggcagaatgctgtgcagggcgtgcggcagaggaaaggagatgtggatggcctggtgcggcagtggcaggacttcaccacctctgtggagaacctcttccgcttcctgacagacaccagccacctgctgtctgctgtgaagggccaggagcgcttcagcctgtaccagaccaggagcctcatccacgagctgaagaacaaggagatccacttccagaggaggaggaccacctgtgccctgaccctggaggccggggagaagctgctgctgaccacagacctgaagaccaaggagagcgtgggccgccgcatcagccagctgcaggacagctggaaggacatggagccccagctggccgagatgatcaagcagttccagagcacagtggagacctgggaccagtgtgagaagaagatcaaggagctgaagagccggctgcaggtgctgaaggcccagagcgaggaccccctgcctgagctgcacgaggacctgcacaatgagaaggagctgatcaaggagctggagcagagcctggcctcctggacccagaacctgaaggagctgcagaccatgaaggctgacctgaccaggcatgtgctggtggaggatgtgatggtgctgaaggagcagatcgagcacctgcaccggcagtgggaggacctgtgcctgcgggtggccatcaggaagcaggagattgaagatcggctgaacacctgggtggtgttcaatgagaagaacaaggagctgtgtgcctggctggtgcagatggagaacaaggtgctgcagacagctgacatcagcattgaggagatgattgagaagctgcagaaggactgcatggaggagatcaacctcttcagcgagaacaagctgcagctgaagcagatgggagaccagctgatcaaggccagcaacaagagcagagctgctgagattgatgacaagctgaacaagatcaatgaccgctggcagcacctgtttgatgtgattggcagccgggtgaagaagctgaaggagacctttgccttcatccagcagctggacaagaacatgagcaacctgcggacctggctggccagaattgaaagtgagctgagcaagcctgtggtgtatgatgtgtgtgatgaccaggagatccagaagaggctggccgagcagcaggacctgcagagggacatcgagcagcacagcgctggggtggagagcgtcttcaacatctgtgatgtgctgctgcatgacagtgatgcctgtgccaatgaaacagaatgtgacagcatccagcagaccaccaggagcctggaccggcgctggaggaacatctgtgccatgtccatggagaggaggatgaagattgaggagacctggaggctgtggcagaagttcctggatgactacagcagatttgaggactggctgaagtctgctgagaggacagctgcctgccccaacagcagcgaggtgctgtacaccagcgccaaggaggagctgaagagatttgaggccttccagaggcagatccacgagcggctgacccagctggagctgatcaacaagcagtacagaaggctggcccgggagaacagaacagacacagccagccggctgaagcagatggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggaggtgtttggccgggtgagccgcttccaccggcggctgaccagctgcaccccaggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaagaagatgaggagggcccctactacagcgccctgagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaggccgagctggagatgctgaagatggccaagccacccagcgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgcagaagagagctgatgcagctggagaaggagctggtggagcggcagccccaggtggacatgctgcaggagatcagcaacagcctgctgatcaagggccatggagaggactgcatcgaggccgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagcagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccgctccttctaccccatgctgcgctacaccaacggccccccacccacctag

SEQ ID NO: 171278 - DNA, 804 bp, Artificial Sequence
  Description of Artificial Sequence: Synthetic coding sequence
atggccagcagccctgagctgcccacagaagatgagcagggctcctggggcattgatgacctgcacatcagcctgcaggccgagcaggaggacacccagaagaaggccttcacctgctggatcaacagccagctggcccggcacaccagccccagcgtcatcagtgacctcttcacagacatcaagaagggccacgtgctgctggacctgctggaggtgctgagcggccagcagctgccccgggacaagggcagcaacaccttccagtgccgcatcaacatcgagcacgccctgaccttcctgaggaacagaagcatcaagctgatcaacatccacgtgacagacatcattgatggcaaccccagcatcatcctgggcctcatctggaccatcatcctgcacttccacatcgagaagctggcccagaccctgagctgcaactacaaccagcccagcctggatgatgtgtctgtggtggacagcagccctgccagcagccccccagccaagaagtgcagcaaggtgcaggcccgctggcagatgtctgccaggaaggccctgctgctgtgggcccaggagcagtgtgccacctatgagagcgtgaatgtgacagacttcaagagctcctggagaaatggcatggccttcctggccatcatccacgccctgcggccagacctgattgacatgaagtctgtgaagcacaggagcaacaaggacaacctgcgggaggccttcagaattgctgagcaggagctgaagatcccccggctgctggagcctgaggcctacaagaacttctag

SEQ ID NO: 171279 - DNA, 9813 bp, Artificial Sequence
  Description of Artificial Sequence: Synthetic coding sequence
atggagaagctgcgcatcaagtacagcgagatgtacaccatcgtgcctgctgagattgagagccaggtggaggagtgcaggaaggccctggaggacattgatgagaagatcagcaatgaggtgctgaagagcagccccagctatgccatgaggaggaagattgaggagatcaacaacggcctgcacaacgtggagaagatgctgcagcagaagagcaagaacatcgagaaggcccaggagatccagaagaagatgtgggatgagctggacctgtggcacagcaagctgaatgagctggacagcgaggtgcaggacatcgtggagcaggaccccggccaggcccaggagtggatggacaacctgatgatccccttccagcagtaccagcaggtgtcccagagagctgagtgcaggaccagccagctgaacaaggccaccgtgaagatggaggagtacagcgacctgctgaagagcacagaggcctggattgagaacaccagccacctgctggccaacccagctgactatgacagcctgcggaccctgagccaccacgccagcacagtgcaggacagcaagtgcttccgcagcggcccccggcccaacatctacgtgtcctactacgtgaccgtcatccagatggccctggaggacagcgagcagaagcacaacctgctgcacagcatcttcatggacctggaggacctgagcatcatctttgaaacagatgagctgacccagagcatccaggagctgagcaaccaggtgacagccctgcagcagaagatcatggagagcctgccccagatccagaggatggctgatgatgtggtggccatcgagagcgaggtgaagtccatggagaagagggtgtccaagatcaagaccatcctgctgagcaaggagatctttgacttcagccctgaggagcacctgaagcacggggaggtgatcctggagaacatccggcccatgaagaagaccatcgccgagatcgtgtcctaccaggtggagctgcggctgccccagacaggcatgaagcccctgcccgtcttccagaggaccaaccagctgctgcaggacatcaagctgctggagaatgtgacccaggagcagaatgagctgctgaaggtggtgatcaagcagaccaatgagtgggatgaggagattgagaacctgaagcagatcctgaacaactacagcgcccagttcagcctggagcacatgagcccagaccaggccgacaagctgccccagctgcagggcgagattgaaagaatggagaagcagatcctgagcctgaaccagaggaaagaagacctgctggtggacctgaaggccaccgtgctgaacctgcaccagcacctgaagcaggagcaggagggcgtggagcgggaccggctgcctgctgtgaccagcgaggagggcggcgtggccgagagagatgccagcgagaggaagctgaacagaagaggctccatgagctacctggccgctgtggaggaggaggtggaggagagctctgtgaagagtgacaatggagatgagaaggccgagcccagcccccagagctggagcagcctgtggaagcatgacaaggacatggaggaggaccgggccagcagcagcagcggcaccatcgtgcaggaggcctacggcaagatcagcaccagtgacaacagcatggcccagatcctgaccccagacagcctgaacacagagcagggccctgagtgcagcctgcggcccaaccagacagaggagggcaccaccccacccatcgaggccgacaccctggacagcagtgatgcccagggcggcctggagccccgggtggagaagaccaggcctgagcccacagaggtgctgcacgcctgcaagacccaggtggccgagctggagctgtggctgcagcaggccaacgtggccgtggagcctgagaccctgaatgctgacatgcagcaggtgctggagcagcagctggtgggctgccaggccatgctgacagaaattgagcacaaggtggccttcctgctggagacctgcaaggaccagggcctgggggacaacggggccacccagcatgaagctgaggccctgagcctgaagctgaagacagtgaagtgcaacctggagaaggtgcagatgatgctgcaggagaagcacagcgaggaccagcaccccaccatcctgaagaagagcagcgagcctgagcaccaggaggccctgcagcctgtgaacctgtctgagctggagagcatcgtgacagagcggccccagttcagccggcagaaggacttccagcagcagcaggtgctggagctgaagcccatggagcagaaggacttcatcaagttcatcgagttcaatgccaagaagatgtggccccagtactgccagcacgacaatgacaccacccaggagagcagcgccagcaaccaggccagcagcccagaaaatgatgtgcctgacagcatcctgagcccccagggccagaatggagacaagtggcagtacctgcaccacgagctgagcagcaagatcaagctgcccctgccccagctggtggagccccaggtgtccaccaacatgggcatcctgcccagcgtgaccatgtacaacttccgctaccccaccacagaggagctgaagacctacaccacccagctggaggacctgcggcaggaggccagcaacctgcagacccaggagaacatgacagaggaggcctacatcaacctggacaagaagctgtttgagctgttcctgaccctgagccagtgcctgagctctgtggaggagatgctggagatgccccggctgtaccgggaggatggcagcggccagcaggtgcactatgagaccctggccctggagctgaagaagctgtacctggccctgagtgacaagaagggggacctgctgaaggccatgacctggccaggagagaacaccaacctgctgctggagtgctttgacaacctgcaggtgtgcctggagcacacccaggccgctgctgtgtgccgcagcaagagcctgaaggccggcctggactacaacagaagctaccagaatgagatcaagaggctgtaccaccagctgatcaagagcaagaccagcctgcagcagagcctgaatgagatcagcggccagagcgtggccgagcagctgcagaaggcagatgcctacacagtggagctggagaatgctgagagccgggtggccaagctgagagatgaaggagagcggctgcacctgccctatgccctgctgcaggaggtgtacaagctggaggatgtgctggacagcatgtggggcatgctgcgggcccgctacacagagctgagcagcccctttgtgacagagagccagcaggatgccctgctgcagggcatggtggagctggtgaagattggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaaccgggagaccttctgggccgagcaggtgacagaggtgaagatcctggaggagaagagccggcagtgtggcatgaagctgcagagcctgctgcagaagtgggaggagtttgatgagaactatgccagcctggagaaggacctggagatcctgatcagcaccctgcccagcgtgtccctggtggaggagacagaggagcggctggtggagcgcatctccttctaccagcagatcaagagaaatattggaggcaagcacgcccggctgtaccagaccctgaatgaaggcaagcagctggtggcctctgtgtcctgcccagagctggagggccagatcgccaagctggaggagcagtggctgagcctgaacaagaagattgaccacgagctgcaccggctgcaggccctgctgaagcacctgctgagctacaacagagacagcgaccagctgaccaagtggctggagagcagccagcacaccctgaactactggaaggagcagagcctgaatgtgtcccaggacctggacaccatccgcagcaacatcaacaacttctttgagttcagcaaggaggtggatgagaagagcagcctgaagacagctgtgatcagcatcggcaaccagctgctgcacctgaaggagacagacacagccaccctgcgggccagcctggcccagtttgagcagaagtggaccatgctgatcacccagctgcctgacatccaggagaagctgcaccagctgcagatggagaagctgcccagcaggaaggccatcacagagatgatctcctggatgaacaacgtggagcaccagaccagtgatgaagattctgtgcacagccccagcagcgccagccaggtgaagcacctgctgcagaagcacaaggagttcaggatggagatggactacaagcagtggatcgtggactttgtgaaccagagcctgctgcagctgagcacctgtgatgtggagagcaagagatatgaaagaacagaatttgctgagcacctgggggagatgaaccggcagtggcaccgggtgcacggcatgctgaacaggaagatccagcacctggagcagctgctggagagcatcacagaaagtgagaacaagatccagatcctgaacaactggctggaggcccaggaggagcggctgaagaccctgcagaagccagagagcgtcatctctgtgcagaagctgctgctggactgccaggacatcgagaaccagctggccatcaagagcaaggccctggatgagctgaagcagagctacctgaccctggagagcggggctgtgcccctgctggaggacacagccagcagaattgatgagctgttccagaagaggagctctgtgctgacccaggtgaaccagctgaagacctccatgcagagcgtgctgcaggagtggaagatctatgaccagctgtatgatgaggtgaacatgatgaccatccgcttctggtactgcatggagcacagcaagcctgtggtgctgagcctggagaccctgcgctgccaggtggagaacctgcagagcctgcaggatgaggccgagagcagcgagggctcctgggagaagctgcaggaggtgattggcaagctgaagggcctgtgccccagcgtggccgagatcatcgaggagaagtgccagaacacccacaagcgctggacccaggtgaaccaggccatcgctgaccagctgcagaaggcccagagcctgctgcagctgtggaaggcctacagcaatgcccatggagaggccgccgcccggctgaagcagcaggaggccaagttccagcagctggccaacatctccatgagcggcaacaacctggccgagatcctgcccccagccctgcaggacatcaaggagctgcagcatgatgtgcagaagaccaaggaggccttcctgcagaacagctctgtgctggaccggctgccccagcctgctgagagcagcacccacatgctgctgcccggccccctgcacagcctgcagagagctgcctacctggagaagatgctgctggtgaaggccaatgaatttgaatttgtgctgagccagttcaaggactttggagtgcggctggagagcctgaagggcctcatcatgcatgaggaggagaacctggaccggctgcaccagcaggagaaggagaacccagacagcttcctgaaccacgtgctggccctgacagcccagagcccagacatcgagcacctgaatgaggtgtccctgaagctgcccctgagtgatgtggccgtgaagaccctgcagaacatgaaccggcagtggatccgggccacagccacagccctggagcgctgcagcgagctgcagggcatcggcctgaatgagaagttcctgtactgctgtgagaagtggatccagctgctggagaagattgaggaggccctgaaggtggatgtggccaacagcctgcctgagctgctggagcagcagaagacctacaagatgctggaggccgaggtgtccatcaaccagaccatcgctgacagctatgtgacccagagcctgcagctgctggacaccacagaaattgagaacagacctgagttcatcacagagttcagcaagctgacagaccgctggcagaatgctgtgcagggcgtgcggcagaggaaaggagatgtggatggcctggtgcggcagtggcaggacttcaccacctctgtggagaacctcttccgcttcctgacagacaccagccacctgctgtctgctgtgaagggccaggagcgcttcagcctgtaccagaccaggagcctcatccacgagctgaagaacaaggagatccacttccagaggaggaggaccacctgtgccctgaccctggaggccggggagaagctgctgctgaccacagacctgaagaccaaggagagcgtgggccgccgcatcagccagctgcaggacagctggaaggacatggagccccagctggccgagatgatcaagcagttccagagcacagtggagacctgggaccagtgtgagaagaagatcaaggagctgaagagccggctgcaggtgctgaaggcccagagcgaggaccccctgcctgagctgcacgaggacctgcacaatgagaaggagctgatcaaggagctggagcagagcctggcctcctggacccagaacctgaaggagctgcagaccatgaaggctgacctgaccaggcatgtgctggtggaggatgtgatggtgctgaaggagcagatcgagcacctgcaccggcagtgggaggacctgtgcctgcgggtggccatcaggaagcaggagattgaggaccggctgaacacctgggtggtgttcaatgagaagaacaaggagctgtgtgcctggctggtgcagatggagaacaaggtgctgcagacagctgacatcagcattgaggagatgattgagaagctgcagaaggactgcatggaggagatcaacctcttcagcgagaacaagctgcagctgaagcagatgggagaccagctgatcaaggccagcaacaagagcagagctgctgagattgatgacaagctgaacaagatcaatgaccgctggcagcacctgtttgatgtgattggcagccgggtgaagaagctgaaggagacctttgccttcatccagcagctggacaagaacatgagcaacctgcggacctggctggcccgcatcgagagcgagctgagcaagcctgtggtgtatgatgtgtgtgatgaccaggagatccagaagaggctggccgagcagcaggacctgcagagggacatcgagcagcacagcgctggggtggagagcgtcttcaacatctgtgatgtgctgctgcatgacagtgatgcctgtgccaatgaaacagaatgtgacagcatccagcagaccaccaggagcctggaccggcgctggaggaacatctgtgccatgtccatggagaggaggatgaagattgaggagacctggaggctgtggcagaagttcctggatgactacagcagatttgaggactggctgaagtctgctgagaggacagctgcctgccccaacagcagcgaggtgctgtacaccagcgccaaggaggagctgaagagatttgaggccttccagaggcagatccacgagcggctgacccagctggagctgatcaacaagcagtaccgccgcctggccagagaaaatagaacagacacagccagccggctgaagcagatggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggaggtgtttggccgggtgagccgcttccaccggcggctgaccagctgcaccccaggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaggaggatgaggagggcccctactacagcgccctgagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaagctgagctggagatgctgaagatggccaagcccccaagtgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgccggcgggagctgatgcagctggagaaggagctggtggagcggcagccccaggtggacatgctgcaggagatcagcaacagcctgctgatcaagggccacggggaggactgcattgaagctgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagcagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccggagcttctaccccatgctgcgctacaccaatggacctccacccacctag

SEQ ID NO: 171280 - DNA, 20724 bp, Artificial Sequence
  Description of Artificial Sequence: Synthetic coding sequence
atggccagcagccctgagctgcccacagaagatgagcagggctcctggggcattgatgacctgcacatcagcctgcaggccgagcaggaggacacccagaagaaggccttcacctgctggatcaacagccagctggcccggcacaccagccccagcgtcatcagtgacctcttcacagacatcaagaagggccacgtgctgctggacctgctggaggtgctgagcggccagcagctgccccgggacaagggcagcaacaccttccagtgccgcatcaacatcgagcacgccctgaccttcctgaggaacagaagcatcaagctgatcaacatccacgtgacagacatcattgatggcaaccccagcatcatcctgggcctcatctggaccatcatcctgcacttccacatcgagaagctggcccagaccctgagctgcaactacaaccagcccagcctggatgatgtgtctgtggtggacagcagccctgccagcagccccccagccaagaagtgcagcaaggtgcaggcccgctggcagatgtctgccaggaaggccctgctgctgtgggcccaggagcagtgtgccacctatgagagcgtgaatgtgacagacttcaagagctcctggagaaatggcatggccttcctggccatcatccacgccctgcggccagacctgattgacatgaagtctgtgaagcacaggagcaacaaggacaacctgcgggaggccttcagaattgctgagcaggagctgaagatcccccggctgctggagccagaagatgtggatgtggtggaccctgatgagaagagcatcatgacctacgtggcccagttcctgcagtacagcaaggatgcccctggcactggagaggaggcccagggcaaggtgaaggatgccatgggctggctgaccctgcagaaggagaagctgcagaagctgctgaaggacagtgaaaatgacacctacttcaagaagtacaacagcctgctgtccttcatggagagcttcaatgaggagaagaagagcttcctggatgtgctgagcatcaagagggacctggatgagctggacaaggaccacctgcagctgcgggaggcctgggatggcctggaccaccagatcaatgcctggaagatcaagctgaactatgccctgcccccacccctgcaccagacagaggcctggctgcaggaggtggaggagctgatggatgaggacctgagcgccagccaggaccacagccaggccgtgaccctcatccaggagaagatgaccctcttcaagagcctgatggacagatttgagcaccacagcaacatcctgctgacctttgagaacaaggatgagaaccacctgcccctggtgccccccaacaagctggaggagatgaagaggcgcatcaacaacatcctggagaagaagttcatcctgctgctggagttccactactacaagtgcctggtgctgggcctggtggatgaggtgaagagcaagctggacatctggaacatcaagtatggcagccgggagagcgtggagctgctgctggaggactggcacaagttcatcgaggagaaggagttcctggcccggctggacaccagcttccagaagtgtggggagatctacaagaacctggccggggagtgccagaacatcaacaagcagtacatgatggtgaagagtgatgtgtgcatgtacaggaagaacatctacaacgtgaagagcaccctgcagaaggtgctggcctgctgggccacctacgtggagaacctgcggctgctgcgggcctgctttgaggagaccaagaaggaggagatcaaggaggtgccctttgagaccctggcccagtggaacctggagcacgccaccctgaatgaagctggcaacttcctggtggaggtgtccaatgatgtggtgggcagcagcatcagcaaggagctgcggcggctgaacaagcgctggaggaagctggtgtccaagacccagctggagatgaacctgcccctgatgatcaagaagcaggaccagcccacctttgacaacagcggcaacatcctgagcaaggaggagaaggccaccgtggagttcagcacagacatgtctgtggagctgcctgagaactacaaccagaacatcaaggccggggagaagcatgagaaggaaaatgaggagttcaccggccagctgaaggtggccaaggatgtggagaagctgattggccaggtggagatctgggaggccgaggccaagtctgtgctggaccaggatgatgtggacacctccatggaggagagcctgaagcacctgattgccaagggctccatgtttgatgagctgatggcccggtctgaggacatgctgcagatggacatccagaacatcagcagccaggagagcttccagcacgtgctgaccaccggcctgcaggccaagatccaggaggccaaggagaaggtgcagatcaacgtggtgaagctgattgctgccctgaagaacctgacagatgtgtccccagacctggacatccggctgaagatggaggagagccagaaggagctggagagctacatgatgagggcccagcagctgctgggccagcgggagagccctggagagctgatcagcaagcacaaggaggccctgatcatcagcaacaccaagagcctggccaagtacctgaaggctgtggaggagctgaagaacaacgtgacagaggacatcaagatgagcctggaggagaagagcagagatgtgtgtgccaagtgggagagcctgcaccacgagctgagcctgtatgtgcagcagctgaagattgacatcgagaagggcaagctgagtgacaacatcctgaagctggagaagcagatcaacaaggagaagaagctgatccggcggggccgcaccaagggcctcatcaaggagcacgaggcctgcttcagcgaggagggctgcctgtaccagctgaaccaccacatggaggtgctgcgggagctgtgtgaggagctgcccagccagaagagccagcaggaggtgaagaggctgctgaaggactatgagcagaagattgaaaggctgctgaagtgtgccagcgagatccacatgaccctgcagcccacagctgggggcaccagcaagaatgaaggcaccatcaccaccagcgagaacagaggaggagacccccacagcgaggccccctttgccaagagtgacaaccagcccagcacagagaaggccatggagcccaccatgaagttcagcctggcctctgtgctgcggcccctgcaggaggagagcatcatggagaaggactacagcgccagcatcaacagcctgctggagagatatgacacctacagagacatcctggagcaccacctgcagaacaacaagttccgcatcaccagtgacttcagcagtgaagaagatagaagcagcagctgcctgcaggccaagctgacagacctgcaggtgatcaagaatgaaacagatgcccgctggaaggagtttgagatcatcagcctgaagctggagaaccacgtgaatgacatcaagaagccctttgtgatcaaggagcgggacaccctgaaggagcgggagcgggagctgcagatgaccctgaacaccaggatggagagcctggagacagccctgcggctggtgctgcctgtggagaaggccagcctgctgctgtgtggcagtgacctgcccctgcacaagatggccatccagggcttccacctgattgatgctgaccgcatctaccagcacctgaggaacatccaggacagcatcgccaagcagatcgagatctgcaaccggctggaggagcccggcaactttgtgctgaaggagctgcacccctttgacctgcacgccatgcagaacatcatcctgaagtacaagacccagtttgagggcatgaaccaccgggtgcagaggtctgaggacaccctgaaggccctggaggacttcctggccagcctgaggacagccaagctgtctgctgagcctgtgacagacctgagcgccagtgacacccaggtggcccaggagaacaccctgactgtgaagaacaaggagggggagatccacctgatgaaggacaaggccaagcacctggacaagtgcctgaagatgctggacatgtccttcaaggatgctgagagaggagatgacaccagctgtgagaacctgctggatgccttcagcatcaagctgtctgagacccacggctacggcgtgcaggaggagttcacagaggagaacaagctgctggaggcctgcatcttcaagaacaatgagctgctgaagaacatccaggatgtgcagagccagatcagcaagattggcctgaaggaccccaccgtgcctgctgtgaagcacaggaagaagagcctcatccggctggacaaggtgctggatgaatatgaggaggagaagaggcacctgcaggagatggccaacagcctgccccacttcaaggatggccgggagaagacagtgaaccagcagtgccagaacacagtggtgctgtgggagaacaccaaggccctggtgacagaatgtctggagcagtgtggccgggtgctggagctgctgaagcagtaccagaacttcaagagcatcctgaccaccctcatccagaaggaggagagcgtcatcagcctgcaggccagctacatgggcaaggagaacctgaagaagagaattgctgagattgaaattgtgaaggaggagttcaatgagcacctggaggtggtggacaagatcaaccaggtgtgcaagaacctgcagttctacctgaacaagatgaagacctttgaggagcccccatttgagaaggaggccaacatcatcgtggaccgctggctggacatcaatgagaagacagaggactactatgagaacctgggccgggccctggccctgtgggacaagctgttcaacctgaagaatgtgattgatgagtggacagagaaggccctgcagaagatggagctgcaccagctgacagaagaagatcgggagcggctgaaggaggagctgcaggtgcatgagcagaagaccagcgagttcagccggcgggtggccgagatccagttcctgctgcagagcagcgagatccccctggagctgcaggtgatggagagcagcatcctgaacaagatggagcacgtgcagaagtgcctgactggagagagcaactgccacgccctgagcggcagcacagctgagctgcgggaggacctggaccaggccaagacccagatcggcatgacagagagcctgctgaaggccctgagccccagcgacagcctggagatcttcaccaagctggaggagatccagcagcagatcctgcagcagaagcacagcatgatcctgctggagaaccagatcggctgcctgaccccagagctgtctgagctgaagaagcagtatgagagcgtgtctgacctcttcaacaccaagaagtctgtgctgcaggaccacttcagcaagctgctgaatgaccagtgcaagaacttcaatgactggttcagcaacatcaaggtgaacctgaaggagtgctttgagagcagcgagaccaagaagtctgtggagcagaagctgcagaagctgagtgacttcctgaccctggagggcaggaacagcaagatcaagcaggtggacagcgtgctgaagcacgtgaagaagcacctgcccaaggcccacgtgaaggagctgatctcctggctggtgggccaggagtttgagctggagaagatggagagcatctgccaggcccgggccaaggagctggaggacagcctgcagcagctgctgcggctgcaggatgaccacaggaacctgaggaagtggctgaccaaccaggaggagaagtggaagggcatggaggagcccggggagaagacagagctgttctgccaggccctggccaggaagcgggagcagtttgagagcgtggcccagctgaacaacagcctgaaggagtatggcttcacagaggaggaggagatcatcatggaggccacctgcctgatggaccgctaccagaccctgctgcggcagctgtctgaaattgaggaggaggacaagctgctgcccacagaggaccagagcttcaatgacctggcccatgatgtgatccactggatcaaggagatcaaggagagcctgatggtgctgaacagcagcgagggcaagatgcccctggaggagcgcatccagaagatcaaggagatcatcctgctgaagccagaaggagatgccagaattgagaccatcatgaagcaggccgagagcagcgaggcccccctggtgcagaagaccctgacagacatcagcaaccagtgggacaacaccctgcacctggccagcacctacctgagccaccaggagaagctgctgctggagggggagaagtacctgcagagcaaggaggacctgcggctgatgctgattgagctgaagaagaagcaggaggccggctttgccctgcagcacggcctgcaggagaagaaggcccagctgaagatctacaagaagttcctgaagaaggcccaggacctgaccagcctgctgaaggagctgaagagccagggcaactacctgctggagtgcaccaagaaccccagcttcagcgaggagccctggctggagatcaagcacctgcacgagagcctgctgcagcagctgcaggacagcgtgcagaacctggatggccacgtgcgggagcatgacagctaccaggtgtgtgtgacagacctgaacaccaccctggacaacttcagcaaggagtttgtgtccttcagtgacaagcctgtggaccagattgctgtggaggagaagctgcagaagctgcaggagctggagaaccggctgagcctgcaggacggcaccctgaagaagatcctggccctggccaagtctgtgaagcagaacaccagctctgtgggccagaagatcatcaaggatgacatcaagagcctgcagtgcaagcagaaggacctggagaaccggctggccagcgccaagcaggagatggagtgctgcctgaacagcatcctgaagagcaagaggagcacagagaagaagggcaagttcaccctgcccggccgggagaagcaggccaccagtgatgtgcaggagagcacccaggagagcgctgctgtggagaagctggaggaggactgggagatcaacaaggacagcgctgtggagatggccatgagcaagcagctgagcctgaatgcccaggagagcatgaagaacacagaagatgagaggaaggtgaatgagctgcagaaccagcccctggagctggacaccatgctgagaaatgagcagctggaggagattgagaagctgtacacccagctggaggccaagaaggccgccatcaagcccctggagcagacagaatgtctgaacaagacagagaccggggccctggtgctgcacaacatcggctacagcgcccagcacctggacaacctgctgcaggccctgatcaccctgaagaagaacaaggagagccagtactgtgtgctgcgggacttccaggagtacctggccgctgtggagagctccatgaaggccctgctgacagacaaggagagcctgaaggtgggccccctggacagcgtgacctacctggacaagatcaagaagttcatcgccagcattgagaaggagaaggacagcctgggcaacctgaagatcaagtgggagaacctgagcaaccacgtgacagacatggacaagaagctgctggagagccagatcaagcagctggagcacggctgggagcaggtggagcagcagatccagaagaagtacagccagcaggtggtggagtatgatgagttcaccaccctgatgaacaaggtgcaggacacagagatcagcctgcagcagcagcagcagcacctgcagctgcggctgaagagccctgaggagcgggccggcaaccagagcatgattgccctgaccacagacctgcaggccaccaagcacggcttctctgtgctgaagggccaggccgagctgcagatgaagaggatctggggcgagaaggagaagaagaacctggaggatggcatcaacaacctgaagaagcagtgggagaccctggagcccctgcacctggaggccgagaaccagatcaagaagtgtgacatccggaacaagatgaaggagaccatcctgtgggccaagaacctgctgggggagctgaaccccagcatccccctgctgcctgatgacatcctgagccagatcaggaagtgcaaggtgacccatgatggcatcctggcccggcagcagagcgtggagagcctggccgaggaggtgaaggacaaggtgcccagcctgaccacctatgagggcagtgacctgaacaacaccctggaggacctgaggaaccagtaccagatgctggtgctgaagagcacccagaggagccagcagctggagttcaagctggaggagaggagcaacttctttgccatcatcaggaagttccagctgatggtgcaggagagcgagaccctcatcatcccccgggtggagacagctgccacagaggccgagctgaagcaccaccacgtgaccctggaggccagccagaaggagctgcaggagattgattctggcatcagcacccacctgcaggagctgaccaacatctatgaggagctgaatgtgtttgagcggctcttcctggaggaccagctgaagaacctgaagatccgcaccaaccgcatccagcgcttcatccagaacacctgcaatgaggtggagcacaagatcaagttctgccggcagttccacgagaagaccagcgccctgcaggaggaggccgacagcatccagagaaatgagctgctgctgaaccaggaggtgaacaagggcgtgaaggaggagatctacaacctgaaggaccggctgacagccatcaagtgctgcatcctgcaggtgctgaagctgaagaaggtgtttgactacatcggcctgaactgggacttcagccagctggaccagctgcagacccaggtgtttgagaaggagaaggagctggaggagaagatcaagcagctggacacctttgaggaggagcacggcaagtaccaggccctgctgagcaagatgagggccatcgacctgcagatcaagaagatgacagaggtggtgctgaaggccccagacagcagccctgagagccggcggctgaatgcccagatcctgagccagagaattgagaaggccaagtgcctgtgtgatgagatcatcaagaagctgaatgaaaacaagacctttgatgacagcttcaaggagaaggagatcctgcagatcaagctgaatgcagaagaaaatgacaagctgtacaaggtgctgcagaacatggtgctggagctgagccccaaggagctggatgagaagaactgccaggacaagctggagaccagcctgcacgtgctgaaccagatcaagagccagctgcagcagcccctgctgatcaacctggagatcaagcacatccagaatgagaaggacaactgtgaggccttccaggagcaggtgtgggccgagatgtgcagcatcaaggctgtgacagccatcgagaagcagcgggaggagaacagcagcgaggccagtgatgtggagaccaagctgcgggagtttgaggacctgcagatgcagctgaacaccagcattgacctgcggaccaacgtgctgaatgatgcctatgagaacctgacccgctacaaggaggccgtgaccagggctgtggagagcatcaccagcctggaggccatcatcatcccctacagagtggatgtgggcaaccctgaggagagcctggagatgcccctgaggaagcaggaggagctggagagcacagtggcccacatccaggacctgacagagaagctgggcatgatcagcagccctgaggccaagctgcagctgcagtacaccctgcaggagctggtgtccaagaacagcgccatgaaggaggccttcaaggcccaggagacagaggccgagcgctacctggagaactacaagtgctacaggaagatggaggaggacatctacaccaacctgagcaagatggagaccgtgctgggccagagcatgagcagcctgcccctgagctaccgggaggccctggagcggctggagcagagcaaggccctggtgagcaacctgatcagcaccaaggaggagctgatgaagctgcggcagatcctgcggctgctgcggctgcgctgcacagaaaatgatggcatctgcctgctgaagatcgtgtctgccctgtgggagaagtggctgagcctgctggaggccgccaaggagtgggagatgtggtgtgaggagctgaagcaggagtggaagtttgtgtctgaggagattgaaagagaggccatcatcctggacaacctgcaggaggagctgcctgagatcagcaagaccaaggaggccgccaccacagaggagctgtctgagctgctggactgcctgtgccagtatggagaaaatgtggagaagcagcagctgctgctgaccctgctgctgcagaggatccgcagcatccagaatgtgcctgagagcagtggagctgtggagaccgtgcctgccttccaggagatcacctccatgaaggagcgctgcaacaagctgctgcagaaggtgcagaagaacaaggagctggtgcagacagagatccaggagcggcacagcttcaccaaggagatcatcgccctgaagaacttcttccagcagaccaccaccagcttccagaacatggccttccaggaccaccctgagaagtctgagcagtttgaggagctgcagagcatcctgaagaagggcaagctgacctttgagaacatcatggagaagctgcgcatcaagtacagcgagatgtacaccatcgtgcctgctgagattgagagccaggtggaggagtgcaggaaggccctggaggacattgatgagaagatcagcaatgaggtgctgaagagcagccccagctatgccatgaggaggaagattgaggagatcaacaacggcctgcacaacgtggagaagatgctgcagcagaagagcaagaacatcgagaaggcccaggagatccagaagaagatgtgggatgagctggacctgtggcacagcaagctgaatgagctggacagcgaggtgcaggacatcgtggagcaggaccccggccaggcccaggagtggatggacaacctgatgatccccttccagcagtaccagcaggtgtcccagagagctgagtgcaggaccagccagctgaacaaggccaccgtgaagatggaggagtacagcgacctgctgaagagcacagaggcctggattgagaacaccagccacctgctggccaacccagctgactatgacagcctgcggaccctgagccaccacgccagcacagtgcagatggccctggaggacagcgagcagaagcacaacctgctgcacagcatcttcatggacctggaggacctgagcatcatctttgaaacagatgagctgacccagagcatccaggagctgagcaaccaggtgacagccctgcagcagaagatcatggagagcctgccccagatccagaggatggctgatgatgtggtggccattgaaagtgaggtgaagtccatggagaagagggtgtccaagatcaagaccatcctgctgagcaaggagatctttgacttcagccctgaggagcacctgaagcatggagaggtgatcctggagaacatccggcccatgaagaagaccatcgccgagatcgtgtcctaccaggtggagctgcggctgccccagacaggcatgaagcccctgcctgtgttccagaggaccaaccagctgctgcaggacatcaagctgctggagaatgtgacccaggagcagaatgagctgctgaaggtggtgatcaagcagaccaatgagtgggatgaggagattgagaacctgaagcagatcctgaacaactacagcgcccagttcagcctggagcacatgagcccagaccaggccgacaagctgccccagctgcagggcgagattgaaagaatggagaagcagatcctgagcctgaaccagaggaaggaggacctgctggtggacctgaaggccaccgtgctgaacctgcaccagcacctgaagcaggagcaggagggcgtggagcgggaccggctgcctgctgtgaccagcgaggagggcggcgtggccgagagagatgccagcgagaggaagctgaacagaagaggctccatgagctacctggccgctgtggaggaggaggtggaggagagctctgtgaagagtgacaatggagatgagaaggccgagcccagcccccagagctggagcagcctgtggaagcatgacaaggacatggaggaggaccgggccagcagcagcagcggcaccatcgtgcaggaggcctacggcaagatcagcaccagtgacaacagcatggcccagatcctgaccccagacagcctgaacacagagcagggcccagaatgttccctgcggcccaaccagacagaggagggcaccaccccacccattgaagctgacaccctggacagcagtgatgcccagggcggcctggagccccgggtggagaagaccaggcctgagcccacagaggtgctgcacgcctgcaagacccaggtggccgagctggagctgtggctgcagcaggccaacgtggccgtggagcctgagaccctgaatgctgacatgcagcaggtgctggagcagcagctggtgggctgccaggccatgctgacagaaattgagcacaaggtggccttcctgctggagacctgcaaggaccagggcctgggggacaatggagccacccagcacgaggccgaggccctgagcctgaagctgaagacagtgaagtgcaacctggagaaggtgcagatgatgctgcaggagaagcacagcgaggaccagcaccccaccatcctgaagaagagcagcgagcctgagcaccaggaggccctgcagcctgtgaacctgtctgagctggagagcatcgtgacagagcggccccagttcagccggcagaaggacttccagcagcagcaggtgctggagctgaagcccatggagcagaaggacttcatcaagttcatcgagttcaatgccaagaagatgtggccccagtactgccagcacgacaatgacaccacccaggagagcagcgccagcaaccaggccagcagcccagaaaatgatgtgcctgacagcatcctgagcccccagggccagaatggagacaagtggcagtacctgcaccacgagctgagcagcaagatcaagctgcccctgccccagctggtggagccccaggtgtccaccaacatgggcatcctgcccagcgtgaccatgtacaacttccgctaccccaccacagaggagctgaagacctacaccacccagctggaggacctgcggcaggaggccagcaacctgcagacccaggagaacatgacagaggaggcctacatcaacctggacaagaagctgtttgagctgttcctgaccctgagccagtgcctgagctctgtggaggagatgctggagatgccccggctgtacagagaagatggcagcggccagcaggtgcactatgagaccctggccctggagctgaagaagctgtacctggccctgagtgacaagaagggggacctgctgaaggccatgacctggccaggagagaacaccaacctgctgctggagtgctttgacaacctgcaggtgtgcctggagcacacccaggccgctgctgtgtgccgcagcaagagcctgaaggccggcctggactacaacagaagctaccagaatgagatcaagaggctgtaccaccagctgatcaagagcaagaccagcctgcagcagagcctgaatgagatcagcggccagagcgtggccgagcagctgcagaaggcagatgcctacacagtggagctggagaatgctgagagccgggtggccaagctgagagatgaaggagagcggctgcacctgccctatgccctgctgcaggaggtgtacaagctggaggatgtgctggacagcatgtggggcatgctgcgggcccgctacacagagctgagcagcccctttgtgacagagagccagcaggatgccctgctgcagggcatggtggagctggtgaagattggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaaccgggagaccttctgggccgagcaggtgacagaggtgaagatcctggaggagaagagccggcagtgtggcatgaagctgcagagcctgctgcagaagtgggaggagtttgatgaaaattatgccagcctggagaaggacctggagatcctgatcagcaccctgcccagcgtgtccctggtggaggagacagaggagcggctggtggagcgcatctccttctaccagcagatcaagaggaacatcggcggcaagcacgcccggctgtaccagaccctgaatgaaggcaagcagctggtggcctctgtgtcctgcccagagctggagggccagatcgccaagctggaggagcagtggctgagcctgaacaagaagattgaccacgagctgcaccggctgcaggccctgctgaagcacctgctgagctacaacagagacagcgaccagctgaccaagtggctggagagcagccagcacaccctgaactactggaaggagcagagcctgaatgtgtcccaggacctggacaccatccgcagcaacatcaacaacttctttgagttcagcaaggaggtggatgagaagagcagcctgaagacagctgtgatcagcatcggcaaccagctgctgcacctgaaggagacagacacagccaccctgcgggccagcctggcccagtttgagcagaagtggaccatgctgatcacccagctgcctgacatccaggagaagctgcaccagctgcagatggagaagctgcccagcaggaaggccatcacagagatgatctcctggatgaacaacgtggagcaccagaccagtgatgaggacagcgtgcacagccccagcagcgccagccaggtgaagcacctgctgcagaagcacaaggagttcaggatggagatggactacaagcagtggatcgtggactttgtgaaccagagcctgctgcagctgagcacctgtgatgtggagagcaagagatatgaaagaacagaatttgctgagcacctgggggagatgaaccggcagtggcaccgggtgcacggcatgctgaacaggaagatccagcacctggagcagctgctggagagcatcacagaaagtgagaacaagatccagatcctgaacaactggctggaggcccaggaggagcggctgaagaccctgcagaagccagagagcgtcatctctgtgcagaagctgctgctggactgccaggacatcgagaaccagctggccatcaagagcaaggccctggatgagctgaagcagagctacctgaccctggagagcggggctgtgcccctgctggaggacacagccagcagaattgatgagctgttccagaagaggagctctgtgctgacccaggtgaaccagctgaagacctccatgcagagcgtgctgcaggagtggaagatctatgaccagctgtatgatgaggtgaacatgatgaccatccgcttctggtactgcatggagcacagcaagcctgtggtgctgagcctggagaccctgcgctgccaggtggagaacctgcagagcctgcaggatgaagctgagagcagcgagggctcctgggagaagctgcaggaggtgattggcaagctgaagggcctgtgccccagcgtggccgagatcatcgaggagaagtgccagaacacccacaagcgctggacccaggtgaaccaggccatcgctgaccagctgcagaaggcccagagcctgctgcagctgtggaaggcctacagcaatgcccacggggaggccgccgcccggctgaagcagcaggaggccaagttccagcagctggccaacatctccatgagcggcaacaacctggccgagatcctgcccccagccctgcaggacatcaaggagctgcagcatgatgtgcagaagaccaaggaggccttcctgcagaacagctctgtgctggaccggctgccccagcctgctgagagcagcacccacatgctgctgcccggccccctgcacagcctgcagagagctgcctacctggagaagatgctgctggtgaaggccaatgaatttgaatttgtgctgagccagttcaaggactttggagtgcggctggagagcctgaagggcctcatcatgcatgaggaggagaacctggaccggctgcaccagcaggagaaggaaaatccagacagcttcctgaaccacgtgctggccctgacagcccagagcccagacatcgagcacctgaatgaggtgtccctgaagctgcccctgagtgatgtggccgtgaagaccctgcagaacatgaaccggcagtggatccgggccacagccacagccctggagcgctgcagcgagctgcagggcatcggcctgaatgagaagttcctgtactgctgtgagaagtggatccagctgctggagaagattgaggaggccctgaaggtggatgtggccaacagcctgcctgagctgctggagcagcagaagacctacaagatgctggaggccgaggtgtccatcaaccagaccatcgctgacagctatgtgacccagagcctgcagctgctggacaccacagaaattgaaaatagacctgagttcatcacagagttcagcaagctgacagaccgctggcagaatgctgtgcagggcgtgcggcagaggaaaggagatgtggatggcctggtgcggcagtggcaggacttcaccacctctgtggagaacctcttccgcttcctgacagacaccagccacctgctgtctgctgtgaagggccaggagcgcttcagcctgtaccagaccaggagcctcatccacgagctgaagaacaaggagatccacttccagaggaggaggaccacctgtgccctgaccctggaggccggggagaagctgctgctgaccacagacctgaagaccaaggagagcgtgggccgccgcatcagccagctgcaggacagctggaaggacatggagccccagctggccgagatgatcaagcagttccagagcacagtggagacctgggaccagtgtgagaagaagatcaaggagctgaagagccggctgcaggtgctgaaggcccagagcgaggaccccctgcctgagctgcacgaggacctgcacaatgagaaggagctgatcaaggagctggagcagagcctggcctcctggacccagaacctgaaggagctgcagaccatgaaggctgacctgaccaggcatgtgctggtggaggatgtgatggtgctgaaggagcagatcgagcacctgcaccggcagtgggaggacctgtgcctgcgggtggccatcaggaagcaggagattgaagatcggctgaacacctgggtggtgttcaatgagaagaacaaggagctgtgtgcctggctggtgcagatggagaacaaggtgctgcagacagctgacatcagcattgaggagatgattgagaagctgcagaaggactgcatggaggagatcaacctcttcagcgagaacaagctgcagctgaagcagatgggagaccagctgatcaaggccagcaacaagagcagagctgctgagattgatgacaagctgaacaagatcaatgaccgctggcagcacctgtttgatgtgattggcagccgggtgaagaagctgaaggagacctttgccttcatccagcagctggacaagaacatgagcaacctgcggacctggctggccagaattgaaagtgagctgagcaagcctgtggtgtatgatgtgtgtgatgaccaggagatccagaagaggctggccgagcagcaggacctgcagagggacatcgagcagcacagcgctggggtggagagcgtcttcaacatctgtgatgtgctgctgcatgacagtgatgcctgtgccaatgaaacagaatgtgacagcatccagcagaccaccaggagcctggaccggcgctggaggaacatctgtgccatgtccatggagaggaggatgaagattgaggagacctggaggctgtggcagaagttcctggatgactacagcagatttgaggactggctgaagtctgctgagaggacagctgcctgccccaacagcagcgaggtgctgtacaccagcgccaaggaggagctgaagagatttgaggccttccagaggcagatccacgagcggctgacccagctggagctgatcaacaagcagtacagaaggctggcccgggagaacagaacagacacagccagccggctgaagcagatggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggaggtgtttggccgggtgagccgcttccaccggcggctgaccagctgcaccccaggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaagaagatgaggagggcccctactacagcgccctgagtgatgtggagatccctgagaaccctgaggcctacctgaagatgaccaccaagaccctgaaggccagcagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaagctgagctggagatgctgaagatggccaagcccccaagtgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgccggcgggagctgatgcagctggagaaggagctggtggagcggcagccccaggtggacatgctgcaggagatcagcaacagcctgctgatcaagggccacggggaggactgcattgaagctgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccgctccttctaccccatgctgcgctacaccaacggccccccacccacctag

SEQ ID NO: 171281 - DNA, 9813 bp, Artificial Sequence; identical to SEQ ID NO: 171279
  Description of Artificial Sequence: Synthetic coding sequence

SEQ ID NO: 171282 - DNA, 1290 bp, Artificial Sequence
  Description of Artificial Sequence: Synthetic coding sequence
atggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaagctgagctggagatgctgaagatggccaagcccccaagtgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccagggcagcaagacccggcccaggagtgatgtgctcttcttcaaggacttccaccagctgagccagaacctgctgctgtggctggccagcgccaagaacagacggcagaaggcccacgtgacagaccccaaggctgacccccgggccctgctggagtgccggcgggagctgatgcagctggagaaggagctggtggagcggcagccccaggtggacatgctgcaggagatcagcaacagcctgctgatcaagggccacggggaggactgcattgaagctgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccgctccttctaccccatgctgcgctacaccaacggccccccacccacctag

SEQ ID NO: 171283 - DNA, 1671 bp, Artificial Sequence
  Description of Artificial Sequence: Synthetic coding sequence
atggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaagaagatgaggagggcccctactacagcgccctgagtgatgtggagatccctgagaaccctgaggcctacctgaagatgaccaccaagaccctgaaggccagcagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaagctgagctggagatgctgaagatggccaagcccccaagtgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccagggcagcaagacccggcccaggagtgatgtgctcttcttcaaggacttccaccagctgagccagaacctgctgctgtggctggccagcgccaagaacagacggcagaaggcccacgtgacagaccccaaggctgacccccgggccctgctggagtgccggcgggagctgatgcagctggagaaggagctggtggagcggcagccccaggtggacatgctgcaggagatcagcaacagcctgctgatcaagggccacggggaggactgcattgaagctgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagcagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccggagcttctaccccatgctgcgctacaccaatggacctccacccacctag

SEQ ID NO: 171284 - DNA, 2007 bp, Artificial Sequence
  Description of Artificial Sequence: Synthetic coding sequence
atggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggaggtgtttggccgggtgagccgcttccaccggcggctgaccagctgcaccccaggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaggaggatgaggagggcccctactacagcgccctgagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaagctgagctggagatgctgaagatggccaagcccccaagtgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgccggcgggagctgatgcagctggagaaggagctggtggagcggcagccccaggtggacatgctgcaggagatcagcaacagcctgctgatcaagggccacggggaggactgcattgaagctgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagcagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccggagcttctaccccatgctgcgctacaccaatggacctccacccacctag

SEQ ID NO: 171285 - DNA, 10626 bp, Artificial Sequence
  Description of Artificial Sequence: Synthetic coding sequence
atggaggaggacatctacaccaacctgagcaagatggagaccgtgctgggccagagcatgagcagcctgcccctgagctaccgggaggccctggagcggctggagcagagcaaggccctggtgagcaacctgatcagcaccaaggaggagctgatgaagctgcggcagatcctgcggctgctgcggctgcgctgcacagaaaatgatggcatctgcctgctgaagatcgtgtctgccctgtgggagaagtggctgagcctgctggaggccgccaaggagtgggagatgtggtgtgaggagctgaagcaggagtggaagtttgtgtctgaggagattgaaagagaggccatcatcctggacaacctgcaggaggagctgcctgagatcagcaagaccaaggaggccgccaccacagaggagctgtctgagctgctggactgcctgtgccagtatggagaaaatgtggagaagcagcagctgctgctgaccctgctgctgcagaggatccgcagcatccagaatgtgcctgagagcagtggagctgtggagaccgtgcctgccttccaggagatcacctccatgaaggagcgctgcaacaagctgctgcagaaggtgcagaagaacaaggagctggtgcagacagagatccaggagcggcacagcttcaccaaggagatcatcgccctgaagaacttcttccagcagaccaccaccagcttccagaacatggccttccaggaccaccctgagaagtctgagcagtttgaggagctgcagagcatcctgaagaagggcaagctgacctttgagaacatcatggagaagctgcgcatcaagtacagcgagatgtacaccatcgtgcctgctgagattgagagccaggtggaggagtgcaggaaggccctggaggacattgatgagaagatcagcaatgaggtgctgaagagcagccccagctatgccatgaggaggaagattgaggagatcaacaacggcctgcacaacgtggagaagatgctgcagcagaagagcaagaacatcgagaaggcccaggagatccagaagaagatgtgggatgagctggacctgtggcacagcaagctgaatgagctggacagcgaggtgcaggacatcgtggagcaggaccccggccaggcccaggagtggatggacaacctgatgatccccttccagcagtaccagcaggtgtcccagagagctgagtgcaggaccagccagctgaacaaggccaccgtgaagatggaggagtacagcgacctgctgaagagcacagaggcctggattgagaacaccagccacctgctggccaacccagctgactatgacagcctgcggaccctgagccaccacgccagcacagtgcagatggccctggaggacagcgagcagaagcacaacctgctgcacagcatcttcatggacctggaggacctgagcatcatctttgaaacagatgagctgacccagagcatccaggagctgagcaaccaggtgacagccctgcagcagaagatcatggagagcctgccccagatccagaggatggctgatgatgtggtggccattgaaagtgaggtgaagtccatggagaagagggtgtccaagatcaagaccatcctgctgagcaaggagatctttgacttcagccctgaggagcacctgaagcatggagaggtgatcctggagaacatccggcccatgaagaagaccatcgccgagatcgtgtcctaccaggtggagctgcggctgccccagacaggcatgaagcccctgcctgtgttccagaggaccaaccagctgctgcaggacatcaagctgctggagaatgtgacccaggagcagaatgagctgctgaaggtggtgatcaagcagaccaatgagtgggatgaggagattgagaacctgaagcagatcctgaacaactacagcgcccagttcagcctggagcacatgagcccagaccaggccgacaagctgccccagctgcagggcgagattgaaagaatggagaagcagatcctgagcctgaaccagaggaaggaggacctgctggtggacctgaaggccaccgtgctgaacctgcaccagcacctgaagcaggagcaggagggcgtggagcgggaccggctgcctgctgtgaccagcgaggagggcggcgtggccgagagagatgccagcgagaggaagctgaacagaagaggctccatgagctacctggccgctgtggaggaggaggtggaggagagctctgtgaagagtgacaatggagatgagaaggccgagcccagcccccagagctggagcagcctgtggaagcatgacaaggacatggaggaggaccgggccagcagcagcagcggcaccatcgtgcaggaggcctacggcaagatcagcaccagtgacaacagcatggcccagatcctgaccccagacagcctgaacacagagcagggcccagaatgttccctgcggcccaaccagacagaggagggcaccaccccacccattgaagctgacaccctggacagcagtgatgcccagggcggcctggagccccgggtggagaagaccaggcctgagcccacagaggtgctgcacgcctgcaagacccaggtggccgagctggagctgtggctgcagcaggccaacgtggccgtggagcctgagaccctgaatgctgacatgcagcaggtgctggagcagcagctggtgggctgccaggccatgctgacagaaattgagcacaaggtggccttcctgctggagacctgcaaggaccagggcctgggggacaatggagccacccagcacgaggccgaggccctgagcctgaagctgaagacagtgaagtgcaacctggagaaggtgcagatgatgctgcaggagaagcacagcgaggaccagcaccccaccatcctgaagaagagcagcgagcctgagcaccaggaggccctgcagcctgtgaacctgtctgagctggagagcatcgtgacagagcggccccagttcagccggcagaaggacttccagcagcagcaggtgctggagctgaagcccatggagcagaaggacttcatcaagttcatcgagttcaatgccaagaagatgtggccccagtactgccagcacgacaatgacaccacccaggagagcagcgccagcaaccaggccagcagcccagaaaatgatgtgcctgacagcatcctgagcccccagggccagaatggagacaagtggcagtacctgcaccacgagctgagcagcaagatcaagctgcccctgccccagctggtggagccccaggtgtccaccaacatgggcatcctgcccagcgtgaccatgtacaacttccgctaccccaccacagaggagctgaagacctacaccacccagctggaggacctgcggcaggaggccagcaacctgcagacccaggagaacatgacagaggaggcctacatcaacctggacaagaagctgtttgagctgttcctgaccctgagccagtgcctgagctctgtggaggagatgctggagatgccccggctgtacagagaagatggcagcggccagcaggtgcactatgagaccctggccctggagctgaagaagctgtacctggccctgagtgacaagaagggggacctgctgaaggccatgacctggccaggagagaacaccaacctgctgctggagtgctttgacaacctgcaggtgtgcctggagcacacccaggccgctgctgtgtgccgcagcaagagcctgaaggccggcctggactacaacagaagctaccagaatgagatcaagaggctgtaccaccagctgatcaagagcaagaccagcctgcagcagagcctgaatgagatcagcggccagagcgtggccgagcagctgcagaaggcagatgcctacacagtggagctggagaatgctgagagccgggtggccaagctgagagatgaaggagagcggctgcacctgccctatgccctgctgcaggaggtgtacaagctggaggatgtgctggacagcatgtggggcatgctgcgggcccgctacacagagctgagcagcccctttgtgacagagagccagcaggatgccctgctgcagggcatggtggagctggtgaagattggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaaccgggagaccttctgggccgagcaggtgacagaggtgaagatcctggaggagaagagccggcagtgtggcatgaagctgcagagcctgctgcagaagtgggaggagtttgatgaaaattatgccagcctggagaaggacctggagatcctgatcagcaccctgcccagcgtgtccctggtggaggagacagaggagcggctggtggagcgcatctccttctaccagcagatcaagaggaacatcggcggcaagcacgcccggctgtaccagaccctgaatgaaggcaagcagctggtggcctctgtgtcctgcccagagctggagggccagatcgccaagctggaggagcagtggctgagcctgaacaagaagattgaccacgagctgcaccggctgcaggccctgctgaagcacctgctgagctacaacagagacagcgaccagctgaccaagtggctggagagcagccagcacaccctgaactactggaaggagcagagcctgaatgtgtcccaggacctggacaccatccgcagcaacatcaacaacttctttgagttcagcaaggaggtggatgagaagagcagcctgaagacagctgtgatcagcatcggcaaccagctgctgcacctgaaggagacagacacagccaccctgcgggccagcctggcccagtttgagcagaagtggaccatgctgatcacccagctgcctgacatccaggagaagctgcaccagctgcagatggagaagctgcccagcaggaaggccatcacagagatgatctcctggatgaacaacgtggagcaccagaccagtgatgaggacagcgtgcacagccccagcagcgccagccaggtgaagcacctgctgcagaagcacaaggagttcaggatggagatggactacaagcagtggatcgtggactttgtgaaccagagcctgctgcagctgagcacctgtgatgtggagagcaagagatatgaaagaacagaatttgctgagcacctgggggagatgaaccggcagtggcaccgggtgcacggcatgctgaacaggaagatccagcacctggagcagctgctggagagcatcacagaaagtgagaacaagatccagatcctgaacaactggctggaggcccaggaggagcggctgaagaccctgcagaagccagagagcgtcatctctgtgcagaagctgctgctggactgccaggacatcgagaaccagctggccatcaagagcaaggccctggatgagctgaagcagagctacctgaccctggagagcggggctgtgcccctgctggaggacacagccagcagaattgatgagctgttccagaagaggagctctgtgctgacccaggtgaaccagctgaagacctccatgcagagcgtgctgcaggagtggaagatctatgaccagctgtatgatgaggtgaacatgatgaccatccgcttctggtactgcatggagcacagcaagcctgtggtgctgagcctggagaccctgcgctgccaggtggagaacctgcagagcctgcaggatgaagctgagagcagcgagggctcctgggagaagctgcaggaggtgattggcaagctgaagggcctgtgccccagcgtggccgagatcatcgaggagaagtgccagaacacccacaagcgctggacccaggtgaaccaggccatcgctgaccagctgcagaaggcccagagcctgctgcagctgtggaaggcctacagcaatgcccacggggaggccgccgcccggctgaagcagcaggaggccaagttccagcagctggccaacatctccatgagcggcaacaacctggccgagatcctgcccccagccctgcaggacatcaaggagctgcagcatgatgtgcagaagaccaaggaggccttcctgcagaacagctctgtgctggaccggctgccccagcctgctgagagcagcacccacatgctgctgcccggccccctgcacagcctgcagagagctgcctacctggagaagatgctgctggtgaaggccaatgaatttgaatttgtgctgagccagttcaaggactttggagtgcggctggagagcctgaagggcctcatcatgcatgaggaggagaacctggaccggctgcaccagcaggagaaggaaaatccagacagcttcctgaaccacgtgctggccctgacagcccagagcccagacatcgagcacctgaatgaggtgtccctgaagctgcccctgagtgatgtggccgtgaagaccctgcagaacatgaaccggcagtggatccgggccacagccacagccctggagcgctgcagcgagctgcagggcatcggcctgaatgagaagttcctgtactgctgtgagaagtggatccagctgctggagaagattgaggaggccctgaaggtggatgtggccaacagcctgcctgagctgctggagcagcagaagacctacaagatgctggaggccgaggtgtccatcaaccagaccatcgctgacagctatgtgacccagagcctgcagctgctggacaccacagaaattgaaaatagacctgagttcatcacagagttcagcaagctgacagaccgctggcagaatgctgtgcagggcgtgcggcagaggaaaggagatgtggatggcctggtgcggcagtggcaggacttcaccacctctgtggagaacctcttccgcttcctgacagacaccagccacctgctgtctgctgtgaagggccaggagcgcttcagcctgtaccagaccaggagcctcatccacgagctgaagaacaaggagatccacttccagaggaggaggaccacctgtgccctgaccctggaggccggggagaagctgctgctgaccacagacctgaagaccaaggagagcgtgggccgccgcatcagccagctgcaggacagctggaaggacatggagccccagctggccgagatgatcaagcagttccagagcacagtggagacctgggaccagtgtgagaagaagatcaaggagctgaagagccggctgcaggtgctgaaggcccagagcgaggaccccctgcctgagctgcacgaggacctgcacaatgagaaggagctgatcaaggagctggagcagagcctggcctcctggacccagaacctgaaggagctgcagaccatgaaggctgacctgaccaggcatgtgctggtggaggatgtgatggtgctgaaggagcagatcgagcacctgcaccggcagtgggaggacctgtgcctgcgggtggccatcaggaagcaggagattgaagatcggctgaacacctgggtggtgttcaatgagaagaacaaggagctgtgtgcctggctggtgcagatggagaacaaggtgctgcagacagctgacatcagcattgaggagatgattgagaagctgcagaaggactgcatggaggagatcaacctcttcagcgagaacaagctgcagctgaagcagatgggagaccagctgatcaaggccagcaacaagagcagagctgctgagattgatgacaagctgaacaagatcaatgaccgctggcagcacctgtttgatgtgattggcagccgggtgaagaagctgaaggagacctttgccttcatccagcagctggacaagaacatgagcaacctgcggacctggctggccagaattgaaagtgagctgagcaagcctgtggtgtatgatgtgtgtgatgaccaggagatccagaagaggctggccgagcagcaggacctgcagagggacatcgagcagcacagcgctggggtggagagcgtcttcaacatctgtgatgtgctgctgcatgacagtgatgcctgtgccaatgaaacagaatgtgacagcatccagcagaccaccaggagcctggaccggcgctggaggaacatctgtgccatgtccatggagaggaggatgaagattgaggagacctggaggctgtggcagaagttcctggatgactacagcagatttgaggactggctgaagtctgctgagaggacagctgcctgccccaacagcagcgaggtgctgtacaccagcgccaaggaggagctgaagagatttgaggccttccagaggcagatccacgagcggctgacccagctggagctgatcaacaagcagtacagaaggctggcccgggagaacagaacagacacagccagccggctgaagcagatggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggaggtgtttggccgggtgagccgcttccaccggcggctgaccagctgcaccccaggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaagaagatgaggagggcccctactacagcgccctgagtgatgtggagatccctgagaaccctgaggcctacctgaagatgaccaccaagaccctgaaggccagcagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaagctgagctggagatgctgaagatggccaagcccccaagtgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgccggcgggagctgatgcagctggagaaggagctggtggagcggcagccccaggtggacatgctgcaggagatcagcaacagcctgctgatcaagggccacggggaggactgcattgaagctgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccgctccttctaccccatgctgcgctacaccaacggccccccacccacctag

SEQ ID NO: 171286 - DNA, 2292 bp, Artificial Sequence
  Description of Artificial Sequence: Synthetic coding sequence
atgtccatggagaggaggatgaagattgaggagacctggaggctgtggcagaagttcctggatgactacagcagatttgaggactggctgaagtctgctgagaggacagctgcctgccccaacagcagcgaggtgctgtacaccagcgccaaggaggagctgaagagatttgaggccttccagaggcagatccacgagcggctgacccagctggagctgatcaacaagcagtacagaaggctggcccgggagaacagaacagacacagccagccggctgaagcagatggtgcatgagggcaaccagcgctgggacaacctgcagaggagagtgacagctgtgctgcggcggctgcggcacttcaccaaccagcgggaggagtttgagggcacccgggagagcatcctggtgtggctgacagagatggacctgcagctgaccaacgtggagcacttcagcgagagtgatgctgatgacaagatgaggcagctgaatggcttccagcaggagatcaccctgaacaccaacaagattgaccagctgattgtgtttggagagcagctgatccagaagtctgagcccctggatgctgtgctgattgaagatgagctggaggagctgcaccgctactgccaggaggtgtttggccgggtgagccgcttccaccggcggctgaccagctgcaccccaggcctggaggatgagaaggaggcctctgaaaatgaaacagacatggaggacccccgggagatccagacagacagctggaggaagagaggagagagcgaggagcccagcagcccccagagcctgtgccacctggtggcccctggccacgagaggagcggctgtgagacccctgtgtctgtggacagcatccccctggagtgggaccacactggagatgtgggcggcagcagcagccatgaagaagatgaggagggcccctactacagcgccctgagcggcaagagcatcagtgatggccacagctggcacgtgcctgacagccccagctgcccagagcaccactacaagcagatggagggggacagaaatgtgccccctgtgcccccagccagcagcaccccctacaagccaccctacggcaagctgctgctgcccccaggcacagatggcggcaaggagggcccccgggtgctgaatggaaacccccagcaggaggatggcggcctggccggcatcacagagcagcagagcggggcctttgaccgctgggagatgatccaggcccaggagctgcacaacaagctgaagatcaagcagaacctgcagcagctgaacagcgacatcagcgccatcaccacctggctgaagaagacagaggccgagctggagatgctgaagatggccaagccacccagcgacatccaggagattgagctgcgggtgaagaggctgcaggagatcctgaaggcctttgacacctacaaggccctggtggtgtctgtgaatgtgagcagcaaggagttcctgcagacagagagccctgagagcacagagctgcagagccggctgcggcagctgagcctgctgtgggaggccgcccagggcgctgtggacagctggaggggcggcctgcggcagagcctgatgcagtgccaggacttccaccagctgagccagaacctgctgctgtggctggccagcgccaagaacagacggcagaaggcccacgtgacagaccccaaggctgacccccgggccctgctggagtgcagaagagagctgatgcagctggagaaggagctggtggagcggcagccccaggtggacatgctgcaggagatcagcaacagcctgctgatcaagggccatggagaggactgcatcgaggccgaggagaaggtgcacgtgattgagaagaagctgaagcagctgcgggagcaggtgtcccaggacctgatggccctgcagggcacccagaacccagccagccccctgcccagctttgatgaggtggacagcggggaccagcccccagccacctctgtgcctgccccccgggccaagcagttccgggctgtgaggaccacagaaggagaggaggagacagagagccgggtgcccggcagcacccggccccagaggagcttcctgagccgggtggtgcgggccgccctgcccctgcagctgctgctgctgctgctgctgctgctggcctgcctgctgcccagcagcgaggaggactacagctgcacccaggccaacaactttgcccgctccttctaccccatgctgcgctacaccaacggccccccacccacctag

SEQ ID NO: 171287 - DNA, 7251 bp, Artificial Sequence
  Description of Artificial Sequence: Synthetic coding sequence
atggagcagttccccaaggagaccgtggtggagagcagcggccccaaggtgctggagacagctgaggagatccaggagcggcggcaggaggtgctgacccgctaccagagcttcaaggagcgggtggccgagcggggccagaagctggaggacagctaccacctgcaggtgttcaagagagatgctgatgacctgggcaagtggatcatggagaaggtgaacatcctgacagacaagagctatgaggaccccaccaacatccagggcaagtaccagaagcaccagagcctggaggccgaggtgcagaccaagagccggctgatgtctgagctggagaagacccgggaggagcgcttcaccatgggccacagcgcccacgaggagaccaaggcccacatcgaggagctgcggcacctgtgggacctgctgctggagctgaccctggagaagggggaccagctgctgcgggccctgaagttccagcagtatgtgcaggagtgtgccgacatcctggagtggattggagacaaggaggccatcgccacctctgtggagctgggggaggactgggagaggacagaggtgctgcacaagaagtttgaggacttccaggtggagctggtggccaaggagggccgggtggtggaggtgaaccagtatgccaatgaatgtgccgaggagaaccacccagacctgcccctcatccagagcaagcagaatgaggtgaatgctgcctgggagcggctgcggggcctggccctgcagaggcagaaggccctgagcaatgctgccaacctgcagcgcttcaagagagatgtgacagaggccatccagtggatcaaggagaaggagcctgtgctgaccagcgaggactatggcaaggacctggtggccagcgagggcctcttccacagccacaagggcctggagaggaacctggccgtgatgtctgacaaggtgaaggagctgtgtgccaaggccgagaagctgaccctgagccaccccagtgatgccccccagatccaggagatgaaggaggacctggtgtcctcctgggagcacatccgggccctggccaccagccgctatgagaagctgcaggccacctactggtaccaccgcttcagcagtgactttgatgagctgagcggctggatgaatgagaagacagctgccatcaatgctgatgagctgcccacagatgtggccggcggggaggtgctgctggacagacaccagcagcacaagcatgaaattgacagctatgatgaccgcttccagagcgcagatgagaccggccaggacctggtgaatgccaaccacgaggccagtgatgaggtgcgggagaagatggagatcctggacaacaactggacagccctgctggagctgtgggatgagcggcaccggcagtatgagcagtgcctggacttccacctgttctacagagattctgagcaggtggacagctggatgagccggcaggaggccttcctggagaatgaagacctgggcaacagcctgggcagcgctgaggccctgctgcagaagcatgaagattttgaggaggccttcaccgcccaggaggagaagatcatcaccgtggacaagacagccaccaagctgattggagatgaccactatgacagcgagaacatcaaggccatcagagatggcctgctggccaggagagatgccctgcgggagaaggccgccacccggcggcggctgctgaaggagagcctgctgctgcagaagctgtatgaagattctgatgacctgaagaactggatcaacaagaagaagaagctggctgatgatgaggactacaaggacatccagaacctgaagagccgggtgcagaagcagcaggtgtttgagaaggagctggccgtgaacaagacccagctggagaacatccagaagacaggccaggagatgattgagggcggccactacgccagtgacaacgtgaccacccggctgtctgaggtggccagcctgtgggaggagctgctggaggccaccaagcagaagggcacccagctgcacgaggccaaccagcagctgcagtttgaaaataatgctgaggacctgcagcgctggctggaggatgtggagtggcaggtgaccagtgaagattatggcaagggcctggccgaggtgcagaaccggctgaggaagcacggcctgctggagagcgctgtggccgcccggcaggaccaggtggacatcctgacagacctggccgcctactttgaggagatcggccacccagacagcaaggacatccgggcccggcaggagagcctggtgtgccgctttgaggccctgaaggagcccctggccaccaggaagaagaagctgctggacctgctgcacctgcagctgatctgccgggacacagaagatgaggaggcctggatccaggagacagagcccagcgccaccagcacctacctgggcaaggacctgattgccagcaagaagctgctgaacagacacagggtcatcctggagaacatcgccagccatgagccccgcatccaggagatcacagagcggggcaacaagatggtggaggagggccactttgctgctgaagatgtggccagccgggtgaagagcctgaaccagaacatggagagcctgcgggcccgggccgcccggcggcagaatgacctggaggccaacgtgcagttccagcagtacctggccgacctgcatgaagctgagacctggatccgggagaaggagcccatcgtggacaacaccaactatggagcagatgaggaggccgccggggccctgctgaagaagcatgaggccttcctgctggacctgaacagctttggagacagcatgaaggccctgaggaaccaggccaatgcctgccagcagcagcaggccgcccctgtggagggcgtggccggggagcagagggtgatggccctgtatgacttccaggcccggagcccccgggaggtgaccatgaagaagggagatgtgctgaccctgctgagcagcatcaacaaggactggtggaaggtggaggccgctgaccaccagggcatcgtgcctgctgtgtatgtgcggcggctggcccatgatgagttccccatgctgccccagaggcggcgggaggagcccggcaacatcacccagaggcaggagcagatcgagaaccagtaccgcagcctgctggacagagctgaggagaggagaagaaggctgctgcagcgctacaatgagttcctgctggcctatgaagctggggacatgctggagtggatccaggagaagaaggccgagaacacaggagtggagctggatgatgtgtgggagctgcagaagaagtttgatgagttccagaaggacctgaacaccaatgagccccggctgcgggacatcaacaaggtggctgatgacctgctgtttgagggcctgctgaccccagagggcgcccagatccggcaggagctgaacagccgctggggcagcctgcagaggctggctgatgagcagaggcagctgctgggcagcgcccatgctgtggaggtgttccaccgggaggctgatgacaccaaggagcagatcgagaagaagtgccaggccctgtctgctgctgaccccggcagtgacctcttctctgtgcaggccctgcagaggagacatgagggctttgagcgggacctggtgcccctgggggacaaggtgaccatcctgggggagacagctgagcggctgtctgagagccacccagatgccacagaggacctgcagaggcagaagatggagctgaatgaggcctgggaggacctgcagggccgcaccaaggacaggaaggagagcctgaatgaggcccagaagttctacctgttcctgagcaaggcccgggacctgcagaactggatcagcagcatcggcggcatggtgagcagccaggagctggccgaggacctgaccggcatcgagatcctgctggagcggcaccaggagcacagagctgacatggaggccgaggcccccaccttccaggccctggaggacttctctgctgagctgattgacagcggccaccacgccagccctgagattgagaagaagctgcaggccgtgaagctggagagagatgacctggagaaggcctgggagaagaggaagaagatcctggaccagtgcctggagctgcagatgttccagggcaactgtgaccaggtggagagctggatggtggcccgggagaacagcctgcggagtgatgacaagagcagcctggacagcctggaggccctgatgaagaagagagatgacctggacaaggccatcacagcccaggagggcaagatcacagacctggagcactttgctgagagcctgattgctgatgagcactacgccaaggaggagatcgccacccggctgcagagggtgctggaccgctggaaggccctgaaggcccagctgattgatgagaggaccaagctgggggactatgccaacctgaagcagttctacagagacctggaggagctggaggagtggatcagcgagatgctgcccacagcctgtgatgagagctacaaggatgccaccaacatccagaggaagtacctgaagcaccagacctttgcccacgaggtggatggccgctctgagcaggtgcacggcgtcatcaacctgggcaacagcctgattgaatgttctgcctgtgatggaaatgaggaggccatgaaggagcagctggagcagctgaaggagcactgggaccacctgctggagaggaccaatgacaagggcaagaagctgaatgaggccagccggcagcagcgcttcaacaccagcatccgggactttgagttctggctgtctgaggccgagaccctgctggccatgaaggaccaggcccgggacctggccagcgctggcaacctgctgaagaagcaccagctgctggagcgggagatgctggcccgggaggatgccctgaaggacctgaacaccctggccgaggacctgctgagcagcggcaccttcaacgtggaccagatcgtgaagaagaaggacaacgtgaacaagcgcttcctgaatgtgcaggagctggccgccgcccaccacgagaagctgaaggaggcctatgccctcttccagttcttccaggacctggatgatgaggagagctggattgaggagaagctgatccgggtgagcagccaggactatggccgggacctgcagggcgtgcagaacctgctgaagaagcacaagaggctggagggggagctggtggcccacgagcccgccatccagaatgtgctggacatggccgagaagctgaaggacaaggctgctgtgggccaggaggagatccagctgcggctggcccagtttgtggagcactgggagaagctgaaggagctggccaaggcccggggcctgaagctggaggagagcctggagtacctgcagttcatgcagaatgctgaggaggaggaggcctggatcaatgagaagaatgccctggccgtgcggggggactgtggggacaccctggccgccacccagagcctgctgatgaagcatgaggccctggagaatgactttgctgtgcatgagaccagggtgcagaatgtgtgtgcccagggcgaggacatcctgaacaaggaggagagccagaacaaggagatcagcagcaagattgaggccctgaatgagaagacccccagcctggccaaggccatcgccgcctggaagctgcagctggaggatgattatgccttccaggagttcaactggaaggcagatgtggtggaggcctggattgctgacaaggagaccagcctgaagaccaatggaaatggagctgacctgggggacttcctgaccctgctggccaagcaggacaccctggatgccagcctgcagagcttccagcaggagcggctgcctgagatcacagacctgaaggacaagctgatcagcgcccagcacaaccagagcaaggccatcgaggagagatatgctgccctgctgaagcgctgggagcagctgctggaggccagcgctgtgcaccggcagaagctgctggagaagcagctgcccctgcagaaggccgaggacctgtttgtggagtttgcccacaaggccagcgccctgaacaactggtgtgagaagatggaggagaacctgtctgagcctgtgcactgtgtgtccctgaatgagatccggcagctgcagaaggaccacgaggacttcctggccagcctggcccgggcccaggccgacttcaagtgcctgctggagctggaccagcagatcaaggccctgggcgtgcccagcagcccctacacctggctgactgtggaggtgctggagaggacctggaagcacctgagtgacatcatcgaggagcgggagcaggagctgcagaaggaggaggcccggcaggtgaagaactttgagatgtgccaggagtttgagcagaatgccagcaccttcctgcagtggatcctggagacccgggcctacttcctggatggcagcctgctgaaggagaccggcaccctggagagccagctggaggccaacaagaggaagcagaaggagatccaggccatgaagaggcagctgaccaagatcgtggacctgggggacaacctggaggatgccctgatcctggacatcaagtacagcaccatcggcctggcccagcagtgggaccagctgtaccagctgggcctgaggatgcagcacaacctggagcagcagatccaggccaaggacatcaagggcgtgtctgaggagaccctgaaggagttcagcaccatctacaagcactttgatgagaacctgaccggccgcctgacccacaaggagttccgcagctgcctgcggggcctgaactactacctgcccatggtggaggaggatgagcacgagcccaagtttgagaagttcctggatgctgtggaccccggcaggaagggctacgtgtccctggaggactacacagccttcctgattgacaaggagagcgagaacatcaagagcagtgatgaaattgaaaatgccttccaggccctggccgagggcaagagctacatcaccaaggaggacatgaagcaggccctgaccccagagcaggtgtccttctgtgccacccacatgcagcagtacatggacccccggggccgcagccacctgagcggctatgactatgtgggcttcaccaacagctacttcggcaactag

SEQ ID NO: 171288 - DNA, 7260 bp, Artificial Sequence
  Description of Artificial Sequence: Synthetic coding sequence
atggagcagttccccaaggagaccgtggtggagagcagcggccccaaggtgctggagacagctgaggagatccaggagcggcggcaggaggtgctgacccgctaccagagcttcaaggagcgggtggccgagcggggccagaagctggaggacagctaccacctgcaggtgttcaagagagatgctgatgacctgggcaagtggatcatggagaaggtgaacatcctgacagacaagagctatgaggaccccaccaacatccagggcaagtaccagaagcaccagagcctggaggccgaggtgcagaccaagagccggctgatgtctgagctggagaagacccgggaggagcgcttcaccatgggccacagcgcccacgaggagaccaaggcccacatcgaggagctgcggcacctgtgggacctgctgctggagctgaccctggagaagggggaccagctgctgcgggccctgaagttccagcagtatgtgcaggagtgtgccgacatcctggagtggattggagacaaggaggccatcgccacctctgtggagctgggggaggactgggagaggacagaggtgctgcacaagaagtttgaggacttccaggtggagctggtggccaaggagggccgggtggtggaggtgaaccagtatgccaatgaatgtgccgaggagaaccacccagacctgcccctcatccagagcaagcagaatgaggtgaatgctgcctgggagcggctgcggggcctggccctgcagaggcagaaggccctgagcaatgctgccaacctgcagcgcttcaagagagatgtgacagaggccatccagtggatcaaggagaaggagcctgtgctgaccagcgaggactatggcaaggacctggtggccagcgagggcctcttccacagccacaagggcctggagaggaacctggccgtgatgtctgacaaggtgaaggagctgtgtgccaaggccgagaagctgaccctgagccaccccagtgatgccccccagatccaggagatgaaggaggacctggtgtcctcctgggagcacatccgggccctggccaccagccgctatgagaagctgcaggccacctactggtaccaccgcttcagcagtgactttgatgagctgagcggctggatgaatgagaagacagctgccatcaatgctgatgagctgcccacagatgtggccggcggggaggtgctgctggacagacaccagcagcacaagcatgaaattgacagctatgatgaccgcttccagagcgcagatgagaccggccaggacctggtgaatgccaaccacgaggccagtgatgaggtgcgggagaagatggagatcctggacaacaactggacagccctgctggagctgtgggatgagcggcaccggcagtatgagcagtgcctggacttccacctgttctacagagattctgagcaggtggacagctggatgagccggcaggaggccttcctggagaatgaagacctgggcaacagcctgggcagcgctgaggccctgctgcagaagcatgaagattttgaggaggccttcaccgcccaggaggagaagatcatcaccgtggacaagacagccaccaagctgattggagatgaccactatgacagcgagaacatcaaggccatcagagatggcctgctggccaggagagatgccctgcgggagaaggccgccacccggcggcggctgctgaaggagagcctgctgctgcagaagctgtatgaagattctgatgacctgaagaactggatcaacaagaagaagaagctggctgatgatgaggactacaaggacatccagaacctgaagagccgggtgcagaagcagcaggtgtttgagaaggagctggccgtgaacaagacccagctggagaacatccagaagacaggccaggagatgattgagggcggccactacgccagtgacaacgtgaccacccggctgtctgaggtggccagcctgtgggaggagctgctggaggccaccaagcagaagggcacccagctgcacgaggccaaccagcagctgcagtttgaaaataatgctgaggacctgcagcgctggctggaggatgtggagtggcaggtgaccagtgaagattatggcaagggcctggccgaggtgcagaaccggctgaggaagcacggcctgctggagagcgctgtggccgcccggcaggaccaggtggacatcctgacagacctggccgcctactttgaggagatcggccacccagacagcaaggacatccgggcccggcaggagagcctggtgtgccgctttgaggccctgaaggagcccctggccaccaggaagaagaagctgctggacctgctgcacctgcagctgatctgccgggacacagaagatgaggaggcctggatccaggagacagagcccagcgccaccagcacctacctgggcaaggacctgattgccagcaagaagctgctgaacagacacagggtcatcctggagaacatcgccagccatgagccccgcatccaggagatcacagagcggggcaacaagatggtggaggagggccactttgctgctgaagatgtggccagccgggtgaagagcctgaaccagaacatggagagcctgcgggcccgggccgcccggcggcagaatgacctggaggccaacgtgcagttccagcagtacctggccgacctgcatgaagctgagacctggatccgggagaaggagcccatcgtggacaacaccaactatggagcagatgaggaggccgccggggccctgctgaagaagcatgaggccttcctgctggacctgaacagctttggagacagcatgaaggccctgaggaaccaggccaatgcctgccagcagcagcaggccgcccctgtggagggcgtggccggggagcagagggtgatggccctgtatgacttccaggcccggagcccccgggaggtgaccatgaagaagggagatgtgctgaccctgctgagcagcatcaacaaggactggtggaaggtggaggccgctgaccaccagggcatcgtgcctgctgtgtatgtgcggcggctggcccatgatgagttccccatgctgccccagaggcggcgggaggagcccggcaacatcacccagaggcaggagcagatcgagaaccagtaccgcagcctgctggacagagctgaggagaggagaagaaggctgctgcagcgctacaatgagttcctgctggcctatgaagctggggacatgctggagtggatccaggagaagaaggccgagaacacaggagtggagctggatgatgtgtgggagctgcagaagaagtttgatgagttccagaaggacctgaacaccaatgagccccggctgcgggacatcaacaaggtggctgatgacctgctgtttgagggcctgctgaccccagagggcgcccagatccggcaggagctgaacagccgctggggcagcctgcagaggctggctgatgagcagaggcagctgctgggcagcgcccatgctgtggaggtgttccaccgggaggctgatgacaccaaggagcagatcgagaagaagtgccaggccctgtctgctgctgaccccggcagtgacctcttctctgtgcaggccctgcagaggagacatgagggctttgagcgggacctggtgcccctgggggacaaggtgaccatcctgggggagacagctgagcggctgtctgagagccacccagatgccacagaggacctgcagaggcagaagatggagctgaatgaggcctgggaggacctgcagggccgcaccaaggacaggaaggagagcctgaatgaggcccagaagttctacctgttcctgagcaaggcccgggacctgcagaactggatcagcagcatcggcggcatggtgagcagccaggagctggccgaggacctgaccggcatcgagatcctgctggagcggcaccaggagcacagagctgacatggaggccgaggcccccaccttccaggccctggaggacttctctgctgagctgattgacagcggccaccacgccagccctgagattgagaagaagctgcaggccgtgaagctggagagagatgacctggagaaggcctgggagaagaggaagaagatcctggaccagtgcctggagctgcagatgttccagggcaactgtgaccaggtggagagctggatggtggcccgggagaacagcctgcggagtgatgacaagagcagcctggacagcctggaggccctgatgaagaagagagatgacctggacaaggccatcacagcccaggagggcaagatcacagacctggagcactttgctgagagcctgattgctgatgagcactacgccaaggaggagatcgccacccggctgcagagggtgctggaccgctggaaggccctgaaggcccagctgattgatgagaggaccaagctgggggactatgccaacctgaagcagttctacagagacctggaggagctggaggagtggatcagcgagatgctgcccacagcctgtgatgagagctacaaggatgccaccaacatccagaggaagtacctgaagcaccagacctttgcccacgaggtggatggccgctctgagcaggtgcacggcgtcatcaacctgggcaacagcctgattgaatgttctgcctgtgatggaaatgaggaggccatgaaggagcagctggagcagctgaaggagcactgggaccacctgctggagaggaccaatgacaagggcaagaagctgaatgaggccagccggcagcagcgcttcaacaccagcatccgggactttgagttctggctgtctgaggccgagaccctgctggccatgaaggaccaggcccgggacctggccagcgctggcaacctgctgaagaagcaccagctgctggagcgggagatgctggcccgggaggatgccctgaaggacctgaacaccctggccgaggacctgctgagcagcggcaccttcaacgtggaccagatcgtgaagaagaaggacaacgtgaacaagcgcttcctgaatgtgcaggagctggccgccgcccaccacgagaagctgaaggaggcctatgccctcttccagttcttccaggacctggatgatgaggagagctggattgaggagaagctgatccgggtgagcagccaggactatggccgggacctgcagggcgtgcagaacctgctgaagaagcacaagaggctggagggggagctggtggcccacgagcccgccatccagaatgtgctggacatggccgagaagctgaaggacaaggctgctgtgggccaggaggagatccagctgcggctggcccagtttgtggagcactgggagaagctgaaggagctggccaaggcccggggcctgaagctggaggagagcctggagtacctgcagttcatgcagaatgctgaggaggaggaggcctggatcaatgagaagaatgccctggccgtgcggggggactgtggggacaccctggccgccacccagagcctgctgatgaagcatgaggccctggagaatgactttgctgtgcatgagaccagggtgcagaatgtgtgtgcccagggcgaggacatcctgaacaaggtgctgcaggaggagagccagaacaaggagatcagcagcaagattgaggccctgaatgagaagacccccagcctggccaaggccatcgccgcctggaagctgcagctggaggatgattatgccttccaggagttcaactggaaggcagatgtggtggaggcctggattgctgacaaggagaccagcctgaagaccaatggaaatggagctgacctgggggacttcctgaccctgctggccaagcaggacaccctggatgccagcctgcagagcttccagcaggagcggctgcctgagatcacagacctgaaggacaagctgatcagcgcccagcacaaccagagcaaggccatcgaggagagatatgctgccctgctgaagcgctgggagcagctgctggaggccagcgctgtgcaccggcagaagctgctggagaagcagctgcccctgcagaaggccgaggacctgtttgtggagtttgcccacaaggccagcgccctgaacaactggtgtgagaagatggaggagaacctgtctgagcctgtgcactgtgtgtccctgaatgagatccggcagctgcagaaggaccacgaggacttcctggccagcctggcccgggcccaggccgacttcaagtgcctgctggagctggaccagcagatcaaggccctgggcgtgcccagcagcccctacacctggctgactgtggaggtgctggagaggacctggaagcacctgagtgacatcatcgaggagcgggagcaggagctgcagaaggaggaggcccggcaggtgaagaactttgagatgtgccaggagtttgagcagaatgccagcaccttcctgcagtggatcctggagacccgggcctacttcctggatggcagcctgctgaaggagaccggcaccctggagagccagctggaggccaacaagaggaagcagaaggagatccaggccatgaagaggcagctgaccaagatcgtggacctgggggacaacctggaggatgccctgatcctggacatcaagtacagcaccatcggcctggcccagcagtgggaccagctgtaccagctgggcctgaggatgcagcacaacctggagcagcagatccaggccaaggacatcaagggcgtgtctgaggagaccctgaaggagttcagcaccatctacaagcactttgatgagaacctgaccggccgcctgacccacaaggagttccgcagctgcctgcggggcctgaactactacctgcccatggtggaggaggatgaacatgagcccaagtttgagaagttcctggatgctgtggaccccggcaggaagggctacgtgtccctggaggactacacagccttcctgattgacaaggagagcgagaacatcaagagcagtgatgaaattgaaaatgccttccaggccctggccgagggcaagagctacatcaccaaggaggacatgaagcaggccctgaccccagagcaggtgtccttctgtgccacccacatgcagcagtacatggacccccggggccgcagccacctgagcggctatgactatgtgggcttcaccaacagctactttggaaattag

SEQ ID NO: 171289 - DNA, 7434 bp, Artificial Sequence
  Description of Artificial Sequence: Synthetic coding sequence
atggaccccagcggcgtgaaggtgctggagacagctgaggacatccaggagcggcggcagcaggtgctggaccgctaccaccgcttcaaggagctgagcaccctgcggcggcagaagctggaggacagctaccgcttccagttcttccagagagatgctgaggagctggagaagtggatccaggagaagctgcagatcgccagtgatgagaactacaaggaccccaccaacctgcagggcaagctgcagaagcaccaggcctttgaggccgaggtgcaggccaacagcggggccatcgtgaagctggatgaaacaggcaacctgatgatcagcgagggccactttgccagcgagaccatccgcacccggctgatggagctgcaccggcagtgggagctgctgctggagaagatgagggagaagggcatcaagctgctgcaggcccagaagctggtgcagtacctgagagaatgtgaagatgtgatggactggatcaatgacaaggaggccatcgtgaccagcgaggagctgggccaggacctggagcacgtggaggtgctgcagaagaagtttgaggagttccagacagacatggccgcccacgaggagcgggtgaatgaggtgaaccagtttgctgccaagctgatccaggagcagcaccctgaggaggagctgatcaagaccaagcaggatgaggtgaatgctgcctggcagaggctgaagggcctggccctgcagaggcagggcaagctgtttggagctgctgaggtgcagcgcttcaacagagatgtggatgagaccatctcctggatcaaggagaaggagcagctgatggccagtgatgactttggccgggacctggcctctgtgcaggccctgctgaggaagcatgagggcctggagcgggacctggccgccctggaggacaaggtgaaggccctgtgtgccgaggccgaccggctgcagcagagccaccccctgagcgccacccagatccaggtgaagcgggaggagctgatcaccaactgggagcagatccgcaccctggccgctgagagacatgcccggctgaatgacagctaccgcctgcagcgcttcctggccgacttccgggacctgacctcctgggtgacagagatgaaggccctgatcaatgctgatgagctggccagtgatgtggccggggctgaggccctgctggacagacaccaggagcacaagggggagattgatgcccacgaggacagcttcaagtctgcagatgaaagtggccaggccctgctggccgccggccactacgccagtgatgaggtgcgggagaagctgactgtgctgtctgaggagcgggccgccctgctggagctgtgggagctgcggcggcagcagtatgagcagtgcatggacctgcagctgttctacagagacacagagcaggtggacaactggatgagcaagcaggaggccttcctgctgaatgaagacctgggggacagcctggacagcgtggaggccctgctgaagaagcatgaggactttgagaagagcctgagcgcccaggaggagaagatcacagccctggatgaatttgccaccaagctgatccagaacaaccactacgccatggaggatgtggccaccaggagagatgccctgctgagcagaagaaatgccctgcacgagcgggccatgagaagaagagcccagctggccgacagcttccacctgcagcagttcttccgggacagtgatgagctgaagtcctgggtgaatgagaagatgaagacagccacagatgaggcctacaaggaccccagcaacctgcagggcaaggtgcagaagcaccaggcctttgaagctgagctgagcgccaaccagagcagaattgatgccctggagaaggccggccagaagctgattgatgtgaaccactacgccaaggatgaggtggccgccaggatgaatgaggtgatcagcctgtggaagaagctgctggaggccacagagctgaagggcatcaagctgcgggaggccaaccagcagcagcagttcaacagaaatgtggaggacatcgagctgtggctgtatgaggtggagggccacctggccagtgatgattatggcaaggacctgaccaacgtgcagaacctgcagaagaagcacgccctgctggaggctgatgtggccgcccaccaggacagaattgatggcatcaccatccaggcccggcagttccaggatgctggccactttgatgctgagaacatcaagaagaagcaggaggccctggtggcccgctatgaggccctgaaggagcccatggtggccaggaagcagaagctggccgacagcctgcggctgcagcagctgttcagagatgtggaggatgaggagacctggatccgggagaaggagcccatcgccgccagcaccaacagaggcaaggacctgattggagtgcagaacctgctgaagaagcaccaggccctgcaggccgagattgctggccacgagccccgcatcaaggctgtgacccagaagggaaatgccatggtggaggagggccactttgctgctgaagatgtgaaggccaagctgcacgagctgaaccagaagtgggaggccctgaaggccaaggccagccagaggcggcaggacctggaggacagcctgcaggcccagcagtactttgctgatgccaatgaggccgagagctggatgagggagaaggagcccatcgtgggcagcacagattatggcaaggatgaggacagcgctgaggccctgctgaagaagcatgaggccctgatgtctgacctgagcgcctacggcagcagcatccaggccctgcgggagcaggcccagagctgccggcagcaggtggcccccacagatgatgaaacaggcaaggagctggtgctggccctgtatgactaccaggagaagagcccccgggaggtgaccatgaagaagggggacatcctgaccctgctgaacagcaccaacaaggactggtggaaggtggaggtgaatgaccggcagggctttgtgcctgctgcctacgtgaagaagctggaccctgcccagagcgccagccgggagaacctgctggaggagcagggcagcatcgccctgcggcaggagcagattgacaaccagacccgcatcaccaaggaggccggctctgtgtccctgaggatgaagcaggtggaggagctgtaccacagcctgctggagctgggggagaagaggaagggcatgctggagaagagctgcaagaagttcatgctgttccgggaggccaatgagctgcagcagtggatcaatgagaaggaggccgccctgaccagcgaggaggtgggcgctgacctggagcaggtggaggtgctgcagaagaagtttgatgacttccagaaggacctgaaggccaatgaaagccggctgaaggacatcaacaaggtggccgaggacctggagagcgagggcctgatggccgaggaggtgcaggccgtgcagcagcaggaggtgtatggcatgatgcccagagatgaaacagacagcaagacagccagcccctggaagagcgcccggctgatggtgcacacagtggccaccttcaacagcatcaaggagctgaatgaacgctggaggagcctgcagcagctggccgaggagaggagccagctgctgggcagcgcccacgaggtgcagcgcttccacagagatgctgatgagaccaaggagtggattgaggagaagaaccaggccctgaacacagacaactacggccatgacctggcctctgtgcaggccctgcagaggaagcatgagggctttgagcgggacctggccgccctgggggacaaggtgaacagcctgggggagacagctgagcggctcatccagagccaccctgagagcgctgaggacctgcaggagaagtgcacagagctgaaccaggcctggagcagcctgggcaagagagctgaccagaggaaggccaagctgggggacagccatgacctgcagcgcttcctgagtgacttccgggacctgatgtcctggatcaatggcatccggggcctggtgtccagtgatgagctggccaaggatgtgactggagctgaggccctgctggagcggcaccaggagcacaggacagaaattgatgcccgggccggcaccttccaggcctttgagcagtttggccagcagctgctggcccacggccactacgccagccctgagatcaagcagaagctggacatcctggaccaggagagagctgacctggagaaggcctgggtgcagaggaggatgatgctggaccagtgcctggagctgcagctgttccaccgggactgtgagcaggccgagaactggatggccgcccgggaggccttcctgaacacagaagataaaggagacagcctggacagcgtggaggccctgatcaagaagcatgaggactttgacaaggccatcaacgtgcaggaggagaagattgctgccctgcaggcctttgctgaccagctgattgctgctggccactacgccaagggggacatcagcagcagaagaaatgaggtgctggaccgctggaggcggctgaaggcccagatgattgagaagaggagcaagctgggggagagccagaccctgcagcagttcagcagagatgtggatgaaattgaggcctggatcagcgagaagctgcagacagccagtgatgagagctacaaggaccccaccaacatccaggtgtccctgatgctgagcaagcaccagaagcaccaggcctttgaggccgagctgcacgccaatgctgaccgcatccggggcgtgattgacatgggcaacagcctcatcgagcggggggcctgtgccggctctgaagatgctgtgaaggcccggctggccgccctggccgaccagtggcagttcctggtgcagaagtctgctgagaagagccagaagctgaaggaggccaacaagcagcagaacttcaacacaggcatcaaggactttgacttctggctgtctgaggtggaggccctgctggcctctgaagattatggcaaggacctggcctctgtgaacaacctgctgaagaagcaccagctgctggaggccgacatcagcgcccacgaggaccggctgaaggacctgaacagccaggccgacagcctgatgaccagcagcgcctttgacaccagccaggtgaaggacaagagggacaccatcaatggccgcttccagaagatcaagtccatggccgccagcagaagagccaagctgaatgaaagccaccggctgcaccagttcttccgggacatggatgatgaggagagctggatcaaggagaagaagctgctggtgggctctgaagattatggccgggacctgactggagtgcagaacctgaggaagaagcacaagaggctggaggccgagctggccgcccacgagcccgccatccagggcgtgctggacaccgggaagaagctgagtgatgacaacaccatcggcaaggaggagatccagcagaggctggcccagtttgtggagcactggaaggagctgaagcagctggccgccgcccggggccagaggctggaggagagcctggagtaccagcagtttgtggccaacgtggaggaggaggaggcctggatcaatgagaagatgaccctggtggcctctgaagattatggagacaccctggccgccatccagggcctgctgaagaagcatgaggcctttgaaacagacttcaccgtgcacaaggacagagtgaatgatgtgtgcaccaacggccaggacctgatcaagaagaacaaccaccacgaggagaacatcagcagcaagatgaagggcctgaatggcaaggtgtctgacctggagaaggccgccgcccagaggaaggccaagctggatgaaaattctgccttcctgcagttcaactggaaggcagatgtggtggagagctggattggagagaaggagaacagcctgaagacagatgattatggccgggacctgagctctgtgcagaccctgctgaccaagcaggagacctttgatgctggcctgcaggccttccagcaggagggcatcgccaacatcacagccctgaaggaccagctgctggccgccaagcacgtgcagagcaaggccatcgaggcccggcatgccagcctgatgaagcgctggagccagctgctggccaacagcgctgccaggaagaagaagctgctggaggcccagagccacttcaggaaggtggaggacctcttcctgacctttgccaagaaggccagcgccttcaacagctggtttgaaaatgctgaggaggacctgacagatcctgtgcgctgcaacagcctggaggagatcaaggccctgcgggaggcccatgatgccttccgcagcagcctgagcagcgcccaggccgacttcaaccagctggccgagctggaccggcagatcaagagcttccgggtggccagcaacccctacacctggttcaccatggaggccctggaggagacctggaggaacctgcagaagatcatcaaggagcgggagctggagctgcagaaggagcagaggcggcaggaggagaatgacaagctgcggcaggagtttgcccagcacgccaatgccttccaccagtggatccaggagacccgctgccagcctgctggggccagctgcatggtggaggagagcggcaccctggagagccagctggaggccaccaagaggaagcaccaggagatccgggccatgaggagccagctgaagaagattgaggacctgggcgccgccatggaggaggccctgatcctggacaacaagtacacagagcacagcacagtgggcctggcccagcagtgggaccagctggaccagctgggcatgaggatgcagcacaacctggagcagcagatccaggccaggaacaccactggagtgacagaggaggccctgaaggagttctccatgatgttcaagcactttgacaaggacaagagcggccgcctgaaccaccaggagttcaagagctgcctgcggagcctgggctatgacctgcccatggtggaggagggggagccagaccctgagtttgaggccatcctggacacagtggaccccaacagagatggccacgtgtccctgcaggagtacatggccttcatgatcagccgggagacagaaaatgtgaagagcagcgaggagattgagagcgccttccgggccctgagcagcgagggcaagccctacgtgaccaaggaggagctgtaccagaacctgacccgggagcaggccgactactgtgtgagccacatgaagccctacgtggatggcaagggccgggagctgcccacagcctttgattatgtggagttcaccaggagcctgtttgtgaactag

SEQ ID NO: 171290 - DNA, 7359 bp, Artificial Sequence
  Description of Artificial Sequence: Synthetic coding sequence
atggaccccagcggcgtgaaggtgctggagacagctgaggacatccaggagcggcggcagcaggtgctggaccgctaccaccgcttcaaggagctgagcaccctgcggcggcagaagctggaggacagctaccgcttccagttcttccagagagatgctgaggagctggagaagtggatccaggagaagctgcagatcgccagtgatgagaactacaaggaccccaccaacctgcagggcaagctgcagaagcaccaggcctttgaggccgaggtgcaggccaacagcggggccatcgtgaagctggatgaaacaggcaacctgatgatcagcgagggccactttgccagcgagaccatccgcacccggctgatggagctgcaccggcagtgggagctgctgctggagaagatgagggagaagggcatcaagctgctgcaggcccagaagctggtgcagtacctgagagaatgtgaagatgtgatggactggatcaatgacaaggaggccatcgtgaccagcgaggagctgggccaggacctggagcacgtggaggtgctgcagaagaagtttgaggagttccagacagacatggccgcccacgaggagcgggtgaatgaggtgaaccagtttgctgccaagctgatccaggagcagcaccctgaggaggagctgatcaagaccaagcaggatgaggtgaatgctgcctggcagaggctgaagggcctggccctgcagaggcagggcaagctgtttggagctgctgaggtgcagcgcttcaacagagatgtggatgagaccatctcctggatcaaggagaaggagcagctgatggccagtgatgactttggccgggacctggcctctgtgcaggccctgctgaggaagcatgagggcctggagcgggacctggccgccctggaggacaaggtgaaggccctgtgtgccgaggccgaccggctgcagcagagccaccccctgagcgccacccagatccaggtgaagcgggaggagctgatcaccaactgggagcagatccgcaccctggccgctgagagacatgcccggctgaatgacagctaccgcctgcagcgcttcctggccgacttccgggacctgacctcctgggtgacagagatgaaggccctgatcaatgctgatgagctggccagtgatgtggccggggctgaggccctgctggacagacaccaggagcacaagggggagattgatgcccacgaggacagcttcaagtctgcagatgaaagtggccaggccctgctggccgccggccactacgccagtgatgaggtgcgggagaagctgactgtgctgtctgaggagcgggccgccctgctggagctgtgggagctgcggcggcagcagtatgagcagtgcatggacctgcagctgttctacagagacacagagcaggtggacaactggatgagcaagcaggaggccttcctgctgaatgaagacctgggggacagcctggacagcgtggaggccctgctgaagaagcatgaggactttgagaagagcctgagcgcccaggaggagaagatcacagccctggatgaatttgccaccaagctgatccagaacaaccactacgccatggaggatgtggccaccaggagagatgccctgctgagcagaagaaatgccctgcacgagcgggccatgagaagaagagcccagctggccgacagcttccacctgcagcagttcttccgggacagtgatgagctgaagtcctgggtgaatgagaagatgaagacagccacagatgaggcctacaaggaccccagcaacctgcagggcaaggtgcagaagcaccaggcctttgaagctgagctgagcgccaaccagagcagaattgatgccctggagaaggccggccagaagctgattgatgtgaaccactacgccaaggatgaggtggccgccaggatgaatgaggtgatcagcctgtggaagaagctgctggaggccacagagctgaagggcatcaagctgcgggaggccaaccagcagcagcagttcaacagaaatgtggaggacatcgagctgtggctgtatgaggtggagggccacctggccagtgatgattatggcaaggacctgaccaacgtgcagaacctgcagaagaagcacgccctgctggaggctgatgtggccgcccaccaggacagaattgatggcatcaccatccaggcccggcagttccaggatgctggccactttgatgctgagaacatcaagaagaagcaggaggccctggtggcccgctatgaggccctgaaggagcccatggtggccaggaagcagaagctggccgacagcctgcggctgcagcagctgttcagagatgtggaggatgaggagacctggatccgggagaaggagcccatcgccgccagcaccaacagaggcaaggacctgattggagtgcagaacctgctgaagaagcaccaggccctgcaggccgagattgctggccacgagccccgcatcaaggctgtgacccagaagggaaatgccatggtggaggagggccactttgctgctgaagatgtgaaggccaagctgcacgagctgaaccagaagtgggaggccctgaaggccaaggccagccagaggcggcaggacctggaggacagcctgcaggcccagcagtactttgctgatgccaatgaggccgagagctggatgagggagaaggagcccatcgtgggcagcacagattatggcaaggatgaggacagcgctgaggccctgctgaagaagcatgaggccctgatgtctgacctgagcgcctacggcagcagcatccaggccctgcgggagcaggcccagagctgccggcagcaggtggcccccacagatgatgaaacaggcaaggagctggtgctggccctgtatgactaccaggagaagagcccccgggaggtgaccatgaagaagggggacatcctgaccctgctgaacagcaccaacaaggactggtggaaggtggaggtgaatgaccggcagggctttgtgcctgctgcctacgtgaagaagctggaccctgcccagagcgccagccgggagaacctgctggaggagcagggcagcatcgccctgcggcaggagcagattgacaaccagtaccacagcctgctggagctgggggagaagaggaagggcatgctggagaagagctgcaagaagttcatgctgttccgggaggccaatgagctgcagcagtggatcaatgagaaggaggccgccctgaccagcgaggaggtgggcgctgacctggagcaggtggaggtgctgcagaagaagtttgatgacttccagaaggacctgaaggccaatgaaagccggctgaaggacatcaacaaggtggccgaggacctggagagcgagggcctgatggccgaggaggtgcaggccgtgcagcagcaggaggtgtatggcatgatgcccagagatgaaacagacagcaagacagccagcccctggaagagcgcccggctgatggtgcacacagtggccaccttcaacagcatcaaggagctgaatgaacgctggaggagcctgcagcagctggccgaggagaggagccagctgctgggcagcgcccacgaggtgcagcgcttccacagagatgctgatgagaccaaggagtggattgaggagaagaaccaggccctgaacacagacaactacggccatgacctggcctctgtgcaggccctgcagaggaagcatgagggctttgagcgggacctggccgccctgggggacaaggtgaacagcctgggggagacagctgagcggctcatccagagccaccctgagagcgctgaggacctgcaggagaagtgcacagagctgaaccaggcctggagcagcctgggcaagagagctgaccagaggaaggccaagctgggggacagccatgacctgcagcgcttcctgagtgacttccgggacctgatgtcctggatcaatggcatccggggcctggtgtccagtgatgagctggccaaggatgtgactggagctgaggccctgctggagcggcaccaggagcacaggacagaaattgatgcccgggccggcaccttccaggcctttgagcagtttggccagcagctgctggcccacggccactacgccagccctgagatcaagcagaagctggacatcctggaccaggagagagctgacctggagaaggcctgggtgcagaggaggatgatgctggaccagtgcctggagctgcagctgttccaccgggactgtgagcaggccgagaactggatggccgcccgggaggccttcctgaacacagaagataaaggagacagcctggacagcgtggaggccctgatcaagaagcatgaggactttgacaaggccatcaacgtgcaggaggagaagattgctgccctgcaggcctttgctgaccagctgattgctgctggccactacgccaagggggacatcagcagcagaagaaatgaggtgctggaccgctggaggcggctgaaggcccagatgattgagaagaggagcaagctgggggagagccagaccctgcagcagttcagcagagatgtggatgaaattgaggcctggatcagcgagaagctgcagacagccagtgatgagagctacaaggaccccaccaacatccagagcaagcaccagaagcaccaggcctttgaagctgagctgcacgccaatgctgaccgcatccggggcgtcatcgacatgggcaacagcctgattgagcggggggcctgtgccggctctgaagatgctgtgaaggcccggctggccgccctggccgaccagtggcagttcctggtgcagaagtctgctgagaagagccagaagctgaaggaggccaacaagcagcagaacttcaacacaggcatcaaggactttgacttctggctgtctgaggtggaggccctgctggccagcgaggactatggcaaggacctggcctctgtgaacaacctgctgaagaagcaccagctgctggaggccgacatcagcgcccatgaagatcggctgaaggacctgaacagccaggccgacagcctgatgaccagcagcgcctttgacaccagccaggtgaaggacaagagggacaccatcaatggccgcttccagaagatcaagtccatggccgccagccggcgggccaagctgaatgaaagccaccggctgcaccagttcttccgggacatggatgatgaggagagctggatcaaggagaagaagctgctggtgggcagcgaggactatggccgggacctgactggagtgcagaacctgaggaagaagcacaagaggctggaggccgagctggccgcccacgagcccgccatccagggcgtgctggacaccgggaagaagctgagtgatgacaacaccatcggcaaggaggagatccagcagaggctggcccagtttgtggagcactggaaggagctgaagcagctggccgccgcccggggccagaggctggaggagagcctggagtaccagcagtttgtggccaacgtggaggaggaggaggcctggatcaatgagaagatgaccctggtggccagcgaggactatggagacaccctggccgccatccagggcctgctgaagaagcatgaggcctttgaaacagacttcaccgtgcacaaggacagagtgaatgatgtgtgcaccaacggccaggacctgatcaagaagaacaaccaccacgaggagaacatcagcagcaagatgaagggcctgaatggcaaggtgtctgacctggagaaggctgctgcccagaggaaggccaagctggatgagaacagcgccttcctgcagttcaactggaaggcagatgtggtggagagctggattggagagaaggagaacagcctgaagacagatgattatggccgggacctgagctctgtgcagaccctgctgaccaagcaggagacctttgatgctggcctgcaggccttccagcaggagggcatcgccaacatcacagccctgaaggaccagctgctggccgccaagcacgtgcagagcaaggccatcgaggcccggcatgccagcctgatgaagcgctggagccagctgctggccaacagcgctgccaggaagaagaagctgctggaggcccagagccacttcaggaaggtggaggacctcttcctgacctttgccaagaaggccagcgccttcaacagctggtttgaaaatgctgaggaggacctgacagatcctgtgcgctgcaacagcctggaggagatcaaggccctgcgggaggcccatgatgccttccgcagcagcctgagcagcgcccaggccgacttcaaccagctggccgagctggaccggcagatcaagagcttccgggtggccagcaacccctacacctggttcaccatggaggccctggaggagacctggaggaacctgcagaagatcatcaaggagcgggagctggagctgcagaaggagcagaggcggcaggaggagaatgacaagctgcggcaggagtttgcccagcacgccaatgccttccaccagtggatccaggagacccgctgccagcctgctggggccagctgcatggtggaggagagcggcaccctggagagccagctggaggccaccaagaggaagcaccaggagatccgggccatgaggagccagctgaagaagattgaggacctgggcgccgccatggaggaggccctgatcctggacaacaagtacacagagcacagcacagtgggcctggcccagcagtgggaccagctggaccagctgggcatgaggatgcagcacaacctggagcagcagatccaggccaggaacaccaccggggtgacagaggaggccctgaaggagttctccatgatgttcaagcactttgacaaggacaagagcggccgcctgaaccaccaggagttcaagagctgcctgcggagcctgggctatgacctgcccatggtggaggagggggagccagaccctgagtttgaggccatcctggacacagtggaccccaacagagatggccacgtgtccctgcaggagtacatggccttcatgatcagccgggagacagaaaatgtgaagagcagcgaggagattgaaagtgccttccgggccctgagcagcgagggcaagccctacgtgaccaaggaggagctgtaccagaacctgacccgggagcaggccgactactgtgtgagccacatgaagccctacgtggatggcaagggccgggagctgcccacagcctttgattatgtggagttcaccaggagcctgtttgtgaactag

SEQ ID NO: 171291 - DNA, 1485 bp, Artificial Sequence
  Description of Artificial Sequence: Synthetic coding sequence
atggccgccagcagaagagccaagctgaatgaaagccaccggctgcaccagttcttccgggacatggatgatgaggagagctggatcaaggagaagaagctgctggtgggctctgaagattatggccgggacctgactggagtgcagaacctgaggaagaagcacaagaggctggaggccgagctggccgcccacgagcccgccatccagggcgtgctggacaccgggaagaagctgagtgatgacaacaccatcggcaaggaggagatccagcagaggctggcccagtttgtggagcactggaaggagctgaagcagctggccgccgcccggggccagaggctggaggagagcctggagtaccagcagtttgtggccaacgtggaggaggaggaggcctggatcaatgagaagatgaccctggtggcctctgaagattatggagacaccctggccgccatccagggcctgctgaagaagcatgaggcctttgaaacagacttcaccgtgcacaaggacagagtgaatgatgtgtgcaccaacggccaggacctgatcaagaagaacaaccaccacgaggagaacatcagcagcaagatgaagggcctgaatggcaaggtgtctgacctggagaaggccgccgcccagaggaaggccaagctggatgaaaattctgccttcctgcagttcaactggaaggcagatgtggtggagagctggattggagagaaggagaacagcctgaagacagatgattatggccgggacctgagctctgtgcagaccctgctgaccaagcaggagacctttgatgctggcctgcaggccttccagcaggagggcatcgccaacatcacagccctgaaggaccagctgctggccgccaagcacgtgcagagcaaggccatcgaggcccggcatgccagcctgatgaagcgctggagccagctgctggccaacagcgctgccaggaagaagaagctgctggaggcccagagccacttcaggaaggtggaggacctcttcctgacctttgccaagaaggccagcgccttcaacagctggtttgaaaatgctgaggaggacctgacagatcctgtgcgctgcaacagcctggaggagatcaaggccctgcgggaggcccatgatgccttccgcagcagcctgagcagcgcccaggccgacttcaaccagctggccgagctggaccggcagatcaagagcttccgggtggccagcaacccctacacctggttcaccatggaggccctggaggagacctggaggaacctgcagaagatcatcaaggagcgggagctggagctgcagaaggagcagaggcggcaggaggagaatgacaagctgcggcaggagtttgcccagcacgccaatgccttccaccagtggatccaggagacccgctgccagaggaaggatggccagctgcagggcggccgggtgggggacccccgcatcccagcctag

SEQ ID NO: 171292 - DNA, 7419 bp, Artificial Sequence
  Description of Artificial Sequence: Synthetic coding sequence
atggaccccagcggcgtgaaggtgctggagacagctgaggacatccaggagcggcggcagcaggtgctggaccgctaccaccgcttcaaggagctgagcaccctgcggcggcagaagctggaggacagctaccgcttccagttcttccagagagatgctgaggagctggagaagtggatccaggagaagctgcagatcgccagtgatgagaactacaaggaccccaccaacctgcagggcaagctgcagaagcaccaggcctttgaggccgaggtgcaggccaacagcggggccatcgtgaagctggatgaaacaggcaacctgatgatcagcgagggccactttgccagcgagaccatccgcacccggctgatggagctgcaccggcagtgggagctgctgctggagaagatgagggagaagggcatcaagctgctgcaggcccagaagctggtgcagtacctgagagaatgtgaagatgtgatggactggatcaatgacaaggaggccatcgtgaccagcgaggagctgggccaggacctggagcacgtggaggtgctgcagaagaagtttgaggagttccagacagacatggccgcccacgaggagcgggtgaatgaggtgaaccagtttgctgccaagctgatccaggagcagcaccctgaggaggagctgatcaagaccaagcaggatgaggtgaatgctgcctggcagaggctgaagggcctggccctgcagaggcagggcaagctgtttggagctgctgaggtgcagcgcttcaacagagatgtggatgagaccatctcctggatcaaggagaaggagcagctgatggccagtgatgactttggccgggacctggcctctgtgcaggccctgctgaggaagcatgagggcctggagcgggacctggccgccctggaggacaaggtgaaggccctgtgtgccgaggccgaccggctgcagcagagccaccccctgagcgccacccagatccaggtgaagcgggaggagctgatcaccaactgggagcagatccgcaccctggccgctgagagacatgcccggctgaatgacagctaccgcctgcagcgcttcctggccgacttccgggacctgacctcctgggtgacagagatgaaggccctgatcaatgctgatgagctggccagtgatgtggccggggctgaggccctgctggacagacaccaggagcacaagggggagattgatgcccacgaggacagcttcaagtctgcagatgaaagtggccaggccctgctggccgccggccactacgccagtgatgaggtgcgggagaagctgactgtgctgtctgaggagcgggccgccctgctggagctgtgggagctgcggcggcagcagtatgagcagtgcatggacctgcagctgttctacagagacacagagcaggtggacaactggatgagcaagcaggaggccttcctgctgaatgaagacctgggggacagcctggacagcgtggaggccctgctgaagaagcatgaggactttgagaagagcctgagcgcccaggaggagaagatcacagccctggatgaatttgccaccaagctgatccagaacaaccactacgccatggaggatgtggccaccaggagagatgccctgctgagcagaagaaatgccctgcacgagcgggccatgagaagaagagcccagctggccgacagcttccacctgcagcagttcttccgggacagtgatgagctgaagtcctgggtgaatgagaagatgaagacagccacagatgaggcctacaaggaccccagcaacctgcagggcaaggtgcagaagcaccaggcctttgaagctgagctgagcgccaaccagagcagaattgatgccctggagaaggccggccagaagctgattgatgtgaaccactacgccaaggatgaggtggccgccaggatgaatgaggtgatcagcctgtggaagaagctgctggaggccacagagctgaagggcatcaagctgcgggaggccaaccagcagcagcagttcaacagaaatgtggaggacatcgagctgtggctgtatgaggtggagggccacctggccagtgatgattatggcaaggacctgaccaacgtgcagaacctgcagaagaagcacgccctgctggaggctgatgtggccgcccaccaggacagaattgatggcatcaccatccaggcccggcagttccaggatgctggccactttgatgctgagaacatcaagaagaagcaggaggccctggtggcccgctatgaggccctgaaggagcccatggtggccaggaagcagaagctggccgacagcctgcggctgcagcagctgttcagagatgtggaggatgaggagacctggatccgggagaaggagcccatcgccgccagcaccaacagaggcaaggacctgattggagtgcagaacctgctgaagaagcaccaggccctgcaggccgagattgctggccacgagccccgcatcaaggctgtgacccagaagggaaatgccatggtggaggagggccactttgctgctgaagatgtgaaggccaagctgcacgagctgaaccagaagtgggaggccctgaaggccaaggccagccagaggcggcaggacctggaggacagcctgcaggcccagcagtactttgctgatgccaatgaggccgagagctggatgagggagaaggagcccatcgtgggcagcacagattatggcaaggatgaggacagcgctgaggccctgctgaagaagcatgaggccctgatgtctgacctgagcgcctacggcagcagcatccaggccctgcgggagcaggcccagagctgccggcagcaggtggcccccacagatgatgaaacaggcaaggagctggtgctggccctgtatgactaccaggagaagagcccccgggaggtgaccatgaagaagggggacatcctgaccctgctgaacagcaccaacaaggactggtggaaggtggaggtgaatgaccggcagggctttgtgcctgctgcctacgtgaagaagctggaccctgcccagagcgccagccgggagaacctgctggaggagcagggcagcatcgccctgcggcaggagcagattgacaaccagacccgcatcaccaaggaggccggctctgtgtccctgaggatgaagcaggtggaggagctgtaccacagcctgctggagctgggggagaagaggaagggcatgctggagaagagctgcaagaagttcatgctgttccgggaggccaatgagctgcagcagtggatcaatgagaaggaggccgccctgaccagcgaggaggtgggcgctgacctggagcaggtggaggtgctgcagaagaagtttgatgacttccagaaggacctgaaggccaatgaaagccggctgaaggacatcaacaaggtggccgaggacctggagagcgagggcctgatggccgaggaggtgcaggccgtgcagcagcaggaggtgtatggcatgatgcccagagatgaaacagacagcaagacagccagcccctggaagagcgcccggctgatggtgcacacagtggccaccttcaacagcatcaaggagctgaatgaacgctggaggagcctgcagcagctggccgaggagaggagccagctgctgggcagcgcccacgaggtgcagcgcttccacagagatgctgatgagaccaaggagtggattgaggagaagaaccaggccctgaacacagacaactacggccatgacctggcctctgtgcaggccctgcagaggaagcatgagggctttgagcgggacctggccgccctgggggacaaggtgaacagcctgggggagacagctgagcggctcatccagagccaccctgagagcgctgaggacctgcaggagaagtgcacagagctgaaccaggcctggagcagcctgggcaagagagctgaccagaggaaggccaagctgggggacagccatgacctgcagcgcttcctgagtgacttccgggacctgatgtcctggatcaatggcatccggggcctggtgtccagtgatgagctggccaaggatgtgactggagctgaggccctgctggagcggcaccaggagcacaggacagaaattgatgcccgggccggcaccttccaggcctttgagcagtttggccagcagctgctggcccacggccactacgccagccctgagatcaagcagaagctggacatcctggaccaggagagagctgacctggagaaggcctgggtgcagaggaggatgatgctggaccagtgcctggagctgcagctgttccaccgggactgtgagcaggccgagaactggatggccgcccgggaggccttcctgaacacagaagataaaggagacagcctggacagcgtggaggccctgatcaagaagcatgaggactttgacaaggccatcaacgtgcaggaggagaagattgctgccctgcaggcctttgctgaccagctgattgctgctggccactacgccaagggggacatcagcagcagaagaaatgaggtgctggaccgctggaggcggctgaaggcccagatgattgagaagaggagcaagctgggggagagccagaccctgcagcagttcagcagagatgtggatgaaattgaggcctggatcagcgagaagctgcagacagccagtgatgagagctacaaggaccccaccaacatccagagcaagcaccagaagcaccaggcctttgaagctgagctgcacgccaatgctgaccgcatccggggcgtcatcgacatgggcaacagcctgattgagcggggggcctgtgccggctctgaagatgctgtgaaggcccggctggccgccctggccgaccagtggcagttcctggtgcagaagtctgctgagaagagccagaagctgaaggaggccaacaagcagcagaacttcaacacaggcatcaaggactttgacttctggctgtctgaggtggaggccctgctggccagcgaggactatggcaaggacctggcctctgtgaacaacctgctgaagaagcaccagctgctggaggccgacatcagcgcccatgaagatcggctgaaggacctgaacagccaggccgacagcctgatgaccagcagcgcctttgacaccagccaggtgaaggacaagagggacaccatcaatggccgcttccagaagatcaagtccatggccgccagccggcgggccaagctgaatgaaagccaccggctgcaccagttcttccgggacatggatgatgaggagagctggatcaaggagaagaagctgctggtgggcagcgaggactatggccgggacctgactggagtgcagaacctgaggaagaagcacaagaggctggaggccgagctggccgcccacgagcccgccatccagggcgtgctggacaccgggaagaagctgagtgatgacaacaccatcggcaaggaggagatccagcagaggctggcccagtttgtggagcactggaaggagctgaagcagctggccgccgcccggggccagaggctggaggagagcctggagtaccagcagtttgtggccaacgtggaggaggaggaggcctggatcaatgagaagatgaccctggtggccagcgaggactatggagacaccctggccgccatccagggcctgctgaagaagcatgaggcctttgaaacagacttcaccgtgcacaaggacagagtgaatgatgtgtgcaccaacggccaggacctgatcaagaagaacaaccaccacgaggagaacatcagcagcaagatgaagggcctgaatggcaaggtgtctgacctggagaaggctgctgcccagaggaaggccaagctggatgagaacagcgccttcctgcagttcaactggaaggcagatgtggtggagagctggattggagagaaggagaacagcctgaagacagatgattatggccgggacctgagctctgtgcagaccctgctgaccaagcaggagacctttgatgctggcctgcaggccttccagcaggagggcatcgccaacatcacagccctgaaggaccagctgctggccgccaagcacgtgcagagcaaggccatcgaggcccggcatgccagcctgatgaagcgctggagccagctgctggccaacagcgctgccaggaagaagaagctgctggaggcccagagccacttcaggaaggtggaggacctcttcctgacctttgccaagaaggccagcgccttcaacagctggtttgaaaatgctgaggaggacctgacagatcctgtgcgctgcaacagcctggaggagatcaaggccctgcgggaggcccatgatgccttccgcagcagcctgagcagcgcccaggccgacttcaaccagctggccgagctggaccggcagatcaagagcttccgggtggccagcaacccctacacctggttcaccatggaggccctggaggagacctggaggaacctgcagaagatcatcaaggagcgggagctggagctgcagaaggagcagaggcggcaggaggagaatgacaagctgcggcaggagtttgcccagcacgccaatgccttccaccagtggatccaggagaccaggacctacctgctggatggcagctgcatggtggaggagagcggcaccctggagagccagctggaggccaccaagaggaagcaccaggagatccgggccatgaggagccagctgaagaagattgaggacctgggcgccgccatggaggaggccctgatcctggacaacaagtacacagagcacagcacagtgggcctggcccagcagtgggaccagctggaccagctgggcatgaggatgcagcacaacctggagcagcagatccaggccaggaacaccaccggggtgacagaggaggccctgaaggagttctccatgatgttcaagcactttgacaaggacaagagcggccgcctgaaccaccaggagttcaagagctgcctgcggagcctgggctatgacctgcccatggtggaggagggggagccagaccctgagtttgaggccatcctggacacagtggaccccaacagagatggccacgtgtccctgcaggagtacatggccttcatgatcagccgggagacagaaaatgtgaagagcagcgaggagattgaaagtgccttccgggccctgagcagcgagggcaagccctacgtgaccaaggaggagctgtaccagaacctgacccgggagcaggccgactactgtgtgagccacatgaagccctacgtggatggcaagggccgggagctgcccacagcctttgattatgtggagttcaccaggagcctgtttgtgaactag

SEQ ID NO: 171293 - DNA, 7434 bp, Artificial Sequence
  Description of Artificial Sequence: Synthetic coding sequence
atggaccccagcggcgtgaaggtgctggagacagctgaggacatccaggagcggcggcagcaggtgctggaccgctaccaccgcttcaaggagctgagcaccctgcggcggcagaagctggaggacagctaccgcttccagttcttccagagagatgctgaggagctggagaagtggatccaggagaagctgcagatcgccagtgatgagaactacaaggaccccaccaacctgcagggcaagctgcagaagcaccaggcctttgaggccgaggtgcaggccaacagcggggccatcgtgaagctggatgaaacaggcaacctgatgatcagcgagggccactttgccagcgagaccatccgcacccggctgatggagctgcaccggcagtgggagctgctgctggagaagatgagggagaagggcatcaagctgctgcaggcccagaagctggtgcagtacctgagagaatgtgaagatgtgatggactggatcaatgacaaggaggccatcgtgaccagcgaggagctgggccaggacctggagcacgtggaggtgctgcagaagaagtttgaggagttccagacagacatggccgcccacgaggagcgggtgaatgaggtgaaccagtttgctgccaagctgatccaggagcagcaccctgaggaggagctgatcaagaccaagcaggatgaggtgaatgctgcctggcagaggctgaagggcctggccctgcagaggcagggcaagctgtttggagctgctgaggtgcagcgcttcaacagagatgtggatgagaccatctcctggatcaaggagaaggagcagctgatggccagtgatgactttggccgggacctggcctctgtgcaggccctgctgaggaagcatgagggcctggagcgggacctggccgccctggaggacaaggtgaaggccctgtgtgccgaggccgaccggctgcagcagagccaccccctgagcgccacccagatccaggtgaagcgggaggagctgatcaccaactgggagcagatccgcaccctggccgctgagagacatgcccggctgaatgacagctaccgcctgcagcgcttcctggccgacttccgggacctgacctcctgggtgacagagatgaaggccctgatcaatgctgatgagctggccagtgatgtggccggggctgaggccctgctggacagacaccaggagcacaagggggagattgatgcccacgaggacagcttcaagtctgcagatgaaagtggccaggccctgctggccgccggccactacgccagtgatgaggtgcgggagaagctgactgtgctgtctgaggagcgggccgccctgctggagctgtgggagctgcggcggcagcagtatgagcagtgcatggacctgcagctgttctacagagacacagagcaggtggacaactggatgagcaagcaggaggccttcctgctgaatgaagacctgggggacagcctggacagcgtggaggccctgctgaagaagcatgaggactttgagaagagcctgagcgcccaggaggagaagatcacagccctggatgaatttgccaccaagctgatccagaacaaccactacgccatggaggatgtggccaccaggagagatgccctgctgagcagaagaaatgccctgcacgagcgggccatgagaagaagagcccagctggccgacagcttccacctgcagcagttcttccgggacagtgatgagctgaagtcctgggtgaatgagaagatgaagacagccacagatgaggcctacaaggaccccagcaacctgcagggcaaggtgcagaagcaccaggcctttgaagctgagctgagcgccaaccagagcagaattgatgccctggagaaggccggccagaagctgattgatgtgaaccactacgccaaggatgaggtggccgccaggatgaatgaggtgatcagcctgtggaagaagctgctggaggccacagagctgaagggcatcaagctgcgggaggccaaccagcagcagcagttcaacagaaatgtggaggacatcgagctgtggctgtatgaggtggagggccacctggccagtgatgattatggcaaggacctgaccaacgtgcagaacctgcagaagaagcacgccctgctggaggctgatgtggccgcccaccaggacagaattgatggcatcaccatccaggcccggcagttccaggatgctggccactttgatgctgagaacatcaagaagaagcaggaggccctggtggcccgctatgaggccctgaaggagcccatggtggccaggaagcagaagctggccgacagcctgcggctgcagcagctgttcagagatgtggaggatgaggagacctggatccgggagaaggagcccatcgccgccagcaccaacagaggcaaggacctgattggagtgcagaacctgctgaagaagcaccaggccctgcaggccgagattgctggccacgagccccgcatcaaggctgtgacccagaagggaaatgccatggtggaggagggccactttgctgctgaagatgtgaaggccaagctgcacgagctgaaccagaagtgggaggccctgaaggccaaggccagccagaggcggcaggacctggaggacagcctgcaggcccagcagtactttgctgatgccaatgaggccgagagctggatgagggagaaggagcccatcgtgggcagcacagattatggcaaggatgaggacagcgctgaggccctgctgaagaagcatgaggccctgatgtctgacctgagcgcctacggcagcagcatccaggccctgcgggagcaggcccagagctgccggcagcaggtggcccccacagatgatgaaacaggcaaggagctggtgctggccctgtatgactaccaggagaagagcccccgggaggtgaccatgaagaagggggacatcctgaccctgctgaacagcaccaacaaggactggtggaaggtggaggtgaatgaccggcagggctttgtgcctgctgcctacgtgaagaagctggaccctgcccagagcgccagccgggagaacctgctggaggagcagggcagcatcgccctgcggcaggagcagattgacaaccagacccgcatcaccaaggaggccggctctgtgtccctgaggatgaagcaggtggaggagctgtaccacagcctgctggagctgggggagaagaggaagggcatgctggagaagagctgcaagaagttcatgctgttccgggaggccaatgagctgcagcagtggatcaatgagaaggaggccgccctgaccagcgaggaggtgggcgctgacctggagcaggtggaggtgctgcagaagaagtttgatgacttccagaaggacctgaaggccaatgaaagccggctgaaggacatcaacaaggtggccgaggacctggagagcgagggcctgatggccgaggaggtgcaggccgtgcagcagcaggaggtgtatggcatgatgcccagagatgaaacagacagcaagacagccagcccctggaagagcgcccggctgatggtgcacacagtggccaccttcaacagcatcaaggagctgaatgaacgctggaggagcctgcagcagctggccgaggagaggagccagctgctgggcagcgcccacgaggtgcagcgcttccacagagatgctgatgagaccaaggagtggattgaggagaagaaccaggccctgaacacagacaactacggccatgacctggcctctgtgcaggccctgcagaggaagcatgagggctttgagcgggacctggccgccctgggggacaaggtgaacagcctgggggagacagctgagcggctcatccagagccaccctgagagcgctgaggacctgcaggagaagtgcacagagctgaaccaggcctggagcagcctgggcaagagagctgaccagaggaaggccaagctgggggacagccatgacctgcagcgcttcctgagtgacttccgggacctgatgtcctggatcaatggcatccggggcctggtgtccagtgatgagctggccaaggatgtgactggagctgaggccctgctggagcggcaccaggagcacaggacagaaattgatgcccgggccggcaccttccaggcctttgagcagtttggccagcagctgctggcccacggccactacgccagccctgagatcaagcagaagctggacatcctggaccaggagagagctgacctggagaaggcctgggtgcagaggaggatgatgctggaccagtgcctggagctgcagctgttccaccgggactgtgagcaggccgagaactggatggccgcccgggaggccttcctgaacacagaagataaaggagacagcctggacagcgtggaggccctgatcaagaagcatgaggactttgacaaggccatcaacgtgcaggaggagaagattgctgccctgcaggcctttgctgaccagctgattgctgctggccactacgccaagggggacatcagcagcagaagaaatgaggtgctggaccgctggaggcggctgaaggcccagatgattgagaagaggagcaagctgggggagagccagaccctgcagcagttcagcagagatgtggatgaaattgaggcctggatcagcgagaagctgcagacagccagtgatgagagctacaaggaccccaccaacatccagctgagcaagctgctgagcaagcaccagaagcaccaggcctttgaggccgagctgcacgccaatgctgaccgcatccggggcgtgattgacatgggcaacagcctcatcgagcggggggcctgtgccggctctgaagatgctgtgaaggcccggctggccgccctggccgaccagtggcagttcctggtgcagaagtctgctgagaagagccagaagctgaaggaggccaacaagcagcagaacttcaacacaggcatcaaggactttgacttctggctgtctgaggtggaggccctgctggcctctgaagattatggcaaggacctggcctctgtgaacaacctgctgaagaagcaccagctgctggaggccgacatcagcgcccacgaggaccggctgaaggacctgaacagccaggccgacagcctgatgaccagcagcgcctttgacaccagccaggtgaaggacaagagggacaccatcaatggccgcttccagaagatcaagtccatggccgccagcagaagagccaagctgaatgaaagccaccggctgcaccagttcttccgggacatggatgatgaggagagctggatcaaggagaagaagctgctggtgggctctgaagattatggccgggacctgactggagtgcagaacctgaggaagaagcacaagaggctggaggccgagctggccgcccacgagcccgccatccagggcgtgctggacaccgggaagaagctgagtgatgacaacaccatcggcaaggaggagatccagcagaggctggcccagtttgtggagcactggaaggagctgaagcagctggccgccgcccggggccagaggctggaggagagcctggagtaccagcagtttgtggccaacgtggaggaggaggaggcctggatcaatgagaagatgaccctggtggcctctgaagattatggagacaccctggccgccatccagggcctgctgaagaagcatgaggcctttgaaacagacttcaccgtgcacaaggacagagtgaatgatgtgtgcaccaacggccaggacctgatcaagaagaacaaccaccacgaggagaacatcagcagcaagatgaagggcctgaatggcaaggtgtctgacctggagaaggccgccgcccagaggaaggccaagctggatgaaaattctgccttcctgcagttcaactggaaggcagatgtggtggagagctggattggagagaaggagaacagcctgaagacagatgattatggccgggacctgagctctgtgcagaccctgctgaccaagcaggagacctttgatgctggcctgcaggccttccagcaggagggcatcgccaacatcacagccctgaaggaccagctgctggccgccaagcacgtgcagagcaaggccatcgaggcccggcatgccagcctgatgaagcgctggagccagctgctggccaacagcgctgccaggaagaagaagctgctggaggcccagagccacttcaggaaggtggaggacctcttcctgacctttgccaagaaggccagcgccttcaacagctggtttgaaaatgctgaggaggacctgacagatcctgtgcgctgcaacagcctggaggagatcaaggccctgcgggaggcccatgatgccttccgcagcagcctgagcagcgcccaggccgacttcaaccagctggccgagctggaccggcagatcaagagcttccgggtggccagcaacccctacacctggttcaccatggaggccctggaggagacctggaggaacctgcagaagatcatcaaggagcgggagctggagctgcagaaggagcagaggcggcaggaggagaatgacaagctgcggcaggagtttgcccagcacgccaatgccttccaccagtggatccaggagaccaggacctacctgctggatggcagctgcatggtggaggagagcggcaccctggagagccagctggaggccaccaagaggaagcaccaggagatccgggccatgaggagccagctgaagaagattgaggacctgggcgccgccatggaggaggccctgatcctggacaacaagtacacagagcacagcacagtgggcctggcccagcagtgggaccagctggaccagctgggcatgaggatgcagcacaacctggagcagcagatccaggccaggaacaccactggagtgacagaggaggccctgaaggagttctccatgatgttcaagcactttgacaaggacaagagcggccgcctgaaccaccaggagttcaagagctgcctgcggagcctgggctatgacctgcccatggtggaggagggggagccagaccctgagtttgaggccatcctggacacagtggaccccaacagagatggccacgtgtccctgcaggagtacatggccttcatgatcagccgggagacagaaaatgtgaagagcagcgaggagattgagagcgccttccgggccctgagcagcgagggcaagccctacgtgaccaaggaggagctgtaccagaacctgacccgggagcaggccgactactgtgtgagccacatgaagccctacgtggatggcaagggccgggagctgcccacagcctttgattatgtggagttcaccaggagcctgtttgtgaactag

SEQ ID NO: 171294 - DNA, 3444 bp, Artificial Sequence
  Description of Artificial Sequence: Synthetic coding sequence
atggagaacaacagagacaaggtgctgagccctgtggacagcggcaacaagctggtggccgagggcaacctgtacagcgacaagatcaaggagaaggtgcagctgattgaagatagacacaggaagaacaatgagaaggcccaggaggcctctgtgctgctgcgggacaacctggagctgcagaacttcctgcagaactgccaggagctgaccctgtggatcaatgacaagctgctgaccagccaggatgtgtcctatgatgaggccaggaacctgcacaacaagtggctgaagcaccaggcctttgtggccgagctggccagccatgagggctggctggagaacattgatgctgagggcaagcagctgatggatgagaagccccagttcaccgccctggtgtcccagaagctggaggccctgcaccggctgtgggatgagctgcaggccaccaccaaggagaagacccagcacctgtctgctgcccggagcagtgacctgcggctgcagacccatgctgacctgaacaagtggatcagcgccatggaggaccagctgcggagtgatgatcctgggaaggacctgacctctgtgaacaggatgctggccaagctgaagagggtggaggaccaggtgaatgtgaggaaggaggagctgggggagctgtttgcccaggtgcccagcatgggagaggagggcggagatgctgacctgagcattgagaagcgcttcctggacctgctggagcccctgggccgcaggaagaagcagctggagagcagccgggccaagctgcagatcagccgggacctggaggatgagaccctgtgggtggaggagcggctgcccctggcccagagcgctgactatggcaccaacctgcagacagtgcagctgttcatgaagaagaaccagaccctgcagaatgagatcctgggccacaccccccgggtggaggatgtgctgcagaggggccagcagctggtggaggccgctgagattgactgccaggacctggaggagcggctgggccacctgcagagctcctgggaccggctgcgggaggccgccgccggccgcctgcagaggctgagagatgccaatgaggcccagcagtactacctggatgctgatgaggccgaggcctggattggagagcaggagctgtatgtgatcagtgatgagatccccaaggatgaggagggcgccatcgtgatgctgaagaggcacctgcggcagcagagagctgtggaggactatggcaggaacatcaagcagctggccagccgggcccagggcctgctgtctgctggccaccctgagggggagcagatcatccggctgcagggccaggtggacaagcactacgccggcctgaaggatgtggccgaggagaggaagaggaagctggagaacatgtaccacctgttccagctgaagcgggagacagatgacctggagcagtggatcagcgagaaggagctggtggccagcagccctgagatgggccaggactttgaccacgtgaccctgctgcgggacaagttccgggactttgcccgggagactggagccatcggccaggagcgggtggacaacgtgaatgccttcatcgagcggctgattgatgctggccacagcgaggccgccaccatcgccgagtggaaggatggcctgaatgagatgtgggccgacctgctggagctgattgacaccaggatgcagctgctggccgccagctatgacctgcaccgctacttctacacaggagctgagatcctgggcctgattgatgagaagcaccgggagctgcctgaagatgtgggcctggatgccagcacagctgagagcttccaccgggtgcacacagcctttgagcgggagctgcacctgctgggcgtgcaggtgcagcagttccaggatgtggccacccggctgcagacagcctatgctggggagaaggccgaggccatccagaacaaggagcaggaggtgtctgctgcctggcaggccctgctggatgcctgtgccggccgccgcacccagctggtggacacagctgacaagttccgcttcttctccatggcccgggacctgctgtcctggatggagagcatcatccggcagatcgagacccaggagcggcccagagatgtgtcctctgtggagctgctgatgaagtaccaccagggcatcaatgctgagattgagaccaggagcaagaacttcagcgcctgcctggagctgggggagagcctgctgcagaggcagcaccaggccagcgaggagatccgggagaagctgcagcaggtgatgagcaggaggaaggagatgaatgagaagtgggaggcccgctgggagcggctgaggatgctgctggaggtgtgccagttcagcagagatgcctctgtggccgaggcctggctgattgcccaggagccctacctggccagcggggactttggccacacagtggacagcgtggagaagctgatcaagagacatgaggcctttgagaagagcacagcctcctgggccgagagatttgctgccctggagaagcccaccaccctggagctgaaggagcggcagattgctgagaggcctgctgaggagaccggcccccaggaggaggagggggagacagctggggaggcccctgtgagccaccacgccgccacagagaggaccagccctggagaggaggagggcacctggccccagaacctgcagcagcccccacctcctggccagcacaaggatggccagaagagcactggagatgagcggcccaccacagagcccctcttcaaggtgctggacacccccctgtctgaaggagatgagcccgccaccctgcctgccccccgggaccacggccagagcgtgcagatggagggctacctgggcaggaagcatgacctggagggccccaacaagaaggccagcaacagcaagggggaggagggggaggagcggcgggagacagaggaggaggatgaggaggaggaggagacagagagcgtggccgtggagatgcagcagcacgccagccacgtgtcctggaacaacctgtactgtgtgctgaggaacagcgagctgaccttctacaaggatgccaagaacctggccctgggcatgccctaccacggggaggagcccctggccctgcggcatgccatctgtgaaattgctgccaactacaagaagaagaagcacgtgttcaagctgcggctgagcaatggaagtgagtggctgttccacggcaaggatgaggaggagatgctgtcctggctgcagggcgtgtccacagccatcaatgaaagccagagcatccgggtgaaggcccagagcctgcccctgcccagcctgagcggcccagatgccagcctgggcaagaaggacaaggagaagcgcttctccttcttccccaagaagaagtag

SEQ ID NO: 171295 - DNA, 6321 bp, Artificial Sequence
  Description of Artificial Sequence: Synthetic coding sequence
atgaccagcgccacagaatttgaaaatgtgggcaaccagcccccctacagccgcatcaatgcccgctgggatgccccagatgatgagctggacaatgacaacagcagcgcccggctgtttgagaggagccgcatcaaggccctggctgatgagcgggaggtggtgcagaagaagaccttcaccaagtgggtgaacagccacctggcccgggtgtcctgccgcatcacagacctgtacaaggacctgagagatggccgcatgctgatcaagctgctggaggtgctgagcggggagatgctgcccaagcccaccaagggcaagatgaggatccactgcctggagaatgtggacaaggccctgcagttcctgaaggagcagagggtgcacctggagaacatgggcagccatgacatcgtggatggcaaccaccggctggtgctgggcctcatctggaccatcatcctgcgcttccagatccaggacatcgtggtgcagacccaggagggccgggagaccaggtctgccaaggatgccctgctgctgtggtgccagatgaagacagctggctacccccacgtgaatgtgaccaacttcaccagctcctggaaggatggcctggccttcaatgccctgatccacaagcacaggccagacctgattgactttgacaagctgaaggacagcaatgcccggcacaacctggagcacgccttcaacgtggccgagcggcagctgggcatcatccccctgctggaccctgaagatgtgttcacagaaaatccagatgagaagagcatcatcacctacgtggtggccttctaccactacttcagcaagatgaaggtgctggccgtggagggcaagagggtgggcaaggtgattgaccacgccatcgagacagagaagatgattgagaagtacagcggcctggccagtgacctgctgacctggattgagcagaccatcaccgtgctgaacagcaggaagtttgccaacagcctgactggagtgcagcagcagctgcaggccttcagcacctacagaacagtggagaagccacccaagttccaggagaagggcaacctggaggtgctgctcttcaccatccagagcaggatgagggccaacaaccagaaggtgtacacccctcatgatggcaagctggtgtctgacatcaacagagcctgggagagcctggaggaggccgagtacagaagagagctggccctgagaaatgagctgatccggcaggagaagctggagcagctggccaggagatttgacaggaaggccgccatgagggagacctggctgtctgagaaccagaggctggtggcccaggacaactttggctatgacctggccgctgtggaggccgccaagaagaagcatgaggccattgaaacagacacagctgcctatgaggagcgggtgcgggccctggaggacctggcccaggagctggagaaggagaactaccatgaccagaagaggatcacagccaggaaggacaacatcctgcggctgtggagctacctgcaggagctgctgcagagccggcggcagaggctggagaccaccctggccctgcagaagctgttccaggacatgctgcacagcattgactggatggatgagatcaaggcccacctgctgtctgctgagtttgggaagcacctgctggaggtggaggacctgctgcagaagcacaagctgatggaggccgacatcgccatccagggcgacaaggtgaaggccatcacagctgccaccctgaagttcacagagggcaagggctaccagccctgtgacccccaggtgatccaggaccgcatcagccacctggagcagtgctttgaggagctgagcaacatggctgctggcaggaaggcccagctggagcagagcaagaggctgtggaagttcttctgggagatggatgaagctgagagctggatcaaggagaaggagcagatctacagcagcctggactatggcaaggacctgacctctgtgctgatcctgcagaggaagcacaaggcctttgaagatgagctgcggggcctggatgcccacctggagcagatcttccaggaggcccacggcatggtggccaggaagcagtttggccacccccagatcgaggcccgcatcaaggaggtgtctgcccagtgggaccagctgaaggacctggccgccttctgcaagaagaacctgcaggatgctgagaacttcttccagttccagggagatgctgatgacctgaaggcctggctgcaggatgcccaccggctgctgtctggagaagatgtgggccaggatgagggcgccacccgggccctgggcaagaagcacaaggacttcctggaggagctggaggagagcagaggagtgatggagcacctggagcagcaggcccagggcttccctgaggagttccgggacagcccagatgtgacccaccggctgcaggccctgcgggagctgtaccagcaggtggtggcccaggccgacctgcggcagcagaggctgcaggaggccctggacctgtacacagtgtttggagaaacagatgcctgtgagctgtggatgggagagaaggagaagtggctggccgagatggagatgccagacaccctggaggacctggaggtggtgcagcacagatttgacatcctggaccaggagatgaagaccctgatgacccagattgatggagtgaacctggccgccaacagcctggtggagagcggccaccccaggagccgggaggtgaagcagtaccaggaccacctgaacacccgctggcaggccttccagaccctggtgtctgagcggcgggaggccgtggacagcgccctgcgggtgcacaactactgtgtggactgtgaggagaccagcaagtggatcacagacaagaccaaggtggtggagagcaccaaggacctgggccgggacctggccggcatcatcgccatccagaggaagctgagcggcctggagagagatgtggccgccatccaggcccgggtggatgccctggagcgggagagccagcagctgatggacagccaccctgagcagaaggaggacatcggccagaggcagaagcacctggaggagctgtggcagggcctgcagcagagcctgcagggccaggaggacctgctgggggaggtgtcccagctgcaggccttcctgcaggacctggatgacttccaggcctggctgagcatcacccagaaggctgtggccagcgaggacatgcctgagagcctgcctgaggccgagcagctgctgcagcagcacgccggcatcaaggatgaaattgatggccaccaggacagctaccagagggtgaaggagagcggggagaaggtgatccagggccagacagatcctgagtacctgctgctgggccagaggctggagggcctggacaccggctggaatgccctgggccgcatgtgggagagccgcagccacaccctggcccagtgcctgggcttccaggagttccagaaggatgccaagcaggccgaggccatcctgagcaaccaggagtacaccctggcccacctggagcccccagacagcctggaggccgctgaggccggcatcaggaagtttgaggacttcctgggctccatggagaacaacagagacaaggtgctgagccctgtggacagcggcaacaagctggtggccgagggcaacctgtacagcgacaagatcaaggagaaggtgcagctgattgaagatagacacaggaagaacaatgagaaggcccaggaggcctctgtgctgctgcgggacaacctggagctgcagaacttcctgcagaactgccaggagctgaccctgtggatcaatgacaagctgctgaccagccaggatgtgtcctatgatgaggccaggaacctgcacaacaagtggctgaagcaccaggcctttgtggccgagctggccagccatgagggctggctggagaacattgatgctgagggcaagcagctgatggatgagaagccccagttcaccgccctggtgtcccagaagctggaggccctgcaccggctgtgggatgagctgcaggccaccaccaaggagaagacccagcacctgtctgctgcccggagcagtgacctgcggctgcagacccatgctgacctgaacaagtggatcagcgccatggaggaccagctgcggagtgatgatcctgggaaggacctgacctctgtgaacaggatgctggccaagctgaagagggtggaggaccaggtgaatgtgaggaaggaggagctgggggagctgtttgcccaggtgcccagcatgggagaggagggcggagatgctgacctgagcattgagaagcgcttcctggacctgctggagcccctgggccgcaggaagaagcagctggagagcagccgggccaagctgcagatcagccgggacctggaggatgagaccctgtgggtggaggagcggctgcccctggcccagagcgctgactatggcaccaacctgcagacagtgcagctgttcatgaagaagaaccagaccctgcagaatgagatcctgggccacaccccccgggtggaggatgtgctgcagaggggccagcagctggtggaggccgctgagattgactgccaggacctggaggagcggctgggccacctgcagagctcctgggaccggctgcgggaggccgccgccggccgcctgcagaggctgagagatgccaatgaggcccagcagtactacctggatgctgatgaggccgaggcctggattggagagcaggagctgtatgtgatcagtgatgagatccccaaggatgaggagggcgccatcgtgatgctgaagaggcacctgcggcagcagagagctgtggaggactatggcaggaacatcaagcagctggccagccgggcccagggcctgctgtctgctggccaccctgagggggagcagatcatccggctgcagggccaggtggacaagcactacgccggcctgaaggatgtggccgaggagaggaagaggaagctggagaacatgtaccacctgttccagctgaagcgggagacagatgacctggagcagtggatcagcgagaaggagctggtggccagcagccctgagatgggccaggactttgaccacgtgaccctgctgcgggacaagttccgggactttgcccgggagactggagccatcggccaggagcgggtggacaacgtgaatgccttcatcgagcggctgattgatgctggccacagcgaggccgccaccatcgccgagtggaaggatggcctgaatgagatgtgggccgacctgctggagctgattgacaccaggatgcagctgctggccgccagctatgacctgcaccgctacttctacacaggagctgagatcctgggcctgattgatgagaagcaccgggagctgcctgaagatgtgggcctggatgccagcacagctgagagcttccaccgggtgcacacagcctttgagcgggagctgcacctgctgggcgtgcaggtgcagcagttccaggatgtggccacccggctgcagacagcctatgctggggagaaggccgaggccatccagaacaaggagcaggaggtgtctgctgcctggcaggccctgctggatgcctgtgccggccgccgcacccagctggtggacacagctgacaagttccgcttcttctccatggcccgggacctgctgtcctggatggagagcatcatccggcagatcgagacccaggagcggcccagagatgtgtcctctgtggagctgctgatgaagtaccaccagggcatcaatgctgagattgagaccaggagcaagaacttcagcgcctgcctggagctgggggagagcctgctgcagaggcagcaccaggccagcgaggagatccgggagaagctgcagcaggtgatgagcaggaggaaggagatgaatgagaagtgggaggcccgctgggagcggctgaggatgctgctggaggtgtgccagttcagcagagatgcctctgtggccgaggcctggctgattgcccaggagccctacctggccagcggggactttggccacacagtggacagcgtggagaagctgatcaagagacatgaggcctttgagaagagcacagcctcctgggccgagagatttgctgccctggagaagcccaccacagccagcagaggaggaagaagagacagccggggcggcagcagcttccccccctgtggccacagagaaaatgtgcccggccagagcctggtgtcctttgtgtag

SEQ ID NO: 171296 - DNA, 6414 bp, Artificial Sequence
  Description of Artificial Sequence: Synthetic coding sequence
atgaccagcgccacagaatttgaaaatgtgggcaaccagcccccctacagccgcatcaatgcccgctgggatgccccagatgatgagctggacaatgacaacagcagcgcccggctgtttgagaggagccgcatcaaggccctggctgatgagcgggaggtggtgcagaagaagaccttcaccaagtgggtgaacagccacctggcccgggtgtcctgccgcatcacagacctgtacaaggacctgagagatggccgcatgctgatcaagctgctggaggtgctgagcggggagatgctgcccaagcccaccaagggcaagatgaggatccactgcctggagaatgtggacaaggccctgcagttcctgaaggagcagagggtgcacctggagaacatgggcagccatgacatcgtggatggcaaccaccggctggtgctgggcctcatctggaccatcatcctgcgcttccagatccaggacatcgtggtgcagacccaggagggccgggagaccaggtctgccaaggatgccctgctgctgtggtgccagatgaagacagctggctacccccacgtgaatgtgaccaacttcaccagctcctggaaggatggcctggccttcaatgccctgatccacaagcacaggccagacctgattgactttgacaagctgaaggacagcaatgcccggcacaacctggagcacgccttcaacgtggccgagcggcagctgggcatcatccccctgctggaccctgaagatgtgttcacagaaaatccagatgagaagagcatcatcacctacgtggtggccttctaccactacttcagcaagatgaaggtgctggccgtggagggcaagagggtgggcaaggtgattgaccacgccatcgagacagagaagatgattgagaagtacagcggcctggccagtgacctgctgacctggattgagcagaccatcaccgtgctgaacagcaggaagtttgccaacagcctgactggagtgcagcagcagctgcaggccttcagcacctacagaacagtggagaagccacccaagttccaggagaagggcaacctggaggtgctgctcttcaccatccagagcaggatgagggccaacaaccagaaggtgtacacccctcatgatggcaagctggtgtctgacatcaacagagcctgggagagcctggaggaggccgagtacagaagagagctggccctgagaaatgagctgatccggcaggagaagctggagcagctggccaggagatttgacaggaaggccgccatgagggagacctggctgtctgagaaccagaggctggtggcccaggacaactttggctatgacctggccgctgtggaggccgccaagaagaagcatgaggccattgaaacagacacagctgcctatgaggagcgggtgcgggccctggaggacctggcccaggagctggagaaggagaactaccatgaccagaagaggatcacagccaggaaggacaacatcctgcggctgtggagctacctgcaggagctgctgcagagccggcggcagaggctggagaccaccctggccctgcagaagctgttccaggacatgctgcacagcattgactggatggatgagatcaaggcccacctgctgtctgctgagtttgggaagcacctgctggaggtggaggacctgctgcagaagcacaagctgatggaggccgacatcgccatccagggcgacaaggtgaaggccatcacagctgccaccctgaagttcacagagggcaagggctaccagccctgtgacccccaggtgatccaggaccgcatcagccacctggagcagtgctttgaggagctgagcaacatggctgctggcaggaaggcccagctggagcagagcaagaggctgtggaagttcttctgggagatggatgaagctgagagctggatcaaggagaaggagcagatctacagcagcctggactatggcaaggacctgacctctgtgctgatcctgcagaggaagcacaaggcctttgaagatgagctgcggggcctggatgcccacctggagcagatcttccaggaggcccacggcatggtggccaggaagcagtttggccacccccagatcgaggcccgcatcaaggaggtgtctgcccagtgggaccagctgaaggacctggccgccttctgcaagaagaacctgcaggatgctgagaacttcttccagttccagggagatgctgatgacctgaaggcctggctgcaggatgcccaccggctgctgtctggagaagatgtgggccaggatgagggcgccacccgggccctgggcaagaagcacaaggacttcctggaggagctggaggagagcagaggagtgatggagcacctggagcagcaggcccagggcttccctgaggagttccgggacagcccagatgtgacccaccggctgcaggccctgcgggagctgtaccagcaggtggtggcccaggccgacctgcggcagcagaggctgcaggaggccctggacctgtacacagtgtttggagaaacagatgcctgtgagctgtggatgggagagaaggagaagtggctggccgagatggagatgccagacaccctggaggacctggaggtggtgcagcacagatttgacatcctggaccaggagatgaagaccctgatgacccagattgatggagtgaacctggccgccaacagcctggtggagagcggccaccccaggagccgggaggtgaagcagtaccaggaccacctgaacacccgctggcaggccttccagaccctggtgtctgagcggcgggaggccgtggacagcgccctgcgggtgcacaactactgtgtggactgtgaggagaccagcaagtggatcacagacaagaccaaggtggtggagagcaccaaggacctgggccgggacctggccggcatcatcgccatccagaggaagctgagcggcctggagagagatgtggccgccatccaggcccgggtggatgccctggagcgggagagccagcagctgatggacagccaccctgagcagaaggaggacatcggccagaggcagaagcacctggaggagctgtggcagggcctgcagcagagcctgcagggccaggaggacctgctgggggaggtgtcccagctgcaggccttcctgcaggacctggatgacttccaggcctggctgagcatcacccagaaggctgtggccagcgaggacatgcctgagagcctgcctgaggccgagcagctgctgcagcagcacgccggcatcaaggatgaaattgatggccaccaggacagctaccagagggtgaaggagagcggggagaaggtgatccagggccagacagatcctgagtacctgctgctgggccagaggctggagggcctggacaccggctggaatgccctgggccgcatgtgggagagccgcagccacaccctggcccagtgcctgggcttccaggagttccagaaggatgccaagcaggccgaggccatcctgagcaaccaggagtacaccctggcccacctggagcccccagacagcctggaggccgctgaggccggcatcaggaagtttgaggacttcctgggctccatggagaacaacagagacaaggtgctgagccctgtggacagcggcaacaagctggtggccgagggcaacctgtacagcgacaagatcaaggagaaggtgcagctgattgaagatagacacaggaagaacaatgagaaggcccaggaggcctctgtgctgctgcgggacaacctggagctgcagaacttcctgcagaactgccaggagctgaccctgtggatcaatgacaagctgctgaccagccaggatgtgtcctatgatgaggccaggaacctgcacaacaagtggctgaagcaccaggcctttgtggccgagctggccagccatgagggctggctggagaacattgatgctgagggcaagcagctgatggatgagaagccccagttcaccgccctggtgtcccagaagctggaggccctgcaccggctgtgggatgagctgcaggccaccaccaaggagaagacccagcacctgtctgctgcccggagcagtgacctgcggctgcagacccatgctgacctgaacaagtggatcagcgccatggaggaccagctgcggagtgatgatcctgggaaggacctgacctctgtgaacaggatgctggccaagctgaagagggtggaggaccaggtgaatgtgaggaaggaggagctgggggagctgtttgcccaggtgcccagcatgggagaggagggcggagatgctgacctgagcattgagaagcgcttcctggacctgctggagcccctgggccgcaggaagaagcagctggagagcagccgggccaagctgcagatcagccgggacctggaggatgagaccctgtgggtggaggagcggctgcccctggcccagagcgctgactatggcaccaacctgcagacagtgcagctgttcatgaagaagaaccagaccctgcagaatgagatcctgggccacaccccccgggtggaggatgtgctgcagaggggccagcagctggtggaggccgctgagattgactgccaggacctggaggagcggctgggccacctgcagagctcctgggaccggctgcgggaggccgccgccggccgcctgcagaggctgagagatgccaatgaggcccagcagtactacctggatgctgatgaggccgaggcctggattggagagcaggagctgtatgtgatcagtgatgagatccccaaggatgaggagggcgccatcgtgatgctgaagaggcacctgcggcagcagagagctgtggaggactatggcaggaacatcaagcagctggccagccgggcccagggcctgctgtctgctggccaccctgagggggagcagatcatccggctgcagggccaggtggacaagcactacgccggcctgaaggatgtggccgaggagaggaagaggaagctggagaacatgtaccacctgttccagctgaagcgggagacagatgacctggagcagtggatcagcgagaaggagctggtggccagcagccctgagatgggccaggactttgaccacgtgaccctgctgcgggacaagttccgggactttgcccgggagactggagccatcggccaggagcgggtggacaacgtgaatgccttcatcgagcggctgattgatgctggccacagcgaggccgccaccatcgccgagtggaaggatggcctgaatgagatgtgggccgacctgctggagctgattgacaccaggatgcagctgctggccgccagctatgacctgcaccgctacttctacacaggagctgagatcctgggcctgattgatgagaagcaccgggagctgcctgaagatgtgggcctggatgccagcacagctgagagcttccaccgggtgcacacagcctttgagcgggagctgcacctgctgggcgtgcaggtgcagcagttccaggatgtggccacccggctgcagacagcctatgctggggagaaggccgaggccatccagaacaaggagcaggaggtgtctgctgcctggcaggccctgctggatgcctgtgccggccgccgcacccagctggtggacacagctgacaagttccgcttcttctccatggcccgggacctgctgtcctggatggagagcatcatccggcagatcgagacccaggagcggcccagagatgtgtcctctgtggagctgctgatgaagtaccaccagggcatcaatgctgagattgagaccaggagcaagaacttcagcgcctgcctggagctgggggagagcctgctgcagaggcagcaccaggccagcgaggagatccgggagaagctgcagcaggtgatgagcaggaggaaggagatgaatgagaagtgggaggcccgctgggagcggctgaggatgctgctggaggtgtgccagttcagcagagatgcctctgtggccgaggcctggctgattgcccaggagccctacctggccagcggggactttggccacacagtggacagcgtggagaagctgatcaagagacatgaggcctttgagaagagcacagcctcctgggccgagagatttgctgccctggagaagcccaccaccctggagctgaaggagcggcagattgctgagaggcctgctgaggagaccggcccccaggaggaggagggggagacagctggggaggcccctgtgagccaccacgccgccacagagaggaccagccctgtgtccctgtggagccggctgagcagctcctgggagagcctgcagcctgagcccagccacccctactag

SEQ ID NO: 171297 - DNA, 6987 bp, Artificial Sequence
  Description of Artificial Sequence: Synthetic coding sequence
atgaccagcgccacagaatttgaaaatgtgggcaaccagcccccctacagccgcatcaatgcccgctgggatgccccagatgatgagctggacaatgacaacagcagcgcccggctgtttgagaggagccgcatcaaggccctggctgatgagcgggaggtggtgcagaagaagaccttcaccaagtgggtgaacagccacctggcccgggtgtcctgccgcatcacagacctgtacaaggacctgagagatggccgcatgctgatcaagctgctggaggtgctgagcggggagatgctgcccaagcccaccaagggcaagatgaggatccactgcctggagaatgtggacaaggccctgcagttcctgaaggagcagagggtgcacctggagaacatgggcagccatgacatcgtggatggcaaccaccggctggtgctgggcctcatctggaccatcatcctgcgcttccagatccaggacatcgtggtgcagacccaggagggccgggagaccaggtctgccaaggatgccctgctgctgtggtgccagatgaagacagctggctacccccacgtgaatgtgaccaacttcaccagctcctggaaggatggcctggccttcaatgccctgatccacaagcacaggccagacctgattgactttgacaagctgaaggacagcaatgcccggcacaacctggagcacgccttcaacgtggccgagcggcagctgggcatcatccccctgctggaccctgaagatgtgttcacagaaaatccagatgagaagagcatcatcacctacgtggtggccttctaccactacttcagcaagatgaaggtgctggccgtggagggcaagagggtgggcaaggtgattgaccacgccatcgagacagagaagatgattgagaagtacagcggcctggccagtgacctgctgacctggattgagcagaccatcaccgtgctgaacagcaggaagtttgccaacagcctgactggagtgcagcagcagctgcaggccttcagcacctacagaacagtggagaagccacccaagttccaggagaagggcaacctggaggtgctgctcttcaccatccagagcaggatgagggccaacaaccagaaggtgtacacccctcatgatggcaagctggtgtctgacatcaacagagcctgggagagcctggaggaggccgagtacagaagagagctggccctgagaaatgagctgatccggcaggagaagctggagcagctggccaggagatttgacaggaaggccgccatgagggagacctggctgtctgagaaccagaggctggtggcccaggacaactttggctatgacctggccgctgtggaggccgccaagaagaagcatgaggccattgaaacagacacagctgcctatgaggagcgggtgcgggccctggaggacctggcccaggagctggagaaggagaactaccatgaccagaagaggatcacagccaggaaggacaacatcctgcggctgtggagctacctgcaggagctgctgcagagccggcggcagaggctggagaccaccctggccctgcagaagctgttccaggacatgctgcacagcattgactggatggatgagatcaaggcccacctgctgtctgctgagtttgggaagcacctgctggaggtggaggacctgctgcagaagcacaagctgatggaggccgacatcgccatccagggcgacaaggtgaaggccatcacagctgccaccctgaagttcacagagggcaagggctaccagccctgtgacccccaggtgatccaggaccgcatcagccacctggagcagtgctttgaggagctgagcaacatggctgctggcaggaaggcccagctggagcagagcaagaggctgtggaagttcttctgggagatggatgaagctgagagctggatcaaggagaaggagcagatctacagcagcctggactatggcaaggacctgacctctgtgctgatcctgcagaggaagcacaaggcctttgaagatgagctgcggggcctggatgcccacctggagcagatcttccaggaggcccacggcatggtggccaggaagcagtttggccacccccagatcgaggcccgcatcaaggaggtgtctgcccagtgggaccagctgaaggacctggccgccttctgcaagaagaacctgcaggatgctgagaacttcttccagttccagggagatgctgatgacctgaaggcctggctgcaggatgcccaccggctgctgtctggagaagatgtgggccaggatgagggcgccacccgggccctgggcaagaagcacaaggacttcctggaggagctggaggagagcagaggagtgatggagcacctggagcagcaggcccagggcttccctgaggagttccgggacagcccagatgtgacccaccggctgcaggccctgcgggagctgtaccagcaggtggtggcccaggccgacctgcggcagcagaggctgcaggaggccctggacctgtacacagtgtttggagaaacagatgcctgtgagctgtggatgggagagaaggagaagtggctggccgagatggagatgccagacaccctggaggacctggaggtggtgcagcacagatttgacatcctggaccaggagatgaagaccctgatgacccagattgatggagtgaacctggccgccaacagcctggtggagagcggccaccccaggagccgggaggtgaagcagtaccaggaccacctgaacacccgctggcaggccttccagaccctggtgtctgagcggcgggaggccgtggacagcgccctgcgggtgcacaactactgtgtggactgtgaggagaccagcaagtggatcacagacaagaccaaggtggtggagagcaccaaggacctgggccgggacctggccggcatcatcgccatccagaggaagctgagcggcctggagagagatgtggccgccatccaggcccgggtggatgccctggagcgggagagccagcagctgatggacagccaccctgagcagaaggaggacatcggccagaggcagaagcacctggaggagctgtggcagggcctgcagcagagcctgcagggccaggaggacctgctgggggaggtgtcccagctgcaggccttcctgcaggacctggatgacttccaggcctggctgagcatcacccagaaggctgtggccagcgaggacatgcctgagagcctgcctgaggccgagcagctgctgcagcagcacgccggcatcaaggatgaaattgatggccaccaggacagctaccagagggtgaaggagagcggggagaaggtgatccagggccagacagatcctgagtacctgctgctgggccagaggctggagggcctggacaccggctggaatgccctgggccgcatgtgggagagccgcagccacaccctggcccagtgcctgggcttccaggagttccagaaggatgccaagcaggccgaggccatcctgagcaaccaggagtacaccctggcccacctggagcccccagacagcctggaggccgctgaggccggcatcaggaagtttgaggacttcctgggctccatggagaacaacagagacaaggtgctgagccctgtggacagcggcaacaagctggtggccgagggcaacctgtacagcgacaagatcaaggagaaggtgcagctgattgaagatagacacaggaagaacaatgagaaggcccaggaggcctctgtgctgctgcgggacaacctggagctgcagaacttcctgcagaactgccaggagctgaccctgtggatcaatgacaagctgctgaccagccaggatgtgtcctatgatgaggccaggaacctgcacaacaagtggctgaagcaccaggcctttgtggccgagctggccagccatgagggctggctggagaacattgatgctgagggcaagcagctgatggatgagaagccccagttcaccgccctggtgtcccagaagctggaggccctgcaccggctgtgggatgagctgcaggccaccaccaaggagaagacccagcacctgtctgctgcccggagcagtgacctgcggctgcagacccatgctgacctgaacaagtggatcagcgccatggaggaccagctgcggagtgatgatcctgggaaggacctgacctctgtgaacaggatgctggccaagctgaagagggtggaggaccaggtgaatgtgaggaaggaggagctgggggagctgtttgcccaggtgcccagcatgggagaggagggcggagatgctgacctgagcattgagaagcgcttcctggacctgctggagcccctgggccgcaggaagaagcagctggagagcagccgggccaagctgcagatcagccgggacctggaggatgagaccctgtgggtggaggagcggctgcccctggcccagagcgctgactatggcaccaacctgcagacagtgcagctgttcatgaagaagaaccagaccctgcagaatgagatcctgggccacaccccccgggtggaggatgtgctgcagaggggccagcagctggtggaggccgctgagattgactgccaggacctggaggagcggctgggccacctgcagagctcctgggaccggctgcgggaggccgccgccggccgcctgcagaggctgagagatgccaatgaggcccagcagtactacctggatgctgatgaggccgaggcctggattggagagcaggagctgtatgtgatcagtgatgagatccccaaggatgaggagggcgccatcgtgatgctgaagaggcacctgcggcagcagagagctgtggaggactatggcaggaacatcaagcagctggccagccgggcccagggcctgctgtctgctggccaccctgagggggagcagatcatccggctgcagggccaggtggacaagcactacgccggcctgaaggatgtggccgaggagaggaagaggaagctggagaacatgtaccacctgttccagctgaagcgggagacagatgacctggagcagtggatcagcgagaaggagctggtggccagcagccctgagatgggccaggactttgaccacgtgaccctgctgcgggacaagttccgggactttgcccgggagactggagccatcggccaggagcgggtggacaacgtgaatgccttcatcgagcggctgattgatgctggccacagcgaggccgccaccatcgccgagtggaaggatggcctgaatgagatgtgggccgacctgctggagctgattgacaccaggatgcagctgctggccgccagctatgacctgcaccgctacttctacacaggagctgagatcctgggcctgattgatgagaagcaccgggagctgcctgaagatgtgggcctggatgccagcacagctgagagcttccaccgggtgcacacagcctttgagcgggagctgcacctgctgggcgtgcaggtgcagcagttccaggatgtggccacccggctgcagacagcctatgctggggagaaggccgaggccatccagaacaaggagcaggaggtgtctgctgcctggcaggccctgctggatgcctgtgccggccgccgcacccagctggtggacacagctgacaagttccgcttcttctccatggcccgggacctgctgtcctggatggagagcatcatccggcagatcgagacccaggagcggcccagagatgtgtcctctgtggagctgctgatgaagtaccaccagggcatcaatgctgagattgagaccaggagcaagaacttcagcgcctgcctggagctgggggagagcctgctgcagaggcagcaccaggccagcgaggagatccgggagaagctgcagcaggtgatgagcaggaggaaggagatgaatgagaagtgggaggcccgctgggagcggctgaggatgctgctggaggtgtgccagttcagcagagatgcctctgtggccgaggcctggctgattgcccaggagccctacctggccagcggggactttggccacacagtggacagcgtggagaagctgatcaagagacatgaggcctttgagaagagcacagcctcctgggccgagagatttgctgccctggagaagcccaccaccctggagctgaaggagcggcagattgctgagaggcctgctgaggagaccggcccccaggaggaggagggggagacagctggggaggcccctgtgagccaccacgccgccacagagaggaccagccctggagaggaggagggcacctggccccagaacctgcagcagcccccacctcctggccagcacaaggatggccagaagagcactggagatgagcggcccaccacagagcccctcttcaaggtgctggacacccccctgtctgaaggagatgagcccgccaccctgcctgccccccgggaccacggccagagcgtgcagatggagggctacctgggcaggaagcatgacctggagggccccaacaagaaggccagcaacagatcctggaacaacctgtactgtgtgctgagaaattctgagctgaccttctacaaggatgccaagaacctggccctgggcatgccctaccatggagaggagcccctggccctgcggcatgccatctgtgaaattgctgccaactacaagaagaagaagcacgtgttcaagctgcggctgagcaatggcagcgagtggctgttccacggcaaggatgaggaggagatgctgtcctggctgcagggcgtgtccacagccatcaatgaaagccagagcatccgggtgaaggcccagagcctgcccctgcccagcctgagcggcccagatgccagcctgggcaagaaggacaaggagaagcgcttctccttcttccccaagaagaagtag

SEQ ID NO: 171298 - DNA, 6999 bp, Artificial Sequence
  Description of Artificial Sequence: Synthetic coding sequence
gagcctgctgacatgaccagcgccacagaatttgaaaatgtgggcaaccagcccccctacagccgcatcaatgcccgctgggatgccccagatgatgagctggacaatgacaacagcagcgcccggctgtttgagaggagccgcatcaaggccctggctgatgagcgggaggtggtgcagaagaagaccttcaccaagtgggtgaacagccacctggcccgggtgtcctgccgcatcacagacctgtacaaggacctgagagatggccgcatgctgatcaagctgctggaggtgctgagcggggagatgctgcccaagcccaccaagggcaagatgaggatccactgcctggagaatgtggacaaggccctgcagttcctgaaggagcagagggtgcacctggagaacatgggcagccatgacatcgtggatggcaaccaccggctggtgctgggcctcatctggaccatcatcctgcgcttccagatccaggacatcgtggtgcagacccaggagggccgggagaccaggtctgccaaggatgccctgctgctgtggtgccagatgaagacagctggctacccccacgtgaatgtgaccaacttcaccagctcctggaaggatggcctggccttcaatgccctgatccacaagcacaggccagacctgattgactttgacaagctgaaggacagcaatgcccggcacaacctggagcacgccttcaacgtggccgagcggcagctgggcatcatccccctgctggaccctgaagatgtgttcacagaaaatccagatgagaagagcatcatcacctacgtggtggccttctaccactacttcagcaagatgaaggtgctggccgtggagggcaagagggtgggcaaggtgattgaccacgccatcgagacagagaagatgattgagaagtacagcggcctggccagtgacctgctgacctggattgagcagaccatcaccgtgctgaacagcaggaagtttgccaacagcctgactggagtgcagcagcagctgcaggccttcagcacctacagaacagtggagaagccacccaagttccaggagaagggcaacctggaggtgctgctcttcaccatccagagcaggatgagggccaacaaccagaaggtgtacacccctcatgatggcaagctggtgtctgacatcaacagagcctgggagagcctggaggaggccgagtacagaagagagctggccctgagaaatgagctgatccggcaggagaagctggagcagctggccaggagatttgacaggaaggccgccatgagggagacctggctgtctgagaaccagaggctggtggcccaggacaactttggctatgacctggccgctgtggaggccgccaagaagaagcatgaggccattgaaacagacacagctgcctatgaggagcgggtgcgggccctggaggacctggcccaggagctggagaaggagaactaccatgaccagaagaggatcacagccaggaaggacaacatcctgcggctgtggagctacctgcaggagctgctgcagagccggcggcagaggctggagaccaccctggccctgcagaagctgttccaggacatgctgcacagcattgactggatggatgagatcaaggcccacctgctgtctgctgagtttgggaagcacctgctggaggtggaggacctgctgcagaagcacaagctgatggaggccgacatcgccatccagggcgacaaggtgaaggccatcacagctgccaccctgaagttcacagagggcaagggctaccagccctgtgacccccaggtgatccaggaccgcatcagccacctggagcagtgctttgaggagctgagcaacatggctgctggcaggaaggcccagctggagcagagcaagaggctgtggaagttcttctgggagatggatgaagctgagagctggatcaaggagaaggagcagatctacagcagcctggactatggcaaggacctgacctctgtgctgatcctgcagaggaagcacaaggcctttgaagatgagctgcggggcctggatgcccacctggagcagatcttccaggaggcccacggcatggtggccaggaagcagtttggccacccccagatcgaggcccgcatcaaggaggtgtctgcccagtgggaccagctgaaggacctggccgccttctgcaagaagaacctgcaggatgctgagaacttcttccagttccagggagatgctgatgacctgaaggcctggctgcaggatgcccaccggctgctgtctggagaagatgtgggccaggatgagggcgccacccgggccctgggcaagaagcacaaggacttcctggaggagctggaggagagcagaggagtgatggagcacctggagcagcaggcccagggcttccctgaggagttccgggacagcccagatgtgacccaccggctgcaggccctgcgggagctgtaccagcaggtggtggcccaggccgacctgcggcagcagaggctgcaggaggccctggacctgtacacagtgtttggagaaacagatgcctgtgagctgtggatgggagagaaggagaagtggctggccgagatggagatgccagacaccctggaggacctggaggtggtgcagcacagatttgacatcctggaccaggagatgaagaccctgatgacccagattgatggagtgaacctggccgccaacagcctggtggagagcggccaccccaggagccgggaggtgaagcagtaccaggaccacctgaacacccgctggcaggccttccagaccctggtgtctgagcggcgggaggccgtggacagcgccctgcgggtgcacaactactgtgtggactgtgaggagaccagcaagtggatcacagacaagaccaaggtggtggagagcaccaaggacctgggccgggacctggccggcatcatcgccatccagaggaagctgagcggcctggagagagatgtggccgccatccaggcccgggtggatgccctggagcgggagagccagcagctgatggacagccaccctgagcagaaggaggacatcggccagaggcagaagcacctggaggagctgtggcagggcctgcagcagagcctgcagggccaggaggacctgctgggggaggtgtcccagctgcaggccttcctgcaggacctggatgacttccaggcctggctgagcatcacccagaaggctgtggccagcgaggacatgcctgagagcctgcctgaggccgagcagctgctgcagcagcacgccggcatcaaggatgaaattgatggccaccaggacagctaccagagggtgaaggagagcggggagaaggtgatccagggccagacagatcctgagtacctgctgctgggccagaggctggagggcctggacaccggctggaatgccctgggccgcatgtgggagagccgcagccacaccctggcccagtgcctgggcttccaggagttccagaaggatgccaagcaggccgaggccatcctgagcaaccaggagtacaccctggcccacctggagcccccagacagcctggaggccgctgaggccggcatcaggaagtttgaggacttcctgggctccatggagaacaacagagacaaggtgctgagccctgtggacagcggcaacaagctggtggccgagggcaacctgtacagcgacaagatcaaggagaaggtgcagctgattgaagatagacacaggaagaacaatgagaaggcccaggaggcctctgtgctgctgcgggacaacctggagctgcagaacttcctgcagaactgccaggagctgaccctgtggatcaatgacaagctgctgaccagccaggatgtgtcctatgatgaggccaggaacctgcacaacaagtggctgaagcaccaggcctttgtggccgagctggccagccatgagggctggctggagaacattgatgctgagggcaagcagctgatggatgagaagccccagttcaccgccctggtgtcccagaagctggaggccctgcaccggctgtgggatgagctgcaggccaccaccaaggagaagacccagcacctgtctgctgcccggagcagtgacctgcggctgcagacccatgctgacctgaacaagtggatcagcgccatggaggaccagctgcggagtgatgatcctgggaaggacctgacctctgtgaacaggatgctggccaagctgaagagggtggaggaccaggtgaatgtgaggaaggaggagctgggggagctgtttgcccaggtgcccagcatgggagaggagggcggagatgctgacctgagcattgagaagcgcttcctggacctgctggagcccctgggccgcaggaagaagcagctggagagcagccgggccaagctgcagatcagccgggacctggaggatgagaccctgtgggtggaggagcggctgcccctggcccagagcgctgactatggcaccaacctgcagacagtgcagctgttcatgaagaagaaccagaccctgcagaatgagatcctgggccacaccccccgggtggaggatgtgctgcagaggggccagcagctggtggaggccgctgagattgactgccaggacctggaggagcggctgggccacctgcagagctcctgggaccggctgcgggaggccgccgccggccgcctgcagaggctgagagatgccaatgaggcccagcagtactacctggatgctgatgaggccgaggcctggattggagagcaggagctgtatgtgatcagtgatgagatccccaaggatgaggagggcgccatcgtgatgctgaagaggcacctgcggcagcagagagctgtggaggactatggcaggaacatcaagcagctggccagccgggcccagggcctgctgtctgctggccaccctgagggggagcagatcatccggctgcagggccaggtggacaagcactacgccggcctgaaggatgtggccgaggagaggaagaggaagctggagaacatgtaccacctgttccagctgaagcgggagacagatgacctggagcagtggatcagcgagaaggagctggtggccagcagccctgagatgggccaggactttgaccacgtgaccctgctgcgggacaagttccgggactttgcccgggagactggagccatcggccaggagcgggtggacaacgtgaatgccttcatcgagcggctgattgatgctggccacagcgaggccgccaccatcgccgagtggaaggatggcctgaatgagatgtgggccgacctgctggagctgattgacaccaggatgcagctgctggccgccagctatgacctgcaccgctacttctacacaggagctgagatcctgggcctgattgatgagaagcaccgggagctgcctgaagatgtgggcctggatgccagcacagctgagagcttccaccgggtgcacacagcctttgagcgggagctgcacctgctgggcgtgcaggtgcagcagttccaggatgtggccacccggctgcagacagcctatgctggggagaaggccgaggccatccagaacaaggagcaggaggtgtctgctgcctggcaggccctgctggatgcctgtgccggccgccgcacccagctggtggacacagctgacaagttccgcttcttctccatggcccgggacctgctgtcctggatggagagcatcatccggcagatcgagacccaggagcggcccagagatgtgtcctctgtggagctgctgatgaagtaccaccagggcatcaatgctgagattgagaccaggagcaagaacttcagcgcctgcctggagctgggggagagcctgctgcagaggcagcaccaggccagcgaggagatccgggagaagctgcagcaggtgatgagcaggaggaaggagatgaatgagaagtgggaggcccgctgggagcggctgaggatgctgctggaggtgtgccagttcagcagagatgcctctgtggccgaggcctggctgattgcccaggagccctacctggccagcggggactttggccacacagtggacagcgtggagaagctgatcaagagacatgaggcctttgagaagagcacagcctcctgggccgagagatttgctgccctggagaagcccaccaccctggagctgaaggagcggcagattgctgagaggcctgctgaggagaccggcccccaggaggaggagggggagacagctggggaggcccctgtgagccaccacgccgccacagagaggaccagccctggagaggaggagggcacctggccccagaacctgcagcagcccccacctcctggccagcacaaggatggccagaagagcactggagatgagcggcccaccacagagcccctcttcaaggtgctggacacccccctgtctgaaggagatgagcccgccaccctgcctgccccccgggaccacggccagagcgtgcagatggagggctacctgggcaggaagcatgacctggagggccccaacaagaaggccagcaacagatcctggaacaacctgtactgtgtgctgagaaattctgagctgaccttctacaaggatgccaagaacctggccctgggcatgccctaccatggagaggagcccctggccctgcggcatgccatctgtgaaattgctgccaactacaagaagaagaagcacgtgttcaagctgcggctgagcaatggcagcgagtggctgttccacggcaaggatgaggaggagatgctgtcctggctgcagggcgtgtccacagccatcaatgaaagccagagcatccgggtgaaggcccagagcctgcccctgcccagcctgagcggcccagatgccagcctgggcaagaaggacaaggagaagcgcttctccttcttccccaagaagaagtag

SEQ ID NO: 171299 - DNA, 6414 bp, Artificial Sequence; identical to SEQ ID NO: 171296
  Description of Artificial Sequence: Synthetic coding sequence

SEQ ID NO: 171300 - DNA, 6987 bp, Artificial Sequence; identical to SEQ ID NO: 171297
  Description of Artificial Sequence: Synthetic coding sequence

SEQ ID NO: 171301 - DNA, 6468 bp, Artificial Sequence
  Description of Artificial Sequence: Synthetic coding sequence
atggagctgcagaggaccagcagcatcagcggccccctgagccctgcctacacaggccaggtgccctacaactacaaccagctggagggccgcttcaagcagctgcaggatgagcgggaggccgtgcagaagaagaccttcaccaagtgggtgaacagccacctggcccgggtgtcctgccgcatcacagacctgtacacagacctgagagatggccgcatgctgatcaagctgctggaggtgctgtctggagagcggctgcccaagcccaccaagggccgcatgaggatccactgcctggagaatgtggacaaggccctgcagttcctgaaggagcagagggtgcacctggagaacatgggcagccatgacatcgtggatggcaaccaccggctgaccctgggcctcatctggaccatcatcctgcgcttccagatccaggacatctctgtggagacagaggacaacaaggagaagaagagcgccaaggatgccctgctgctgtggtgccagatgaagacagctggctacccaaatgtgaacatccacaacttcaccacctcctggagagatggcatggccttcaatgccctgatccacaagcacaggccagacctgattgactttgacaagctgaagaagagcaatgcccactacaacctgcagaatgccttcaacctggccgagcagcacctgggcctgaccaagctgctggaccctgaggacatctctgtggaccacccagatgagaagagcatcatcacctacgtggtgacctactaccactacttcagcaagatgaaggccctggccgtggagggcaagagaattggcaaggtgctggacaatgccattgaaacagagaagatgattgagaagtatgagagcctggccagtgacctgctggagtggattgagcagaccatcatcatcctgaacaacaggaagtttgccaacagcctggtgggcgtgcagcagcagctgcaggccttcaacacctacagaacagtggagaagccacccaagttcacagagaagggcaacctggaggtgctgctcttcaccatccagagcaagatgagggccaacaaccagaaggtgtacatgccccgggagggcaagctgatcagtgacatcaacaaggcctgggagcggctggagaaggccgagcacgagcgggagctggccctgagaaatgaactcatccggcaggagaagctggagcagctggccaggagatttgacaggaaggccgccatgagggagacctggctgtctgagaaccagaggctggtgtcccaggacaactttggatttgacctgcctgctgtggaggccgccaccaagaagcatgaggccatcgagacagacattgctgcctatgaggagcgggtgcaggccgtggtggccgtggcccgggagctggaggccgagaactaccatgacatcaagaggatcacagccaggaaggacaacgtcatccggctgtgggagtacctgctggagctgctgcgggcccggcggcagaggctggagatgaacctgggcctgcagaagatcttccaggagatgctgtacatcatggactggatggatgagatgaaggtgctggtgctgagccaggactatggcaagcacctgctgggcgtggaggacctgctgcagaagcacaccctggtggaggccgacatcggcatccaggccgagcgggtgcggggcgtgaatgccagcgcccagaagtttgccacagatggagagggctacaagccctgtgacccccaggtgatccgggacagagtggcccacatggagttctgctaccaggagctgtgccagctggccgctgagcggcgggcccggctggaggagagccggcggctgtggaagttcttctgggagatggccgaggaggagggctggatccgggagaaggagaagatcctgagcagtgatgattatggcaaggacctgacctctgtgatgaggctgctgagcaagcaccgggcctttgaagatgagatgagcggccgcagcggccactttgagcaggccatcaaggagggggaggacatgattgctgaggagcactttggaagtgagaagatccgggagcgcatcatctacatccgggagcagtgggccaacctggagcagctgagcgccatcaggaagaagaggctggaggaggccagcctgctgcaccagttccaggctgatgctgatgacattgatgcctggatgctggacatcctgaagatcgtgagcagcagtgatgtgggccatgatgagtacagcacccagagcctggtgaagaagcacaaggatgtggccgaggagatcgccaactaccggcccaccctggacaccctgcacgagcaggccagcgccctgccccaggagcacgccgagagcccagatgtgcggggccgcctgagcggcatcgaggagcgctacaaggaggtggccgagctgacccggctgaggaagcaggccctgcaggacaccctggccctgtacaagatgttttctgaggctgatgcctgtgagctgtggattgatgagaaggagcagtggctgaacaacatgcagatccctgagaagctggaggacctggaggtgatccagcacagatttgagagcctggagcctgagatgaacaaccaggccagccgggtggccgtggtgaaccagatcgcccggcagctgatgcacagcggccaccccagcgagaaggagatcaaggcccagcaggacaagctgaacacccgctggagccagttccgggagctggtggacaggaagaaggatgccctgctgagcgccctgagcatccagaactaccacctggagtgcaatgagaccaagtcctggatccgggagaagaccaaggtgattgagagcacccaggacctgggcaatgacctggccggcgtgatggccctgcagaggaagctgaccggcatggagcgggacctggtggccatcgaggccaagctgagtgacctgcagaaggaggccgagaagctggagagcgagcacccagaccaggcccaggccatcctgagccggctggccgagatcagtgatgtgtgggaggagatgaagaccaccctgaagaaccgggaggccagcctgggggaggccagcaagctgcagcagttcctgcgggacctggatgacttccagagctggctgagcaggacccagacagccatcgccagcgaggacatgcccaacaccctgacagaggccgagaagctgctgacccagcacgagaacatcaagaatgaaattgacaactatgaggaggactaccagaagatgagggacatgggagagatggtgacccagggccagacagatgcccagtacatgttcctgcggcagaggctgcaggccctggacaccggctggaatgagctgcacaagatgtgggagaaccggcagaacctgctgagccagagccacgcctaccagcagttcctgcgggacaccaagcaggccgaggccttcctgaacaaccaggagtatgtgctggcccacacagagatgcccaccaccctggagggcgctgaggccgccatcaagaagcaggaggacttcatgaccaccatggatgccaatgaggagaagatcaatgctgtggtggagaccggccggcggctggtgtctgatggcaacatcaacagcgaccgcatccaggagaaggtggacagcattgatgacagacacaggaagaaccgggagacagccagcgagctgctgatgaggctgaaggacaacagagacctgcagaagttcctgcaggactgccaggagctgagcctgtggatcaatgagaagatgctgacagcccaggacatgtcctatgatgaggccaggaacctgcacagcaagtggctgaagcaccaggccttcatggccgagctggccagcaacaaggagtggctggacaagattgagaaggagggcatgcagctgatcagcgagaagccagagacagaggccgtggtgaaggagaagctgaccggcctgcacaagatgtgggaggtgctggagagcaccacccagaccaaggcccagaggctgtttgatgccaacaaggccgagctgttcacccagagctgtgccgacctggacaagtggctgcacggcctggagagccagatccagagtgatgattatggcaaggacctgacctctgtgaacatcctgctgaagaagcagcagatgctggagaaccagatggaggtgaggaagaaggagattgaggagctgcagagccaggcccaggccctgagccaggagggcaagagcacagatgaggtggacagcaagaggctgactgtgcagaccaagttcatggagctgctggagcccctgaatgaaaggaagcacaacctgctggccagcaaggagatccaccagttcaacagagatgtggaggatgagatcctgtgggtgggggagaggatgcccctggccaccagcacagaccacggccacaacctgcagacagtgcagctgctgatcaagaagaaccagaccctgcagaaggagatccagggccaccagcccagaattgatgacatctttgagaggagccagaacatcgtgacagacagcagcagcctgtctgctgaggccatccggcagaggctggccgacctgaagcagctgtggggcctgctgattgaggagacagagaagaggcaccggcggctggaggaggcccaccgggcccagcagtactactttgatgctgctgaggccgaggcctggatgtctgagcaggagctgtacatgatgtctgaggagaaggccaaggatgagcagagcgctgtgtccatgctgaagaagcaccagatcctggagcaggccgtggaggactatgcagagaccgtgcaccagctgagcaagaccagccgggccctggtggccgacagccaccctgagagcgagcgcatctccatgaggcagagcaaggtggacaagctgtatgccggcctgaaggacctggccgaggagcggcggggcaagctggatgagcggcacaggctcttccagctgaaccgggaggtggatgacctggagcagtggattgctgagcgggaggtggtggccggcagccatgagctgggccaggactatgaacatgtgaccatgctgcaggagcgcttccgggagtttgcccgggacaccggcaacatcggccaggagcgggtggacacagtgaaccacctggctgatgagctgatcaacagcggccacagtgatgctgccaccatcgccgagtggaaggatggcctgaatgaggcctgggccgacctgctggagctgattgacaccaggacccagatcctggccgccagctatgagctgcacaagttctaccatgatgccaaggagatcttcggccgcatccaggacaagcacaagaagctgcctgaggagctgggccgggaccagaacacagtggagaccctgcagaggatgcacaccacctttgaacatgacatccaggccctgggcacccaggtgcggcagctgcaggaggatgctgcccggctgcaggccgcctatgctggggacaaggcagatgacatccagaagagagaaaatgaggtgctggaggcctggaagagcctgctggatgcctgtgagagccggcgggtgcggctggtggacacaggagacaagttccgcttcttctccatggtgcgggacctgatgctgtggatggaggatgtgatccggcagatcgaggcccaggagaagcccagagatgtgtcctctgtggagctgctgatgaacaaccaccagggcatcaaggccgagattgatgccagaaatgacagcttcaccacctgcatcgagctgggcaagagcctgctggccaggaagcactacgccagcgaggagatcaaggagaagctgctgcagctgacagagaagaggaaggagatgattgacaagtgggaggaccgctgggagtggctgcggctcatcctggaggtgcaccagttcagcagagatgcctctgtggccgaggcctggctgctgggccaggagccctacctgagcagccgggagatcggccagagcgtggatgaggtggagaagctgatcaagagacatgaggcctttgagaagtctgctgccacctgggatgagcgcttcagcgccctggagcggctgaccaccctggagctgctggaggtgcggcggcagcaggaggaggaggagaggaagagaagaccacccagccctgagcccagcaccaaggtgtctgaggaggccgagagccagcagcagtgggacaccagcaagggggagcaggtgtcccagaatggcctgcctgctgagcagggcagcccccgggtgtcctaccgcagccagacctaccagaactacaagaacttcaacagcagaagaacagccagtgaccagccctggagcggcctgtag

SEQ ID NO: 171302 - DNA, 7095 bp, Artificial Sequence
  Description of Artificial Sequence: Synthetic coding sequence
atgaccaccaccgtggccacagattatgacaacatcgagatccagcagcagtacagtgatgtgaacaaccgctgggatgtggatgactgggacaatgaaaacagcagcgcccggctgtttgagaggagccgcatcaaggccctggctgatgagcgggaggccgtgcagaagaagaccttcaccaagtgggtgaacagccacctggcccgggtgtcctgccgcatcacagacctgtacacagacctgagagatggccgcatgctgatcaagctgctggaggtgctgagcggggagcggctgcccaagcccaccaagggccgcatgaggatccactgcctggagaatgtggacaaggccctgcagttcctgaaggagcagagggtgcacctggagaacatgggcagccatgacatcgtggatggcaaccaccggctgaccctgggcctcatctggaccatcatcctgcgcttccagatccaggacatctctgtggagacagaggacaacaaggagaagaagagcgccaaggatgccctgctgctgtggtgccagatgaagacagctggctaccccaacgtgaacatccacaacttcaccacctcctggagagatggcatggccttcaatgccctgatccacaagcacaggccagacctgattgactttgacaagctgaagaagagcaatgcccactacaacctgcagaatgccttcaacctggccgagcagcacctgggcctgaccaagctgctggaccctgaggacatctctgtggaccacccagatgagaagagcatcatcacctacgtggtgacctactaccactacttcagcaagatgaaggccctggccgtggagggcaagagaattggcaaggtgctggacaatgccatcgagacagagaagatgattgagaagtatgagagcctggccagtgacctgctggagtggattgagcagaccatcatcatcctgaacaacaggaagtttgccaacagcctggtgggcgtgcagcagcagctgcaggccttcaacacctacagaacagtggagaagccacccaagttcacagagaagggcaacctggaggtgctgctcttcaccatccagagcaagatgagggccaacaaccagaaggtgtacatgccccgggagggcaagctgatcagtgacatcaacaaggcctgggagcggctggagaaggccgagcacgagcgggagctggccctgagaaatgagctgatccggcaggagaagctggagcagctggccaggagatttgacaggaaggccgccatgagggagacctggctgtctgagaaccagaggctggtgtcccaggacaactttggatttgacctgcctgctgtggaggccgccaccaagaagcatgaggccattgaaacagacattgctgcctatgaggagcgggtgcaggccgtggtggccgtggcccgggagctggaggccgagaactaccatgacatcaagaggatcacagccaggaaggacaacgtcatccggctgtgggagtacctgctggagctgctgcgggcccggcggcagaggctggagatgaacctgggcctgcagaagatcttccaggagatgctgtacatcatggactggatggatgagatgaaggtgctggtgctgagccaggactatggcaagcacctgctgggcgtggaggacctgctgcagaagcacaccctggtggaggccgacatcggcatccaggccgagcgggtgcggggcgtgaatgccagcgcccagaagtttgccacagatggagagggctacaagccctgtgacccccaggtgatccgggacagagtggcccacatggagttctgctaccaggagctgtgccagctggccgctgagcggcgggcccggctggaggagagccggcggctgtggaagttcttctgggagatggccgaggaggagggctggatccgggagaaggagaagatcctgagcagtgatgattatggcaaggacctgacctctgtgatgaggctgctgagcaagcaccgggcctttgaagatgagatgagcggccgcagcggccactttgagcaggccatcaaggagggggaggacatgattgctgaggagcacttcggcagcgagaagatccgggagcgcatcatctacatccgggagcagtgggccaacctggagcagctgagcgccatcaggaagaagaggctggaggaggccagcctgctgcaccagttccaggctgatgctgatgacattgatgcctggatgctggacatcctgaagatcgtgagcagcagtgatgtgggccatgatgagtacagcacccagagcctggtgaagaagcacaaggatgtggccgaggagatcgccaactaccggcccaccctggacaccctgcacgagcaggccagcgccctgccccaggagcacgccgagagcccagatgtgcggggccgcctgtctggaattgaggagcgctacaaggaggtggccgagctgacccggctgaggaagcaggccctgcaggacaccctggccctgtacaagatgttcagcgaggctgatgcctgtgagctgtggattgatgagaaggagcagtggctgaacaacatgcagatccctgagaagctggaggacctggaggtgatccagcacagatttgagagcctggagcctgagatgaacaaccaggccagccgggtggccgtggtgaaccagatcgcccggcagctgatgcacagcggccaccccagcgagaaggagatcaaggcccagcaggacaagctgaacacccgctggagccagttccgggagctggtggacaggaagaaggatgccctgctgagcgccctgagcatccagaactaccacctggagtgcaatgagaccaagtcctggatccgggagaagaccaaggtgattgagagcacccaggacctgggcaatgacctggccggcgtgatggccctgcagaggaagctgaccggcatggagcgggacctggtggccatcgaggccaagctgagtgacctgcagaaggaggccgagaagctggagagcgagcacccagaccaggcccaggccatcctgagccggctggccgagatcagtgatgtgtgggaggagatgaagaccaccctgaagaaccgggaggccagcctgggggaggccagcaagctgcagcagttcctgcgggacctggatgacttccagagctggctgagcaggacccagacagccatcgccagcgaggacatgcccaacaccctgacagaagctgagaagctgctgacccagcacgagaacatcaagaatgaaattgacaactatgaggaggactaccagaagatgagggacatgggagagatggtgacccagggccagacagatgcccagtacatgttcctgcggcagaggctgcaggccctggacaccggctggaatgagctgcacaagatgtgggagaaccggcagaacctgctgagccagagccacgcctaccagcagttcctgcgggacaccaagcaggccgaggccttcctgaacaaccaggagtatgtgctggcccacacagagatgcccaccaccctggagggcgctgaggccgccatcaagaagcaggaggacttcatgaccaccatggatgccaatgaggagaagatcaatgctgtggtggagactggaagaaggctggtgtctgatggcaacatcaacagcgaccgcatccaggagaaggtggacagcattgatgacagacacaggaagaaccgggagacagccagcgagctgctgatgaggctgaaggacaacagagacctgcagaagttcctgcaggactgccaggagctgagcctgtggatcaatgagaagatgctgacagcccaggacatgtcctatgatgaggccaggaacctgcacagcaagtggctgaagcaccaggccttcatggccgagctggccagcaacaaggagtggctggacaagattgagaaggagggcatgcagctgatcagcgagaagccagagacagaagctgtggtgaaggagaagctgaccggcctgcacaagatgtgggaggtgctggagagcaccacccagaccaaggcccagaggctgtttgatgccaacaaggccgagctgttcacccagagctgtgccgacctggacaagtggctgcacggcctggagagccagatccagagtgatgattatggcaaggacctgacctctgtgaacatcctgctgaagaagcagcagatgctggagaaccagatggaggtgaggaagaaggagattgaggagctgcagagccaggcccaggccctgagccaggagggcaagagcacagatgaggtggacagcaagaggctgactgtgcagaccaagttcatggagctgctggagcccctgaatgaaaggaagcacaacctgctggccagcaaggagatccaccagttcaacagagatgtggaggatgagatcctgtgggtgggggagaggatgcccctggccaccagcacagaccacggccacaacctgcagacagtgcagctgctgatcaagaagaaccagaccctgcagaaggagatccagggccaccagcccagaattgatgacatctttgagaggagccagaacatcgtgacagacagcagcagcctgtctgctgaggccatccggcagaggctggccgacctgaagcagctgtggggcctgctgattgaggagacagagaagaggcaccggcggctggaggaggcccaccgggcccagcagtactactttgatgctgctgaggccgaggcctggatgtctgagcaggagctgtacatgatgtctgaggagaaggccaaggatgagcagagcgctgtgtccatgctgaagaagcaccagatcctggagcaggccgtggaggactatgcagagaccgtgcaccagctgagcaagaccagccgggccctggtggccgacagccaccctgagagcgagcgcatctccatgaggcagagcaaggtggacaagctgtatgccggcctgaaggacctggccgaggagcggcggggcaagctggatgagcggcacaggctcttccagctgaaccgggaggtggatgacctggagcagtggattgctgagcgggaggtggtggccggcagccatgagctgggccaggactatgagcacgtgaccatgctgcaggagcgcttccgggagtttgcccgggacaccggcaacatcggccaggagcgggtggacacagtgaaccacctggctgatgagctgatcaacagcggccacagtgatgctgccaccatcgccgagtggaaggatggcctgaatgaggcctgggccgacctgctggagctgattgacaccaggacccagatcctggccgccagctatgagctgcacaagttctaccatgatgccaaggagatcttcggccgcatccaggacaagcacaagaagctgcctgaggagctgggccgggaccagaacacagtggagaccctgcagaggatgcacaccacctttgaacatgacatccaggccctgggcacccaggtgcggcagctgcaggaggatgctgcccggctgcaggccgcctatgctggggacaaggcagatgacatccagaagcgggagaatgaggtgctggaggcctggaagagcctgctggatgcctgtgagagcagaagagtgcggctggtggacaccggggacaagttccgcttcttctccatggtgcgggacctgatgctgtggatggaggatgtgatccggcagatcgaggcccaggagaagcccagagatgtgtcctctgtggagctgctgatgaacaaccaccagggcatcaaggccgagattgatgccagaaatgacagcttcaccacctgcatcgagctgggcaagagcctgctggccaggaagcactacgccagcgaggagatcaaggagaagctgctgcagctgacagagaagaggaaggagatgattgacaagtgggaggaccgctgggagtggctgcggctcatcctggaggtgcaccagttcagcagagatgcctctgtggccgaggcctggctgctgggccaggagccctacctgagcagccgggagatcggccagagcgtggatgaggtggagaagctgatcaagagacatgaggcctttgagaagtctgctgccacctgggatgagcgcttcagcgccctggagcggctgaccaccctggagctgctggaggtgcggcggcagcaggaggaggaggagaggaagaggcggccccccagccctgagcccagcaccaaggtgtctgaggaggccgagagccagcagcagtgggacaccagcaaaggagagcaggtgtcccagaatggcctgcctgctgagcagggcagccccaggatggccgagaccgtggacaccagcgagatggtgaatggagccacagagcagaggaccagcagcaaggagagcagccccatccccagccccaccagtgacaggaaggccaagacagccctgcctgcccagagcgctgccaccctgcctgcccggacccaggagaccccatctgcccagatggagggcttcctgaacaggaagcatgagtgggaggcccacaacaagaaggccagcagccgctcctggcacaacgtgtactgtgtgatcaacaaccaggagatgggcttctacaaggatgccaagacagctgccagcggcatcccctaccacagcgaggtgcctgtgtccctgaaggaggccgtgtgtgaggtggccctggactacaagaagaagaagcacgtgttcaagctgcggctgaatgatggaaatgagtacctgttccaggccaaggatgatgaggagatgaacacctggatccaggccatcagcagcgccatcagcagtgacaagcatgaggtgtctgccagcacccagagcaccccagccagcagccgggcccagaccctgcccacctctgtggtgaccatcaccagcgagagcagccctgggaagcgggagaaggacaaggagaaggacaaggagaagcgcttcagcctgtttgggaagaagaagtag

SEQ ID NO: 171303 - DNA, 2073 bp, Artificial Sequence
  Description of Artificial Sequence: Synthetic coding sequence
atgaccaccaccgtggccacagattatgacaacatcgagatccagcagcagtacagtgatgtgaacaaccgctgggatgtggatgactgggacaatgaaaacagcagcgcccggctgtttgagaggagccgcatcaaggccctggctgatgagcgggaggccgtgcagaagaagaccttcaccaagtgggtgaacagccacctggcccgggtgtcctgccgcatcacagacctgtacacagacctgagagatggccgcatgctgatcaagctgctggaggtgctgagcggggagcggctgcccaagcccaccaagggccgcatgaggatccactgcctggagaatgtggacaaggccctgcagttcctgaaggagcagagggtgcacctggagaacatgggcagccatgacatcgtggatggcaaccaccggctgaccctgggcctcatctggaccatcatcctgcgcttccagatccaggacatctctgtggagacagaggacaacaaggagaagaagagcgccaaggatgccctgctgctgtggtgccagatgaagacagctggctaccccaacgtgaacatccacaacttcaccacctcctggagagatggcatggccttcaatgccctgatccacaagcacaggccagacctgattgactttgacaagctgaagaagagcaatgcccactacaacctgcagaatgccttcaacctggccgagcagcacctgggcctgaccaagctgctggaccctgaggacatctctgtggaccacccagatgagaagagcatcatcacctacgtggtgacctactaccactacttcagcaagatgaaggccctggccgtggagggcaagagaattggcaaggtgctggacaatgccatcgagacagagaagatgattgagaagtatgagagcctggccagtgacctgctggagtggattgagcagaccatcatcatcctgaacaacaggaagtttgccaacagcctggtgggcgtgcagcagcagctgcaggccttcaacacctacagaacagtggagaagccacccaagttcacagagaagggcaacctggaggtgctgctcttcaccatccagagcaagatgagggccaacaaccagaaggtgtacatgccccgggagggcaagctgatcagtgacatcaacaaggcctgggagcggctggagaaggccgagcacgagcgggagctggccctgagaaatgagctgatccggcaggagaagctggagcagctggccaggagatttgacaggaaggccgccatgagggagacctggctgtctgagaaccagaggctggtgtcccaggacaactttggatttgacctgcctgctgtggaggccgccaccaagaagcatgaggccattgaaacagacattgctgcctatgaggagcgggtgcaggccgtggtggccgtggcccgggagctggaggccgagaactaccatgacatcaagaggatcacagccaggaaggacaacgtcatccggctgtgggagtacctgctggagctgctgcgggcccggcggcagaggctggagatgaacctgggcctgcagaagatcttccaggagatgctgtacatcatggactggatggatgagatgaaggtgctggtgctgagccaggactatggcaagcacctgctgggcgtggaggacctgctgcagaagcacaccctggtggaggccgacatcggcatccaggccgagcgggtgcggggcgtgaatgccagcgcccagaagtttgccacagatggagagggctacaagccctgtgacccccaggtgatccgggacagagtggcccacatggagttctgctaccaggagctgtgccagctggccgctgagcggcgggcccggctggaggagagccggcggctgtggaagttcttctgggagatggccgaggaggagggctggatccgggagaaggagaagatcctgagcagtgatgattatggcaaggacctgacctctgtgatgaggctgctgagcaagcaccgggcctttgaagatgagatgagcggccgctag

SEQ ID NO: 171304 - DNA, 7173 bp, Artificial Sequence
  Description of Artificial Sequence: Synthetic coding sequence
atgagcagcaccctgagccccacagactttgacagcctggagatccagggccagtacagcgacatcaacaaccgctgggacctgcctgacagcgactgggacaatgacagcagcagcgcccggctgtttgagaggagccgcatcaaggccctggctgatgagcgggaggccgtgcagaagaagaccttcaccaagtgggtgaacagccacctggcccgggtgacctgccgggtgggggacctgtacagcgacctgagagatggaagaaacctgctgcggctgctggaggtgctgtctggagagatcctgcccaagcccaccaagggccgcatgaggatccactgcctggagaatgtggacaaggccctgcagttcctgaaggagcagaaggtgcacctggagaacatgggcagccatgacatcgtggatggcaaccaccggctgaccctgggcctggtgtggaccatcatcctgcgcttccagatccaggacatctctgtggagacagaggacaacaaggagaagaagagcgccaaggatgccctgctgctgtggtgccagatgaagacagctggctacccaaatgtgaatgtgcacaacttcaccacctcctggagagatggcctggccttcaatgccatcgtgcacaagcacaggccagacctgctggactttgagagcctgaagaagtgcaatgcccactacaacctgcagaatgccttcaacctggccgagaaggagctgggcctgaccaagctgctggaccctgaagatgtgaatgtggaccagccagatgagaagagcatcatcacctacgtggccacctactaccactacttcagcaagatgaaggccctggccgtggagggcaagagaattggcaaggtgctggaccacgccatggaggccgagcggctggtggagaagtatgagagcctggccagcgagctgctgcagtggattgagcagaccatcgtgaccctgaatgaccggcagctggccaacagcctgagcggcgtgcagaaccagctgcagagcttcaacagctacagaacagtggagaagccacccaagttcacagagaagggcaacctggaggtgctgctcttcaccatccagagcaagctgcgggccaacaaccagaaggtgtacaccccccgggagggccgcctcatcagtgacatcaacaaggcctgggagcggctggagaaggccgagcacgagcgggagctggccctgaggacagagctgatccggcaggagaagctggagcagctggccgccaggtttgacaggaaggccgccatgagggagacctggctgtctgagaaccagaggctggtgtcccaggacaactttggcctggagctggccgctgtggaggccgctgtgaggaagcatgaggccatcgagacagacatcgtggcctacagcggccgggtgcaggccgtggatgctgtggccgctgagctggccgctgagcgctaccatgacatcaagagaattgctgcccggcagcacaacgtggcccggctgtgggacttcctgcggcagatggtggccgcccggcgggagcggctgctgctgaacctggagctgcagaaggtgttccaggacctgctgtacctgatggactggatggaggagatgaagggccgcctgcagagccaggacctgggccgccacctggccggcgtggaggacctgctgcagctgcacgagctggtggaggccgacattgctgtgcaggccgagcgggtgcgggctgtgtctgccagcgccctgcgcttctgcaaccctgggaaggagtaccggccctgtgacccccagctggtgtctgagcgggtggccaagctggagcagagctatgaggccctgtgtgagctggccgccgcccggcgggcccggctggaggagagccggcggctgtggaggttcctgtgggaggtgggggaggccgaggcctgggtgcgggagcagcagcacctgctggccagcgctgacaccggccgggacctgaccggggccctgcggctgctgaacaagcacacagccctgcggggggagatgagcggccgcctgggccccctgaagctgaccctggagcagggccagcagctggtggccgagggccaccctggggccagccaggccagcgcccgggctgctgagctgcaggcccagtgggagcggctggaggccctggccgaggagcgggcccagaggctggcccaggccgccagcctgtaccagttccaggctgatgccaatgacatggaggcctggctggtggatgccctgcggctggtgagcagccctgagctgggccatgatgagttcagcacccaggccctggcccggcagcaccgggccctggaggaggagatccgcagccaccggcccaccctggatgccctgcgggagcaggccgccgccctgccccccaccctgagcaggaccccagaggtgcagagccgggtgcccaccctggagcggcactatgaggagctgcaggcccgggccggggagcgggcccgggccctggaggccgccctggccctgtacaccatgctgtctgaggccggggcctgtggcctgtgggtggaggagaaggagcagtggctgaatggcctggccctgcctgagcggctggaggacctggaggtggtgcagcagagatttgagaccctggagcctgagatgaacaccctggccgcccagatcacagctgtgaatgacattgctgagcagctgctgaaggccaaccccccaggcaaggacagaattgtgaacacccaggagcagctgaaccaccgctggcagcagttccggcggctggctgatggcaagaaggccgccctgaccagcgccctgagcatccagaactaccacctggagtgcacagagacccaggcctggatgagggagaagaccaaggtgattgagagcacccagggcctgggcaatgacctggccggcgtgctggccctgcagaggaagctggccggcacagagcgggacctggaggccatcgccgcccgggtgggggagctgacccgggaggccaatgccctggccgccggccacccagcccaggccgtggccatcaatgcccggctgcgggaggtgcagacaggctgggaggacctgcgggccaccatgagaagaagagaggagagcctgggggaggcccggcggctgcaggacttcctgcggagcctggatgacttccaggcctggctgggccgcacccagacagctgtggccagcgaggagggccctgccaccctgcctgaggccgaggccctgctggcccagcacgccgccctgcggggggaggtggagcgggcccagagcgagtacagccggctgcgggccctgggggaggaggtgacccgggaccaggccgacccccagtgcctcttcctgcggcagaggctggaggccctgggcaccggctgggaggagctgggccgcatgtgggagagccggcagggccgcctggcccaggcccacggcttccagggcttcctgagagatgcccggcaggccgagggcgtgctgagcagccaggagtatgtgctgagccacacagagatgcctggcaccctgcaggccgcagatgctgccatcaagaagctggaggacttcatgagcaccatggatgccaacggggagcgcatccacggcctgctggaggccggccggcagctggtgtctgagggcaacatccacgccgacaagatccgggagaaggctgacagcattgaaagaagacacaagaagaaccaggatgctgcccagcagttcctgggccgcctgcgggacaaccgggagcagcagcacttcctgcaggactgccacgagctgaagctgtggattgatgagaagatgctgacagcccaggatgtgtcctatgatgaggccaggaacctgcacaccaagtggcagaagcaccaggccttcatggccgagctggccgccaacaaggactggctggacaaggtggacaaggagggccgggagctgaccctggagaagccagagctgaaggccctggtgtctgagaagctgcgggacctgcaccggcgctgggatgagctggagaccaccacccaggccaaggcccggagcctgtttgatgccaacagagctgagctgtttgcccagagctgctgtgccctggagagctggctggagagcctgcaggcccagctgcacagtgatgattatggcaaggacctgacctctgtgaacatcctgctgaagaagcagcagatgctggagtgggagatggctgtgcgggagaaggaggtggaggccatccaggcccaggccaaggccctggcccaggaggaccagggcgctggggaggtggagaggaccagcagagctgtggaggagaagttccgggccctgtgccagcccatgagggagcgctgccggcggctgcaggccagccgggagcagcaccagttccacagagatgtggaggatgagatcctgtgggtgacagagcggctgcccatggccagctccatggagcacggcaaggacctgcccagcgtgcagctgctgatgaagaagaaccagaccctgcagaaggagatccagggccacgagcccagaattgctgacctgcgggagcggcagagggccctgggcgctgctgctgctggccctgagctggccgagctgcaggagatgtggaagaggctgggccacgagctggagctgcggggcaagaggctggaggatgccctgcgggcccagcagttctacagagatgctgctgaggccgaggcctggatgggagagcaggagctgcacatgatgggccaggagaaggccaaggatgagctgagcgcccaggccgaggtgaagaagcaccaggtgctggagcaggccctggccgactatgcccagaccatccaccagctggccgccagcagccaggacatgattgaccacgagcaccctgagagcacccgcatcagcatccggcaggcccaggtggacaagctgtatgccggcctgaaggagctggccggggagcggcgggagcggctgcaggagcacctgcggctgtgccagctgcggcgggagctggatgacctggagcagtggatccaggagcgggaggtggtggccgccagccatgagctgggccaggactatgagcacgtgaccatgctgcgggacaagttccgggagttcagccgggacaccagcaccatcggccaggagcgggtggacagcgccaatgccctggccaacggcctgattgctgggggccatgctgcccgggccaccgtggccgagtggaaggacagcctgaatgaggcctgggccgacctgctggagctgctggacacccggggccaggtgctggccgccgcctatgagctgcagcgcttcctgcacggggcccggcaggccctggcccgggtgcagcacaagcagcagcagctgcctgatggcaccggccgggacctgaatgctgctgaggccctgcagaggaggcactgtgcctatgaacatgacatccaggccctgagcccccaggtgcagcaggtgcaggatgatggccaccggctgcagaaggcctatgctggggacaaggccgaggagatcggccgccacatgcaggccgtggccgaggcctgggcccagctgcagggcagcagcgctgcccggcggcagctgctgctggacaccacagacaagttccgcttcttcaaggctgtgcgggagctgatgctgtggatggatgaggtgaacctgcagatggatgcccaggagcggcccagagatgtgtcctctgctgacctggtgatcaagaaccagcagggcatcaaggccgagattgaggcccgggctgaccgcttcagcagctgcatcgacatgggcaaggagctgctggcccggagccactacgccgctgaggagatcagcgagaagctgagccagctgcaggcccggcggcaggagacagctgagaagtggcaggagaagatggactggctgcagctggtgctggaggtgctggtgtttggaagagatgctggcatggccgaggcctggctgtgcagccaggagcccctggtgcgctctgctgagctgggctgcaccgtggatgaggtggagagcctcatcaagagacatgaggccttccagaagtctgctgtggcctgggaggagcgcttctgtgccctggagaagctgacagccctggaggagcgggagaaggagaggaagaggaagcgggaggaggaggagaggaggaagcagcccccagcccctgagcccacagcctctgtgcccccaggggacctggtgggcggccagacagccagtgacaccacctgggatggcacccagccccggcccccacccagcacccaggcccccagcgtgaatggagtgtgcacagatggagagcccagccagcccctgctgggccagcagaggctggagcacagcagcttccctgagggccctggccctggcagcggagatgaggccaacggccccagaggagagcggcagaccaggacccggggccctgcccccagcgccatgccccagagccgcagcacagagagcgcccatgctgccaccctgcccccccggggccctgagcccagcgcccaggagcagatggagggcatgctgtgcaggaagcaggagatggaggccttcggcaagaaggccgccaacagatcctggcagaatgtgtactgtgtgctgcggcggggcagcctgggcttctacaaggatgccaaggccgccagcgctggggtgccctaccatggagaggtgcctgtgtccctggcccgggcccagggctctgtggcctttgactacaggaagaggaagcacgtgttcaagctgggcctgcaggacggcaaggagtacctgttccaggccaaggatgaggccgagatgagctcctggctgcgggtggtgaatgctgccatcgccacagccagcagcgccagcggggagcctgaggagcctgtggtgcccagcaccacccggggcatgacccgggccatgaccatgcctcctgtgtcccctgtgggcgctgagggccctgtggtgctgcggagcaaggatggccgggagcgggagcgggagaagcgcttctccttcttcaagaagaacaagtag

SEQ ID NO: 171305 - DNA, 2805 bp, Artificial Sequence
  Description of Artificial Sequence: Synthetic coding sequence
atgagcagcaccctgagccccacagactttgacagcctggagatccagggccagtacagcgacatcaacaaccgctgggacctgcctgacagcgactgggacaatgacagcagcagcgcccggctgtttgagaggagccgcatcaaggccctggctgatgagcgggaggccgtgcagaagaagaccttcaccaagtgggtgaacagccacctggcccgggtgacctgccgggtgggggacctgtacagcgacctgagagatggaagaaacctgctgcggctgctggaggtgctgtctggagagatcctgcccaagcccaccaagggccgcatgaggatccactgcctggagaatgtggacaaggccctgcagttcctgaaggagcagaaggtgcacctggagaacatgggcagccatgacatcgtggatggcaaccaccggctgaccctgggcctggtgtggaccatcatcctgcgcttccagatccaggacatctctgtggagacagaggacaacaaggagaagaagagcgccaaggatgccctgctgctgtggtgccagatgaagacagctggctacccaaatgtgaatgtgcacaacttcaccacctcctggagagatggcctggccttcaatgccatcgtgcacaagcacaggccagacctgctggactttgagagcctgaagaagtgcaatgcccactacaacctgcagaatgccttcaacctggccgagaaggagctgggcctgaccaagctgctggaccctgaagatgtgaatgtggaccagccagatgagaagagcatcatcacctacgtggccacctactaccactacttcagcaagatgaaggccctggccgtggagggcaagagaattggcaaggtgctggaccacgccatggaggccgagcggctggtggagaagtatgagagcctggccagcgagctgctgcagtggattgagcagaccatcgtgaccctgaatgaccggcagctggccaacagcctgagcggcgtgcagaaccagctgcagagcttcaacagctacagaacagtggagaagccacccaagttcacagagaagggcaacctggaggtgctgctcttcaccatccagagcaagctgcgggccaacaaccagaaggtgtacaccccccgggagggccgcctcatcagtgacatcaacaaggcctgggagcggctggagaaggccgagcacgagcgggagctggccctgaggacagagctgatccggcaggagaagctggagcagctggccgccaggtttgacaggaaggccgccatgagggagacctggctgtctgagaaccagaggctggtgtcccaggacaactttggcctggagctggccgctgtggaggccgctgtgaggaagcatgaggccatcgagacagacatcgtggcctacagcggccgggtgcaggccgtggatgctgtggccgctgagctggccgctgagcgctaccatgacatcaagagaattgctgcccggcagcacaacgtggcccggctgtgggacttcctgcggcagatggtggccgcccggcgggagcggctgctgctgaacctggagctgcagaaggtgttccaggacctgctgtacctgatggactggatggaggagatgaagggccgcctgcagagccaggacctgggccgccacctggccggcgtggaggacctgctgcagctgcacgagctggtggaggccgacattgctgtgcaggccgagcgggtgcgggctgtgtctgccagcgccctgcgcttctgcaaccctgggaaggagtaccggccctgtgacccccagctggtgtctgagcgggtggccaagctgacagccctggaggagcgggagaaggagaggaagaggaagcgggaggaggaggagaggaggaagcagcccccagcccctgagcccacagcctctgtgcccccaggggacctggtgggcggccagacagccagtgacaccacctgggatggcacccagccccggcccccacccagcacccaggcccccagcgtgaatggagtgtgcacagatggagagcccagccagcccctgctgggccagcagaggctggagcacagcagcttccctgagggccctggccctggcagcggagatgaggccaacggccccagaggagagcggcagaccaggacccggggccctgcccccagcgccatgccccagagccgcagcacagagagcgcccatgctgccaccctgcccccccggggccctgagcccagcgcccaggagcagatggagggcatgctgtgcaggaagcaggagatggaggccttcggcaagaaggccgccaacagatcctggcagaatgtgtactgtgtgctgcggcggggcagcctgggcttctacaaggatgccaaggccgccagcgctggggtgccctaccatggagaggtgcctgtgtccctggcccgggcccagggctctgtggcctttgactacaggaagaggaagcacgtgttcaagctgggcctgcaggacggcaaggagtacctgttccaggccaaggatgaggccgagatgagctcctggctgcgggtggtgaatgctgccatcgccacagccagcagcgccagcggggagcctgaggagcctgtggtgcccagcaccacccggggcatgacccgggccatgaccatgcctcctgtgtcccctgtgggcgctgagggccctgtggtgctgcggagcaaggatggccgggagcgggagcgggagaagcgcttctccttcttcaagaagaacaagtag

SEQ ID NO: 171306 - DNA, 354 bp, Artificial Sequence
  Description of Artificial Sequence: Synthetic coding sequence
atgagcagcaccctgagccccacagactttgacagcctggagatccagggccagtacagcgacatcaacaaccgctgggacctgcctgacagcgactgggacaatgacagcagcagcgcccggctgtttgagaggagccgcatcaaggccctggctgatgagcgggaggccgtgcagaagaagaccttcaccaagtgggtgaacagccacctggcccgggtgacctgccgggtgggggacctgtacagcgacctgagagatggaagaaacctgctgcggctgctggaggtgctgtctggagagatcctgcccaagcccaccaagggccgcatgaggatccactgcctggagtag

SEQ ID NO: 171307 - DNA, 7098 bp, Artificial Sequence
  Description of Artificial Sequence: Synthetic coding sequence
atgagcagcaccctgagccccacagactttgacagcctggagatccagggccagtacagcgacatcaacaaccgctgggacctgcctgacagcgactgggacaatgacagcagcagcgcccggctgtttgagaggagccgcatcaaggccctggctgatgagcgggaggccgtgcagaagaagaccttcaccaagtgggtgaacagccacctggcccgggtgacctgccgggtgggggacctgtacagcgacctgagagatggaagaaacctgctgcggctgctggaggtgctgtctggagagatcctgcccaagcccaccaagggccgcatgaggatccactgcctggagaatgtggacaaggccctgcagttcctgaaggagcagaaggtgcacctggagaacatgggcagccatgacatcgtggatggcaaccaccggctgaccctgggcctggtgtggaccatcatcctgcgcttccagatccaggacatctctgtggagacagaggacaacaaggagaagaagagcgccaaggatgccctgctgctgtggtgccagatgaagacagctggctacccaaatgtgaatgtgcacaacttcaccacctcctggagagatggcctggccttcaatgccatcgtgcacaagcacaggccagacctgctggactttgagagcctgaagaagtgcaatgcccactacaacctgcagaatgccttcaacctggccgagaaggagctgggcctgaccaagctgctggaccctgaagatgtgaatgtggaccagccagatgagaagagcatcatcacctacgtggccacctactaccactacttcagcaagatgaaggccctggccgtggagggcaagagaattggcaaggtgctggaccacgccatggaggccgagcggctggtggagaagtatgagagcctggccagcgagctgctgcagtggattgagcagaccatcgtgaccctgaatgaccggcagctggccaacagcctgagcggcgtgcagaaccagctgcagagcttcaacagctacagaacagtggagaagccacccaagttcacagagaagggcaacctggaggtgctgctcttcaccatccagagcaagctgcgggccaacaaccagaaggtgtacaccccccgggagggccgcctcatcagtgacatcaacaaggcctgggagcggctggagaaggccgagcacgagcgggagctggccctgaggacagagctgatccggcaggagaagctggagcagctggccgccaggtttgacaggaaggccgccatgagggagacctggctgtctgagaaccagaggctggtgtcccaggacaactttggcctggagctggccgctgtggaggccgctgtgaggaagcatgaggccatcgagacagacatcgtggcctacagcggccgggtgcaggccgtggatgctgtggccgctgagctggccgctgagcgctaccatgacatcaagagaattgctgcccggcagcacaacgtggcccggctgtgggacttcctgcggcagatggtggccgcccggcgggagcggctgctgctgaacctggagctgcagaaggtgttccaggacctgctgtacctgatggactggatggaggagatgaagggccgcctgcagagccaggacctgggccgccacctggccggcgtggaggacctgctgcagctgcacgagctggtggaggccgacattgctgtgcaggccgagcgggtgcgggctgtgtctgccagcgccctgcgcttctgcaaccctgggaaggagtaccggccctgtgacccccagctggtgtctgagcgggtggccaagctggagcagagctatgaggccctgtgtgagctggccgccgcccggcgggcccggctggaggagagccggcggctgtggaggttcctgtgggaggtgggggaggccgaggcctgggtgcgggagcagcagcacctgctggccagcgctgacaccggccgggacctgaccggggccctgcggctgctgaacaagcacacagccctgcggggggagatgagcggccgcctgggccccctgaagctgaccctggagcagggccagcagctggtggccgagggccaccctggggccagccaggccagcgcccgggctgctgagctgcaggcccagtgggagcggctggaggccctggccgaggagcgggcccagaggctggcccaggccgccagcctgtaccagttccaggctgatgccaatgacatggaggcctggctggtggatgccctgcggctggtgagcagccctgagctgggccatgatgagttcagcacccaggccctggcccggcagcaccgggccctggaggaggagatccgcagccaccggcccaccctggatgccctgcgggagcaggccgccgccctgccccccaccctgagcaggaccccagaggtgcagagccgggtgcccaccctggagcggcactatgaggagctgcaggcccgggccggggagcgggcccgggccctggaggccgccctggccctgtacaccatgctgtctgaggccggggcctgtggcctgtgggtggaggagaaggagcagtggctgaatggcctggccctgcctgagcggctggaggacctggaggtggtgcagcagagatttgagaccctggagcctgagatgaacaccctggccgcccagatcacagctgtgaatgacattgctgagcagctgctgaaggccaaccccccaggcaaggacagaattgtgaacacccaggagcagctgaaccaccgctggcagcagttccggcggctggctgatggcaagaaggccgccctgaccagcgccctgagcatccagaactaccacctggagtgcacagagacccaggcctggatgagggagaagaccaaggtgattgagagcacccagggcctgggcaatgacctggccggcgtgctggccctgcagaggaagctggccggcacagagcgggacctggaggccatcgccgcccgggtgggggagctgacccgggaggccaatgccctggccgccggccacccagcccaggccgtggccatcaatgcccggctgcgggaggtgcagacaggctgggaggacctgcgggccaccatgagaagaagagaggagagcctgggggaggcccggcggctgcaggacttcctgcggagcctggatgacttccaggcctggctgggccgcacccagacagctgtggccagcgaggagggccctgccaccctgcctgaggccgaggccctgctggcccagcacgccgccctgcggggggaggtggagcgggcccagagcgagtacagccggctgcgggccctgggggaggaggtgacccgggaccaggccgacccccagtgcctcttcctgcggcagaggctggaggccctgggcaccggctgggaggagctgggccgcatgtgggagagccggcagggccgcctggcccaggcccacggcttccagggcttcctgagagatgcccggcaggccgagggcgtgctgagcagccaggagtatgtgctgagccacacagagatgcctggcaccctgcaggccgcagatgctgccatcaagaagctggaggacttcatgagcaccatggatgccaacggggagcgcatccacggcctgctggaggccggccggcagctggtgtctgagggcaacatccacgccgacaagatccgggagaaggctgacagcattgaaagaagacacaagaagaaccaggatgctgcccagcagttcctgggccgcctgcgggacaaccgggagcagcagcacttcctgcaggactgccacgagctgaagctgtggattgatgagaagatgctgacagcccaggatgtgtcctatgatgaggccaggaacctgcacaccaagtggcagaagcaccaggccttcatggccgagctggccgccaacaaggactggctggacaaggtggacaaggagggccgggagctgaccctggagaagccagagctgaaggccctggtgtctgagaagctgcgggacctgcaccggcgctgggatgagctggagaccaccacccaggccaaggcccggagcctgtttgatgccaacagagctgagctgtttgcccagagctgctgtgccctggagagctggctggagagcctgcaggcccagctgcacagtgatgattatggcaaggacctgacctctgtgaacatcctgctgaagaagcagcagatgctggagtgggagatggctgtgcgggagaaggaggtggaggccatccaggcccaggccaaggccctggcccaggaggaccagggcgctggggaggtggagaggaccagcagagctgtggaggagaagttccgggccctgtgccagcccatgagggagcgctgccggcggctgcaggccagccgggagcagcaccagttccacagagatgtggaggatgagatcctgtgggtgacagagcggctgcccatggccagctccatggagcacggcaaggacctgcccagcgtgcagctgctgatgaagaagaaccagaccctgcagaaggagatccagggccacgagcccagaattgctgacctgcgggagcggcagagggccctgggcgctgctgctgctggccctgagctggccgagctgcaggagatgtggaagaggctgggccacgagctggagctgcggggcaagaggctggaggatgccctgcgggcccagcagttctacagagatgctgctgaggccgaggcctggatgggagagcaggagctgcacatgatgggccaggagaaggccaaggatgagctgagcgcccaggccgaggtgaagaagcaccaggtgctggagcaggccctggccgactatgcccagaccatccaccagctggccgccagcagccaggacatgattgaccacgagcaccctgagagcacccgcatcagcatccggcaggcccaggtggacaagctgtatgccggcctgaaggagctggccggggagcggcgggagcggctgcaggagcacctgcggctgtgccagctgcggcgggagctggatgacctggagcagtggatccaggagcgggaggtggtggccgccagccatgagctgggccaggactatgagcacgtgaccatgctgcgggacaagttccgggagttcagccgggacaccagcaccatcggccaggagcgggtggacagcgccaatgccctggccaacggcctgattgctgggggccatgctgcccgggccaccgtggccgagtggaaggacagcctgaatgaggcctgggccgacctgctggagctgctggacacccggggccaggtgctggccgccgcctatgagctgcagcgcttcctgcacggggcccggcaggccctggcccgggtgcagcacaagcagcagcagctgcctgatggcaccggccgggacctgaatgctgctgaggccctgcagaggaggcactgtgcctatgaacatgacatccaggccctgagcccccaggtgcagcaggtgcaggatgatggccaccggctgcagaaggcctatgctggggacaaggccgaggagatcggccgccacatgcaggccgtggccgaggcctgggcccagctgcagggcagcagcgctgcccggcggcagctgctgctggacaccacagacaagttccgcttcttcaaggctgtgcgggagctgatgctgtggatggatgaggtgaacctgcagatggatgcccaggagcggcccagagatgtgtcctctgctgacctggtgatcaagaaccagcagggcatcaaggccgagattgaggcccgggctgaccgcttcagcagctgcatcgacatgggcaaggagctgctggcccggagccactacgccgctgaggagatcagcgagaagctgagccagctgcaggcccggcggcaggagacagctgagaagtggcaggagaagatggactggctgcagctggtgctggaggtgctggtgtttggaagagatgctggcatggccgaggcctggctgtgcagccaggagcccctggtgcgctctgctgagctgggctgcaccgtggatgaggtggagagcctcatcaagagacatgaggccttccagaagtctgctgtggcctgggaggagcgcttctgtgccctggagaagctgacagccctggaggagcgggagaaggagaggaagaggaagcgggaggaggaggagaggaggaagcagcccccagcccctgagcccacagcctctgtgcccccaggggacctggtgggcggccagacagccagtgacaccacctgggatggcacccagccccggcccccacccagcacccaggcccccagcgtgaatggagtgtgcacagatggagagcccagccagcccctgctgggccagcagaggctggagcacagcagcttccctgagggccctggccctggcagcggagatgaggccaacggccccagaggagagcggcagaccaggacccggggccctgcccccagcgccatgccccagagccgcagcacagagagcgcccatgctgccaccctgcccccccggggccctgagcccagcgcccaggagcagatggagggcatgctgtgcaggaagcaggagatggaggccttcggcaagaaggccgccaacagatcctggcagaatgtgtactgtgtgctgcggcggggcagcctgggcttctacaaggatgccaaggccgccagcgctggggtgccctaccatggagaggtgcctgtgtccctggcccgggcccagggctctgtggcctttgactacaggaagaggaagcacgtgttcaagctgggcctgcaggacggcaaggagtacctgttccaggccaaggatgaggtgtcctgccccagctgcagcagcctgtctgtgcccttccagaagctgcctgctgctgacagccccagcttccctgtgctgcccctcttccctggcctggtgctgtgtgggaagacaggctgtgtgcggcggccccaccaggccgccctgcctgtgtag

SEQ ID NO: 171308 - DNA, 7173 bp, Artificial Sequence; identical to SEQ ID NO: 171304
  Description of Artificial Sequence: Synthetic coding sequence

SEQ ID NO: 171309 - DNA, 6465 bp, Artificial Sequence
  Description of Artificial Sequence: Synthetic coding sequence
atggcccaggtgcctggagaggtggacaacatggagggcctgcctgcccccaacaacaacccagctgcccgctgggagagcccagaccggggctgggagcgggagcagcctgctgccagcacagctgctgccagcctgtttgagtgcagccgcatcaaggccctggctgatgagcgggaggccgtgcagaagaagaccttcaccaagtgggtgaacagccacctggcccgggtgggctgccacatcggggacctgtatgtggacctgagagatggctttgtgctgacccggctgctggaggtgctgtctggagagcagctgccccggcccacccggggccgcatgaggatccacagcctggagaatgtggacaaggccctgcagttcctgaaggagcagagggtgcacctggagaatgtgggcagccatgacatcgtggatggcaaccaccggctgaccctgggcctggtgtggaccatcatcctgcgcttccagatccaggtgatcaagattgaaacagaggacaaccgggagaccaggtctgccaaggatgccctgctgctgtggtgccagatgaagacagctggctacccagaggtgaacatccagaacttcaccacctcctggagagatggcctggccttcaatgccctgatccaccgccacaggccagacctggtggacttcagcaagctgaccaagagcaatgccaactacaacctgcagagggccttcagaacagctgagcagcacctgggcctggcccggctgctggaccctgaagatgtgaacatggaggccccagatgagaagagcatcatcacctacgtggtgtccttctaccactacttcagcaagatgaaggccctggccgtggagggcaagagaattggcaaggtgctggaccaggtgctggaggtgggcaagatcatcgagagatatgaggagctggccgctgagctgctggcctggatccacaggacagtgggcctcatcagcaaccagaagtttgccaacagcctgagcggcgtgcagcagcagctgcaggccttcaccgcctactgcaccctggagaagcctgtgaagttccaggagaagggcaacctggaggtgctgctcttcagcatccagagcaagctgcgggcctgcaacagaagactctttgtgccccgggagggctgcggcatctgggacatcgacaaggcctggggcgagctggagaaggccgagcacgagcgggaggccgccctgcgggcagagctgatccggcaggagaagctggagctgctggcccagagatttgaccacaaggtggccatgagggagagctggctgaatgaaaaccagaggctggtgtcccaggacaactttggctatgagctgcctgctgtggaggccgccatgaagaagcatgaggccatcgaggccgacattgctgcctatgaggagcgggtgcagggcgtggccgagctggcccaggccctggccgctgagggctactatgacatccggcgggtggccgcccagagggacagcgtgctgcggcagtgggccctgctgaccggcctggtgggcgcccggaggacccggctggagcagaacctggccctgcagaaggtgttccaggagatggtgtacatggtggactggatggaggagatgcaggcccagctgctgagccgggagtgtggccagcacctggtggaggctgatgacctgctgcagaagcacggcctgctggagggggacattgctgcccagagcgagcgggtggaggccctgaatgctgctgccctgcgcttcagccagctgcagggctaccagccctgtgacccccaggtgatctgcaacagagtgaaccacgtgcacggctgcctggccgagctgcaggagcaggccgcccggcggcgggcagagctggaggccagccgcagcctgtgggccctgctgcaggagctggaggaggccgagagctgggcccgggacaaggagcggctgctggaggccgccggcggcggcggggccgccggggctgctggagctgctggaacagctggaggagcccatgacctgagcagcacagcccggctgctggcccagcacaagatcctgcagggcgagctgggcggcagaagagccctgctgcagcaggccctgcgctgtggggaggagctggtggccgccggcggcgctgtgggccctggagctgacacagtgcacctggtgggcctggccgagcgggccgccagcgcccggcggcgctggcagaggctggaggaggccgccgcccggcgggagcggcggctgcaggaggcccgggccctgcaccagtttggagctgacctggatggcctgctggactggctgagagatgcctaccgcctggccgccgccggggactttggacatgatgaggccagcagccggcggctggcccggcagcaccgggccctgactggagaggtggaggcccaccggggccctgtgtctggcctgcggcggcagctggccaccctgggcggggccagcggggccggccccctggtggtggccctgcaggtgcgggtggtggaggccgagcagctgtttgctgaggtgacagaggtggccgccctgcggcggcagtggctgagagatgccctggccgtgtacaggatgtttggagaggtgcacgcctgtgagctgtggattggagagaaggagcagtggctgctgtccatgagggtgcctgacagcctggatgatgtggaggtggtgcagcacagatttgagagcctggaccaggagatgaacagcctgatgggccgggtgctggatgtgaaccacacagtgcaggagctggtggagggcggccaccccagcagtgatgaggtgcgcagctgccaggaccacctgaacagccgctggaaccgcatcgtggagctggtggagcagaggaaggaggagatgtctgctgtgctgctggtggagaaccacgtgctggaggtggccgaggtgcgggcccaggtgcgggagaagagaagagctgtggagagcgccccccgggccggcggggccctgcagtggaggctgagcggcctggaggccgccctgcaggccctggagccccggcaggccgccctgctggaggaggccgccctgctggccgagcgcttccctgcccaggccgcccggctgcaccagggcgctgaggagctgggcgctgagtggggcgccctggccagcgctgcccaggcctgtggggaggccgtggccgctgctggccgcctgcagcgcttcctgcatgacctggatgccttcctggactggctggtgcgggcccaggaggccgccggcggcagcgagggccccctgcccaacagcctggaggaggctgatgccctgctggcccggcatgctgccctgaaggaggaggtggaccagcgggaggaggactatgccagaattgtggccgccagcgaggccctgctggccgcagatggagctgagctgggccctggcctggccctggatgagtggctgccccacctggagctgggctggcacaagctgctgggcctgtgggaggcccggcgggaggccctggtgcaggcccacatctaccagctgttcctgcgggacctgcggcaggccctggtggtgctgaggaaccaggagatggccctgtctggagctgagctgcccggcaccgtggagagcgtggaggaggccctgaagcagcaccgggacttcctgaccaccatggagctgagccagcagaagatgcaggtggccgtgcaggccgctgagggcctgctgcggcagggcaacatctacggggagcaggcccaggaggccgtgacccggctgctggagaagaaccaggagaaccagctgcgggcccagcagtggatgcagaagctgcatgaccagctggagctgcagcacttcctgcgggactgccacgagctggatggctggatccacgagaagatgctgatggccagagatggcacccgggaggacaaccacaagctgcacaagcgctggctgcggcaccaggccttcatggccgagctggcccagaacaaggagtggctggagaagattgagcgggagggccagcagctgatgcaggagaagccagagctggccgcctctgtgaggaagaagctgggggagatccggcagtgctgggccgagctggagagcaccacccaggccaaggcccggcagctgtttgaggccagcaaggctgaccagctggtgcagagctttgctgagctggacaagaagctgctgcacatggagagccagctgcaggatgtggaccccggcggggacctggccaccgtgaacagccagctgaagaagctgcagagcatggagagccaggtggaggagtggtaccgggaggtgggggagctgcaggcccagacagctgccctgcccctggagcccgccagcaaggagctggtgggggagcggcagaatgctgtgggggagcggctggtgcggctgctggagcccctgcaggagcggcggcggctgctgctggccagcaaggagctgcaccaggtggcccatgacctggatgatgagctggcctgggtgcaggagcggctgcccctggccatgcagacagaaagaggaaatggcctgcaggccgtgcagcagcacatcaagaagaaccagggcctgcggcgggagatccaggcccacggcccccggctggaggaggtgctggagcgggccggggccctggccagcctgcggagccctgaggccgaggccgtgagaagaggcctggagcagctgcagagcgcctgggccggcctgcgggaggccgctgagcggcggcagcaggtgctggatgctgccttccaggtggagcagtactactttgatgtggccgaggtggaggcctggctgggggagcaggagctgctgatgatgtctgaagataaaggcaaggatgagcagagcaccctgcagctgctgaagaagcacctgcagctggagcagggcgtggagaactatgaggagagcatcgcccagctgagccggcagtgccgggccctgctggagatgggccacccagattctgagcagatcagccggcggcagagccaggtggaccggctgtatgtggccctgaaggagctgggggaggagaggagagtggccctggagcagcagtactggctgtaccagctgagccggcaggtgtctgagctggagcactggattgctgagaaggaggtggtggccggcagccctgagctgggccaggactttgaacatgtgtctgtgctgcaggagaagttcagcgagtttgccagcgagaccggcatggccggccgggagcggctggccgctgtgaaccagatggtggatgagctgattgaatgtggccacacagctgctgccaccatggccgagtggaaggatggcctgaatgaggcctgggccgagctgctggagctgatgggcacccgggcccagctgctggccgccagccgggagctgcacaagttcttcagtgatgcccgggagctgcagggccagatcgaggagaagagaagaaggctgccccggctgaccaccccacctgagccccggcccagcgccagctccatgcagaggaccctgcgggcctttgaacatgacctgcagctgctggtgtcccaggtgcggcagctgcaggagggcgccgcccagctgaggacagtgtatgctggggagcacgccgaggccatcgccagccgggagcaggaggtgctgcagggctggaaggagctgctgagcgcctgtgaagatgcccggctgcacgtgagcagcacagcagatgccctgcgcttccacagccaggtgcgggacctgctgtcctggatggatggcatcgccagccagattggagctgctgacaagcccagagatgtgtcctctgtggaggtgctgatgaactaccaccagggcctgaagacagagctggaggcccgggtgcctgagctgaccacctgccaggagctgggccgcagcctgctgctgaacaagagcgccatggctgatgagatccaggcccagctggacaagctgggcaccaggaaggaggaggtgtctgagaagtgggacagacactgggagtggctgcagcagatgctggaggtgcaccagtttgcccaggaggccgtggtggctgatgcctggctgacagcccaggagcccctgctgcagagccgggagctgggcagctctgtggatgaggtggagcagctgatcagaagacatgaggccttcaggaaggctgctgctgcctgggaggagcgcttcagcagcctgcggcggctgaccaccccccggcgggaggaccacctgaaccctggggtgcaggaccagccctggcagcacacagagaagcccagcctgcccaagcccaaggccaacaaggagaagacagccaggagagatggcacctgcctgtag

SEQ ID NO: 171310 - DNA, 3930 bp, Artificial Sequence
  Description of Artificial Sequence: Synthetic coding sequence
atggcccaggtgcctggagaggtggacaacatggagggcctgcctgcccccaacaacaacccagctgcccgctgggagagcccagaccggggctgggagcgggagcagcctgctgccagcacagctgctgccagcctgtttgagtgcagccgcatcaaggccctggctgatgagcgggaggccgtgcagaagaagaccttcaccaagtgggtgaacagccacctggcccgggtgggctgccacatcggggacctgtatgtggacctgagagatggctttgtgctgacccggctgctggaggtgctgtctggagagcagctgccccggcccacccggggccgcatgaggatccacagcctggagaatgtggacaaggccctgcagttcctgaaggagcagagggtgcacctggagaatgtgggcagccatgacatcgtggatggcaaccaccggctgaccctgggcctggtgtggaccatcatcctgcgcttccagatccaggtgatcaagattgaaacagaggacaaccgggagaccaggtctgccaaggatgccctgctgctgtggtgccagatgaagacagctggctacccagaggtgaacatccagaacttcaccacctcctggagagatggcctggccttcaatgccctgatccaccgccacaggccagacctggtggacttcagcaagctgaccaagagcaatgccaactacaacctgcagagggccttcagaacagctgagcagcacctgggcctggcccggctgctggaccctgaagatgtgaacatggaggccccagatgagaagagcatcatcacctacgtggtgtccttctaccactacttcagcaagatgaaggccctggccgtggagggcaagagaattggcaaggtgctggaccaggtgctggaggtgggcaagatcatcgagagatatgaggagctggccgctgagctgctggcctggatccacaggacagtgggcctcatcagcaaccagaagtttgccaacagcctgagcggcgtgcagcagcagctgcaggccttcaccgcctactgcaccctggagaagcctgtgaagttccaggagaagggcaacctggaggtgctgctcttcagcatccagagcaagctgcgggcctgcaacagaagactctttgtgccccgggagggctgcggcatctgggacatcgacaaggcctggggcgagctggagaaggccgagcacgagcgggaggccgccctgcgggcagagctgatccggcaggagaagctggagctgctggcccagagatttgaccacaaggtggccatgagggagagctggctgaatgaaaaccagaggctggtgtcccaggacaactttggctatgagctgcctgctgtggaggccgccatgaagaagcatgaggccatcgaggccgacattgctgcctatgaggagcgggtgcagggcgtggccgagctggcccaggccctggccgctgagggctactatgacatccggcgggtggccgcccagagggacagcgtgctgcggcagtgggccctgctgaccggcctggtgggcgcccggaggacccggctggagcagaacctggccctgcagaaggtgttccaggagatggtgtacatggtggactggatggaggagatgcaggcccagctgctgagccgggagtgtggccagcacctggtggaggctgatgacctgctgcagaagcacggcctgctggagggggacattgctgcccagagcgagcgggtggaggccctgaatgctgctgccctgcgcttcagccagctgcagggctaccagccctgtgacccccaggtgatctgcaacagagtgaaccacgtgcacggctgcctggccgagctgcaggagcaggccgcccggcggcgggcagagctggaggccagccgcagcctgtgggccctgctgcaggagctggaggaggccgagagctgggcccgggacaaggagcggctgctggaggccgccggcggcggcggggccgccggggctgctggagctgctggaacagctggaggagcccatgacctgagcagcacagcccggctgctggcccagcacaagatcctgcagggcgagctgggcggcagaagagccctgctgcagcaggccctgcgctgtggggaggagctggtggccgccggcggcgctgtgggccctggagctgacacagtgcacctggtgggcctggccgagcgggccgccagcgcccggcggcgctggcagaggctggaggaggccgccgcccggcgggagcggcggctgcaggaggcccgggccctgcaccagtttggagctgacctggatggcctgctggactggctgagagatgcctaccgcctggccgccgccggggactttggacatgatgaggccagcagccggcggctggcccggcagcaccgggccctgactggagaggtggaggcccaccggggccctgtgtctggcctgcggcggcagctggccaccctgggcggggccagcggggccggccccctggtggtggccctgcaggtgcgggtggtggaggccgagcagctgtttgctgaggtgacagaggtggccgccctgcggcggcagtggctgagagatgccctggccgtgtacaggatgtttggagaggtgcacgcctgtgagctgtggattggagagaaggagcagtggctgctgtccatgagggtgcctgacagcctggatgatgtggaggtggtgcagcacagatttgagagcctggaccaggagatgaacagcctgatgggccgggtgctggatgtgaaccacacagtgcaggagctggtggagggcggccaccccagcagtgatgaggtgcgcagctgccaggaccacctgaacagccgctggaaccgcatcgtggagctggtggagcagaggaaggaggagatgtctgctgtgctgctggtggagaaccacgtgctggaggtggccgaggtgcgggcccaggtgcgggagaagagaagagctgtggagagcgccccccgggccggcggggccctgcagtggaggctgagcggcctggaggccgccctgcaggccctggagccccggcaggccgccctgctggaggaggccgccctgctggccgagcgcttccctgcccaggccgcccggctgcaccagggcgctgaggagctgggcgctgagtggggcgccctggccagcgctgcccaggcctgtggggaggccgtggccgctgctggccgcctgcagcgcttcctgcatgacctggatgccttcctggactggctggtgcgggcccaggaggccgccggcggcagcgagggccccctgcccaacagcctggaggaggctgatgccctgctggcccggcatgctgccctgaaggaggaggtggaccagcgggaggaggactatgccagaattgtggccgccagcgaggccctgctggccgcagatggagctgagctgggccctggcctggccctggatgagtggctgccccacctggagctgggctggcacaagctgctgggcctgtgggaggcccggcgggaggccctggtgcaggcccacatctaccagctgttcctgcgggacctgcggcaggccctggtggtgctgaggaaccaggagatggccctgtctggagctgagctgcccggcaccgtggagagcgtggaggaggccctgaagcagcaccgggacttcctgaccaccatggagctgagccagcagaagatgcaggtggccgtgcaggccgctgagggcctgctgcggcagggcaacatctacggggagcaggcccaggaggccgtgacccggctgctggagaagtgcctgatcatccacccagccctgctgcaccccccctgggagcccccagacctgcccaggagcagcagctag

SEQ ID NO: 171311 - DNA, 7695 bp, Artificial Sequence
  Description of Artificial Sequence: Synthetic coding sequence
atggcccaggtgcctggagaggtggacaacatggagggcctgcctgcccccaacaacaacccagctgcccgctgggagagcccagaccggggctgggagcgggagcagcctgctgccagcacagctgctgccagcctgtttgagtgcagccgcatcaaggccctggctgatgagcgggaggccgtgcagaagaagaccttcaccaagtgggtgaacagccacctggcccgggtgggctgccacatcggggacctgtatgtggacctgagagatggctttgtgctgacccggctgctggaggtgctgtctggagagcagctgccccggcccacccggggccgcatgaggatccacagcctggagaatgtggacaaggccctgcagttcctgaaggagcagagggtgcacctggagaatgtgggcagccatgacatcgtggatggcaaccaccggctgaccctgggcctggtgtggaccatcatcctgcgcttccagatccaggtgatcaagattgaaacagaggacaaccgggagaccaggtctgccaaggatgccctgctgctgtggtgccagatgaagacagctggctacccagaggtgaacatccagaacttcaccacctcctggagagatggcctggccttcaatgccctgatccaccgccacaggccagacctggtggacttcagcaagctgaccaagagcaatgccaactacaacctgcagagggccttcagaacagctgagcagcacctgggcctggcccggctgctggaccctgaagatgtgaacatggaggccccagatgagaagagcatcatcacctacgtggtgtccttctaccactacttcagcaagatgaaggccctggccgtggagggcaagagaattggcaaggtgctggaccaggtgctggaggtgggcaagatcatcgagagatatgaggagctggccgctgagctgctggcctggatccacaggacagtgggcctcatcagcaaccagaagtttgccaacagcctgagcggcgtgcagcagcagctgcaggccttcaccgcctactgcaccctggagaagcctgtgaagttccaggagaagggcaacctggaggtgctgctcttcagcatccagagcaagctgcgggcctgcaacagaagactctttgtgccccgggagggctgcggcatctgggacatcgacaaggcctggggcgagctggagaaggccgagcacgagcgggaggccgccctgcgggcagagctgatccggcaggagaagctggagctgctggcccagagatttgaccacaaggtggccatgagggagagctggctgaatgaaaaccagaggctggtgtcccaggacaactttggctatgagctgcctgctgtggaggccgccatgaagaagcatgaggccatcgaggccgacattgctgcctatgaggagcgggtgcagggcgtggccgagctggcccaggccctggccgctgagggctactatgacatccggcgggtggccgcccagagggacagcgtgctgcggcagtgggccctgctgaccggcctggtgggcgcccggaggacccggctggagcagaacctggccctgcagaaggtgttccaggagatggtgtacatggtggactggatggaggagatgcaggcccagctgctgagccgggagtgtggccagcacctggtggaggctgatgacctgctgcagaagcacggcctgctggagggggacattgctgcccagagcgagcgggtggaggccctgaatgctgctgccctgcgcttcagccagctgcagggctaccagccctgtgacccccaggtgatctgcaacagagtgaaccacgtgcacggctgcctggccgagctgcaggagcaggccgcccggcggcgggcagagctggaggccagccgcagcctgtgggccctgctgcaggagctggaggaggccgagagctgggcccgggacaaggagcggctgctggaggccgccggcggcggcggggccgccggggctgctggagctgctggaacagctggaggagcccatgacctgagcagcacagcccggctgctggcccagcacaagatcctgcagggcgagctgggcggcagaagagccctgctgcagcaggccctgcgctgtggggaggagctggtggccgccggcggcgctgtgggccctggagctgacacagtgcacctggtgggcctggccgagcgggccgccagcgcccggcggcgctggcagaggctggaggaggccgccgcccggcgggagcggcggctgcaggaggcccgggccctgcaccagtttggagctgacctggatggcctgctggactggctgagagatgcctaccgcctggccgccgccggggactttggacatgatgaggccagcagccggcggctggcccggcagcaccgggccctgactggagaggtggaggcccaccggggccctgtgtctggcctgcggcggcagctggccaccctgggcggggccagcggggccggccccctggtggtggccctgcaggtgcgggtggtggaggccgagcagctgtttgctgaggtgacagaggtggccgccctgcggcggcagtggctgagagatgccctggccgtgtacaggatgtttggagaggtgcacgcctgtgagctgtggattggagagaaggagcagtggctgctgtccatgagggtgcctgacagcctggatgatgtggaggtggtgcagcacagatttgagagcctggaccaggagatgaacagcctgatgggccgggtgctggatgtgaaccacacagtgcaggagctggtggagggcggccaccccagcagtgatgaggtgcgcagctgccaggaccacctgaacagccgctggaaccgcatcgtggagctggtggagcagaggaaggaggagatgtctgctgtgctgctggtggagaaccacgtgctggaggtggccgaggtgcgggcccaggtgcgggagaagagaagagctgtggagagcgccccccgggccggcggggccctgcagtggaggctgagcggcctggaggccgccctgcaggccctggagccccggcaggccgccctgctggaggaggccgccctgctggccgagcgcttccctgcccaggccgcccggctgcaccagggcgctgaggagctgggcgctgagtggggcgccctggccagcgctgcccaggcctgtggggaggccgtggccgctgctggccgcctgcagcgcttcctgcatgacctggatgccttcctggactggctggtgcgggcccaggaggccgccggcggcagcgagggccccctgcccaacagcctggaggaggctgatgccctgctggcccggcatgctgccctgaaggaggaggtggaccagcgggaggaggactatgccagaattgtggccgccagcgaggccctgctggccgcagatggagctgagctgggccctggcctggccctggatgagtggctgccccacctggagctgggctggcacaagctgctgggcctgtgggaggcccggcgggaggccctggtgcaggcccacatctaccagctgttcctgcgggacctgcggcaggccctggtggtgctgaggaaccaggagatggccctgtctggagctgagctgcccggcaccgtggagagcgtggaggaggccctgaagcagcaccgggacttcctgaccaccatggagctgagccagcagaagatgcaggtggccgtgcaggccgctgagggcctgctgcggcagggcaacatctacggggagcaggcccaggaggccgtgacccggctgctggagaagaaccaggagaaccagctgcgggcccagcagtggatgcagaagctgcatgaccagctggagctgcagcacttcctgcgggactgccacgagctggatggctggatccacgagaagatgctgatggccagagatggcacccgggaggacaaccacaagctgcacaagcgctggctgcggcaccaggccttcatggccgagctggcccagaacaaggagtggctggagaagattgagcgggagggccagcagctgatgcaggagaagccagagctggccgcctctgtgaggaagaagctgggggagatccggcagtgctgggccgagctggagagcaccacccaggccaaggcccggcagctgtttgaggccagcaaggctgaccagctggtgcagagctttgctgagctggacaagaagctgctgcacatggagagccagctgcaggatgtggaccccggcggggacctggccaccgtgaacagccagctgaagaagctgcagagcatggagagccaggtggaggagtggtaccgggaggtgggggagctgcaggcccagacagctgccctgcccctggagcccgccagcaaggagctggtgggggagcggcagaatgctgtgggggagcggctggtgcggctgctggagcccctgcaggagcggcggcggctgctgctggccagcaaggagctgcaccaggtggcccatgacctggatgatgagctggcctgggtgcaggagcggctgcccctggccatgcagacagaaagaggaaatggcctgcaggccgtgcagcagcacatcaagaagaaccagggcctgcggcgggagatccaggcccacggcccccggctggaggaggtgctggagcgggccggggccctggccagcctgcggagccctgaggccgaggccgtgagaagaggcctggagcagctgcagagcgcctgggccggcctgcgggaggccgctgagcggcggcagcaggtgctggatgctgccttccaggtggagcagtactactttgatgtggccgaggtggaggcctggctgggggagcaggagctgctgatgatgtctgaagataaaggcaaggatgagcagagcaccctgcagctgctgaagaagcacctgcagctggagcagggcgtggagaactatgaggagagcatcgcccagctgagccggcagtgccgggccctgctggagatgggccacccagattctgagcagatcagccggcggcagagccaggtggaccggctgtatgtggccctgaaggagctgggggaggagaggagagtggccctggagcagcagtactggctgtaccagctgagccggcaggtgtctgagctggagcactggattgctgagaaggaggtggtggccggcagccctgagctgggccaggactttgaacatgtgtctgtgctgcaggagaagttcagcgagtttgccagcgagaccggcatggccggccgggagcggctggccgctgtgaaccagatggtggatgagctgattgaatgtggccacacagctgctgccaccatggccgagtggaaggatggcctgaatgaggcctgggccgagctgctggagctgatgggcacccgggcccagctgctggccgccagccgggagctgcacaagttcttcagtgatgcccgggagctgcagggccagatcgaggagaagagaagaaggctgccccggctgaccaccccacctgagccccggcccagcgccagctccatgcagaggaccctgcgggcctttgaacatgacctgcagctgctggtgtcccaggtgcggcagctgcaggagggcgccgcccagctgaggacagtgtatgctggggagcacgccgaggccatcgccagccgggagcaggaggtgctgcagggctggaaggagctgctgagcgcctgtgaagatgcccggctgcacgtgagcagcacagcagatgccctgcgcttccacagccaggtgcgggacctgctgtcctggatggatggcatcgccagccagattggagctgctgacaagcccagagatgtgtcctctgtggaggtgctgatgaactaccaccagggcctgaagacagagctggaggcccgggtgcctgagctgaccacctgccaggagctgggccgcagcctgctgctgaacaagagcgccatggctgatgagatccaggcccagctggacaagctgggcaccaggaaggaggaggtgtctgagaagtgggacagacactgggagtggctgcagcagatgctggaggtgcaccagtttgcccaggaggccgtggtggctgatgcctggctgacagcccaggagcccctgctgcagagccgggagctgggcagctctgtggatgaggtggagcagctgatcagaagacatgaggccttcaggaaggctgctgctgcctgggaggagcgcttcagcagcctgcggcggctgaccaccatcgagaagatcaaggccgagcagagcaagcagccccccacccccctgctgggcaggaagttcttcggggaccccacagagctggccgccaaggccgcccccctgctgcggcctgggggctatgagcggggcctggagcccctggcccggcgggccagtgacaccctgtctgctgaggtgaggaccagggtgggctacgtgcggcaggagctgaagccagagcggctgcagcccagaattgaccggctgcctgagatccctggccgggtggagcctgctgccctgcctgctgccccagaagatgctgctgagaccccagccaccccagctgctgctgagcaggtgcggcccaggcctgagcggcaggagagcgctgacagagctgaggagctgcccaggagaagaagacctgagcggcaggagagcgtggaccagagcgaggaggccgccaggagaagaagacctgagcggcaggagagcgctgagcatgaagctgcccacagcctgaccctgggccgctatgagcagatggagcggcggcgggagcggcgggagcggcggctggagcggcaggagagcagcgagcaggagatgcccatccggggggacctggtgaagggcaaggccaccctggccgacatcgtggagcagctgcaggagaaggaggccggccctggcctgcctgctggccccagcctgccccagccccgggagctgcccccaggccgcctgcccaacggcctggagctgcctgagaggacccccaggccagaccggccccgggcccgggaccggcccaagccccggcggcggccccggccccgggagggcggggagggcggcggcagccgccgcagccgcagcgccccagcccagggcggcagcgccccagcccctcctcctccacccacccacacagtgcagcacgagggcttcctgctgaggaagcgggagctggatgccaacaggaagagcagcaacagatcctgggtgtccctgtactgtgtgctgagcaaaggagagctgggcttctacaaggacagcaaaggacctgccagcggcagcacccatggaggagagcccctgctgagcctgcacaaggccaccagcgaggtggccagtgactacaagaagaagaagcacgtgttcaagctgcagacccaggacggcagcgagttcctgctgcaggccaaggatgaggaggagatgaatggctggctggaggccgtggccagctctgtggccgagcacgccgagatcgcccgctggggccagaccctgcccaccaccagcagcacagatgagggcaaccccaagcgggagggcggggacagaagagccagcggccgcaggaagtag

SEQ ID NO: 171312 - DNA, 2037 bp, Artificial Sequence
  Description of Artificial Sequence: Synthetic coding sequence
atgctgatggccagagatggcacccgggaggacaaccacaagctgcacaagcgctggctgcggcaccaggccttcatggccgagctggcccagaacaaggagtggctggagaagattgagcgggagggccagcagctgatgcaggagaagccagagctggccgcctctgtgaggaagaagctgggggagatccggcagtgctgggccgagctggagagcaccacccaggccaaggcccggcagctgtttgaggccagcaaggctgaccagctggtgcagagctttgctgagctggacaagaagctgctgcacatggagagccagctgcaggatgtggaccccggcggggacctggccaccgtgaacagccagctgaagaagctgcagagcatggagagccaggtggaggagtggtaccgggaggtgggggagctgcaggcccagacagctgccctgcccctggagcccgccagcaaggagctggtgggggagcggcagaatgctgtgggggagcggctggtgcggctgctggagcccctgcaggagcggcggcggctgctgctggccagcaaggagctgcaccaggtggcccatgacctggatgatgagctggcctgggtgcaggagcggctgcccctggccatgcagacagaaagaggaaatggcctgcaggccgtgcagcagcacatcaagaagaaccagggcctgcggcgggagatccaggcccacggcccccggctggaggaggtgctggagcgggccggggccctggccagcctgcggagccctgaggccgaggccgtgagaagaggcctggagcagctgcagagcgcctgggccggcctgcgggaggccgctgagcggcggcagcaggtgctggatgctgccttccaggtggagcagtactactttgatgtggccgaggtggaggcctggctgggggagcaggagctgctgatgatgtctgaagataaaggcaaggatgagcagagcaccctgcagctgctgaagaagcacctgcagctggagcagggcgtggagaactatgaggagagcatcgcccagctgagccggcagtgccgggccctgctggagatgggccacccagattctgagcagatcagccggcggcagagccaggtggaccggctgtatgtggccctgaaggagctgggggaggagaggagagtggccctggagcagcagtactggctgtaccagctgagccggcaggtgtctgagctggagcactggattgctgagaaggaggtggtggccggcagccctgagctgggccaggactttgaacatgtgtctgtgctgcaggagaagttcagcgagtttgccagcgagaccggcatggccggccgggagcggctggccgctgtgaaccagatggtggatgagctgattgaatgtggccacacagctgctgccaccatggccgagtggaaggatggcctgaatgaggcctgggccgagctgctggagctgatgggcacccgggcccagctgctggccgccagccgggagctgcacaagttcttcagtgatgcccgggagctgcagggccagatcgaggagaagagaagaaggctgccccggctgaccaccccacctgagccccggcccagcgccagctccatgcagaggaccctgcgggcctttgaacatgacctgcagctgctggtgtcccaggtgcggcagctgcaggagggcgccgcccagctgaggacagtgtatgctggggagcacgccgaggccatcgccagccgggagcaggaggtgctgcagggctggaaggagctgctgagcgcctgtgaagatgcccggctgcacgtgagcagcacagcagatgccctgcgcttccacagccaggtgcgggacctgctgtcctggatggatggcatcgccagccagattggagctgctgacaagccccgctgccccagcagcctgctgggcctgcctgccagcccctggtggcccaccccagccacccccagccccctgacagcccccttctccatggagtag

SEQ ID NO: 171313 - DNA, 3924 bp, Artificial Sequence
  Description of Artificial Sequence: Synthetic coding sequence
atgccccactaccccagctgcagcagcgcccccagcctgggcaccccccggcccccccagatccagcagctggaggcccggcacaggaaccaggagaaccagctgcgggcccagcagtggatgcagaagctgcatgaccagctggagctgcagcacttcctgcgggactgccacgagctggatggctggattcatgagaagatgctgatggccagagatggcacccgggaggacaaccacaagctgcacaagcgctggctgcggcaccaggccttcatggccgagctggcccagaacaaggagtggctggagaagattgaaagagagggccagcagctgatgcaggagaagccagagctggccgcctctgtgaggaagaagctgggggagatccggcagtgctgggccgagctggagagcaccacccaggccaaggcccggcagctgtttgaggccagcaaggctgaccagctggtgcagagctttgctgagctggacaagaagctgctgcacatggagagccagctgcaggatgtggaccctggaggagacctggccaccgtgaacagccagctgaagaagctgcagagcatggagagccaggtggaggagtggtaccgggaggtgggggagctgcaggcccagacagctgccctgcccctggagcccgccagcaaggagctggtgggggagcggcagaatgctgtgggggagcggctggtgcggctgctggagcccctgcaggagcggcggcggctgctgctggccagcaaggagctgcaccaggtggcccatgacctggatgatgagctggcctgggtgcaggagcggctgcccctggccatgcagacagaaagaggaaatggcctgcaggccgtgcagcagcacatcaagaagaaccagggcctgcggcgggagatccaggcccacggcccccggctggaggaggtgctggagagagctggggccctggccagcctgcggagccctgaggccgaggccgtgcggcggggcctggagcagctgcagagcgcctgggccggcctgcgggaggccgctgagcggcggcagcaggtgctggatgctgccttccaggtggagcagtactactttgatgtggccgaggtggaggcctggctgggggagcaggagctgctgatgatgtctgaggacaagggcaaggatgagcagagcaccctgcagctgctgaagaagcacctgcagctggagcagggcgtggagaactatgaggagagcatcgcccagctgagccggcagtgccgggccctgctggagatgggccacccagacagcgagcagatcagccggcggcagagccaggtggaccggctgtatgtggccctgaaggagctgggggaggagcggcgggtggccctggagcagcagtactggctgtaccagctgagccggcaggtgtctgagctggagcactggattgctgagaaggaggtggtggccggcagccctgagctgggccaggactttgagcacgtgtctgtgctgcaggagaagttcagcgagtttgccagcgagaccggcatggccggccgggagcggctggccgctgtgaaccagatggtggatgagctgattgaatgtggccacacagctgctgccaccatggccgagtggaaggatggcctgaatgaggcctgggccgagctgctggagctgatgggcacccgggcccagctgctggccgccagccgggagctgcacaagttcttcagtgatgcccgggagctgcagggccagatcgaggagaagagaagaaggctgccccggctgaccaccccacctgagccccggcccagcgccagctccatgcagaggaccctgcgggcctttgaacatgacctgcagctgctggtgtcccaggtgcggcagctgcaggagggcgccgcccagctgaggacagtgtatgctggggagcacgccgaggccatcgccagccgggagcaggaggtgctgcagggctggaaggagctgctgagcgcctgtgaagatgcccggctgcacgtgagcagcacagcagatgccctgcgcttccacagccaggtgcgggacctgctgtcctggatggatggcatcgccagccagatcggggctgctgacaagcccagagatgtgtcctctgtggaggtgctgatgaactaccaccagggcctgaagacagagctggaggcccgggtgcctgagctgaccacctgccaggagctgggccgcagcctgctgctgaacaagagcgccatggctgatgagatccaggcccagctggacaagctgggcaccaggaaggaggaggtgtctgagaagtgggacagacactgggagtggctgcagcagatgctggaggtgcaccagtttgcccaggaggccgtggtggctgatgcctggctgacagcccaggagcccctgctgcagagccgggagctgggcagctctgtggatgaggtggagcagctgatcagaagacatgaggccttcaggaaggctgctgctgcctgggaggagcgcttcagcagcctgcggcggctgaccaccatcgagaagatcaaggccgagcagagcaagcagccccccacccccctgctgggcaggaagttctttggagaccccacagagctggccgccaaggccgcccccctgctgcggcctgggggctatgaaagaggcctggagcccctggcccggcgggccagtgacaccctgtctgctgaggtgaggaccagggtgggctacgtgcggcaggagctgaagccagagcggctgcagcccagaattgaccggctgcctgagatccctggccgggtggagcctgctgccctgcctgctgccccagaagatgctgctgagaccccagccaccccagctgctgctgagcaggtgcggcccaggcctgagcggcaggagagcgctgacagagctgaggagctgcccaggagaagaagacctgagcggcaggagagcgtggaccagagcgaggaggccgccaggagaagaagacctgagcggcaggagagcgctgagcacgaggccgcccacagcctgaccctgggccgctatgagcagatggagaggagaagagagcggcgggagcggcggctggagcggcaggagagcagcgagcaggagatgcccatccggggggacctggtgaagggcaaggccaccctggccgacatcgtggagcagctgcaggagaaggaggccggccctggcctgcctgctggccccagcctgccccagccccgggagctgcccccaggccgcctgcccaacggcctggagctgcctgagaggacccccaggccagaccggccccgggcccgggaccggcccaagcccaggagaagaccccggccccgggagggcggggagggcggcggcagcagaagaagccgcagcgccccagcccagggcggcagcgccccagcccctcctcctccacccacccacacagtgcagcacgagggcttcctgctgaggaagcgggagctggatgccaacaggaagagcagcaacagatcctgggtgtccctgtactgtgtgctgagcaagggggagctgggcttctacaaggacagcaagggccctgccagcggcagcacccacggcggggagcccctgctgagcctgcacaaggccaccagcgaggtggccagtgactacaagaagaagaagcacgtgttcaagctgcagacccaggacggcagcgagttcctgctgcaggccaaggatgaggaggagatgaatggctggctggaggccgtggccagctctgtggccgagcacgccgagatcgcccgctggggccagaccctgcccaccaccagcagcacagatgagggcaaccccaagcgggagggcggggaccggcgggccagcggccgcaggaagtag

SEQ ID NO: 171314 - DNA, 7695 bp, Artificial Sequence
  Description of Artificial Sequence: Synthetic coding sequence
atggcccaggtgcctggagaggtggacaacatggagggcctgcctgcccccaacaacaacccagctgcccgctgggagagcccagaccggggctgggagcgggagcagcctgctgccagcacagctgctgccagcctgtttgagtgcagccgcatcaaggccctggctgatgagcgggaggccgtgcagaagaagaccttcaccaagtgggtgaacagccacctggcccgggtgggctgccacatcggggacctgtatgtggacctgagagatggctttgtgctgacccggctgctggaggtgctgtctggagagcagctgccccggcccacccggggccgcatgaggatccacagcctggagaatgtggacaaggccctgcagttcctgaaggagcagagggtgcacctggagaatgtgggcagccatgacatcgtggatggcaaccaccggctgaccctgggcctggtgtggaccatcatcctgcgcttccagatccaggtgatcaagattgaaacagaggacaaccgggagaccaggtctgccaaggatgccctgctgctgtggtgccagatgaagacagctggctacccagaggtgaacatccagaacttcaccacctcctggagagatggcctggccttcaatgccctgatccaccgccacaggccagacctggtggacttcagcaagctgaccaagagcaatgccaactacaacctgcagagggccttcagaacagctgagcagcacctgggcctggcccggctgctggaccctgaagatgtgaacatggaggccccagatgagaagagcatcatcacctacgtggtgtccttctaccactacttcagcaagatgaaggccctggccgtggagggcaagagaattggcaaggtgctggaccaggtgctggaggtgggcaagatcatcgagagatatgaggagctggccgctgagctgctggcctggatccacaggacagtgggcctcatcagcaaccagaagtttgccaacagcctgagcggcgtgcagcagcagctgcaggccttcaccgcctactgcaccctggagaagcctgtgaagttccaggagaagggcaacctggaggtgctgctcttcagcatccagagcaagctgcgggcctgcaacagaagactctttgtgccccgggagggctgcggcatctgggacatcgacaaggcctggggcgagctggagaaggccgagcacgagcgggaggccgccctgcgggcagagctgatccggcaggagaagctggagctgctggcccagagatttgaccacaaggtggccatgagggagagctggctgaatgaaaaccagaggctggtgtcccaggacaactttggctatgagctgcctgctgtggaggccgccatgaagaagcatgaggccatcgaggccgacattgctgcctatgaggagcgggtgcagggcgtggccgagctggcccaggccctggccgctgagggctactatgacatccggcgggtggccgcccagagggacagcgtgctgcggcagtgggccctgctgaccggcctggtgggcgcccggaggacccggctggagcagaacctggccctgcagaaggtgttccaggagatggtgtacatggtggactggatggaggagatgcaggcccagctgctgagccgggagtgtggccagcacctggtggaggctgatgacctgctgcagaagcacggcctgctggagggggacattgctgcccagagcgagcgggtggaggccctgaatgctgctgccctgcgcttcagccagctgcagggctaccagccctgtgacccccaggtgatctgcaacagagtgaaccacgtgcacggctgcctggccgagctgcaggagcaggccgcccggcggcgggcagagctggaggccagccgcagcctgtgggccctgctgcaggagctggaggaggccgagagctgggcccgggacaaggagcggctgctggaggccgccggcggcggcggggccgccggggctgctggagctgctggaacagctggaggagcccatgacctgagcagcacagcccggctgctggcccagcacaagatcctgcagggcgagctgggcggcagaagagccctgctgcagcaggccctgcgctgtggggaggagctggtggccgccggcggcgctgtgggccctggagctgacacagtgcacctggtgggcctggccgagcgggccgccagcgcccggcggcgctggcagaggctggaggaggccgccgcccggcgggagcggcggctgcaggaggcccgggccctgcaccagtttggagctgacctggatggcctgctggactggctgagagatgcctaccgcctggccgccgccggggactttggacatgatgaggccagcagccggcggctggcccggcagcaccgggccctgactggagaggtggaggcccaccggggccctgtgtctggcctgcggcggcagctggccaccctgggcggggccagcggggccggccccctggtggtggccctgcaggtgcgggtggtggaggccgagcagctgtttgctgaggtgacagaggtggccgccctgcggcggcagtggctgagagatgccctggccgtgtacaggatgtttggagaggtgcacgcctgtgagctgtggattggagagaaggagcagtggctgctgtccatgagggtgcctgacagcctggatgatgtggaggtggtgcagcacagatttgagagcctggaccaggagatgaacagcctgatgggccgggtgctggatgtgaaccacacagtgcaggagctggtggagggcggccaccccagcagtgatgaggtgcgcagctgccaggaccacctgaacagccgctggaaccgcatcgtggagctggtggagcagaggaaggaggagatgtctgctgtgctgctggtggagaaccacgtgctggaggtggccgaggtgcgggcccaggtgcgggagaagagaagagctgtggagagcgccccccgggccggcggggccctgcagtggaggctgagcggcctggaggccgccctgcaggccctggagccccggcaggccgccctgctggaggaggccgccctgctggccgagcgcttccctgcccaggccgcccggctgcaccagggcgctgaggagctgggcgctgagtggggcgccctggccagcgctgcccaggcctgtggggaggccgtggccgctgctggccgcctgcagcgcttcctgcatgacctggatgccttcctggactggctggtgcgggcccaggaggccgccggcggcagcgagggccccctgcccaacagcctggaggaggctgatgccctgctggcccggcatgctgccctgaaggaggaggtggaccagcgggaggaggactatgccagaattgtggccgccagcgaggccctgctggccgcagatggagctgagctgggccctggcctggccctggatgagtggctgccccacctggagctgggctggcacaagctgctgggcctgtgggaggcccggcgggaggccctggtgcaggcccacatctaccagctgttcctgcgggacctgcggcaggccctggtggtgctgaggaaccaggagatggccctgtctggagctgagctgcccggcaccgtggagagcgtggaggaggccctgaagcagcaccgggacttcctgaccaccatggagctgagccagcagaagatgcaggtggccgtgcaggccgctgagggcctgctgcggcagggcaacatctacggggagcaggcccaggaggccgtgacccggctgctggagaagaaccaggagaaccagctgcgggcccagcagtggatgcagaagctgcatgaccagctggagctgcagcacttcctgcgggactgccacgagctggatggctggatccacgagaagatgctgatggccagagatggcacccgggaggacaaccacaagctgcacaagcgctggctgcggcaccaggccttcatggccgagctggcccagaacaaggagtggctggagaagattgagcgggagggccagcagctgatgcaggagaagccagagctggccgcctctgtgaggaagaagctgggggagatccggcagtgctgggccgagctggagagcaccacccaggccaaggcccggcagctgtttgaggccagcaaggctgaccagctggtgcagagctttgctgagctggacaagaagctgctgcacatggagagccagctgcaggatgtggaccccggcggggacctggccaccgtgaacagccagctgaagaagctgcagagcatggagagccaggtggaggagtggtaccgggaggtgggggagctgcaggcccagacagctgccctgcccctggagcccgccagcaaggagctggtgggggagcggcagaatgctgtgggggagcggctggtgcggctgctggagcccctgcaggagcggcggcggctgctgctggccagcaaggagctgcaccaggtggcccatgactggaccacctcctgggcctgggtgcaggagcggctgcccctggccatgcagacagaaagaggaaatggcctgcaggccgtgcagcagcacatcaagaagaaccagggcctgcggcgggagatccaggcccacggcccccggctggaggaggtgctggagcgggccggggccctggccagcctgcggagccctgaggccgaggccgtgagaagaggcctggagcagctgcagagcgcctgggccggcctgcgggaggccgctgagcggcggcagcaggtgctggatgctgccttccaggtggagcagtactactttgatgtggccgaggtggaggcctggctgggggagcaggagctgctgatgatgtctgaagataaaggcaaggatgagcagagcaccctgcagctgctgaagaagcacctgcagctggagcagggcgtggagaactatgaggagagcatcgcccagctgagccggcagtgccgggccctgctggagatgggccacccagattctgagcagatcagccggcggcagagccaggtggaccggctgtatgtggccctgaaggagctgggggaggagaggagagtggccctggagcagcagtactggctgtaccagctgagccggcaggtgtctgagctggagcactggattgctgagaaggaggtggtggccggcagccctgagctgggccaggactttgaacatgtgtctgtgctgcaggagaagttcagcgagtttgccagcgagaccggcatggccggccgggagcggctggccgctgtgaaccagatggtggatgagctgattgaatgtggccacacagctgctgccaccatggccgagtggaaggatggcctgaatgaggcctgggccgagctgctggagctgatgggcacccgggcccagctgctggccgccagccgggagctgcacaagttcttcagtgatgcccgggagctgcagggccagatcgaggagaagagaagaaggctgccccggctgaccaccccacctgagccccggcccagcgccagctccatgcagaggaccctgcgggcctttgaacatgacctgcagctgctggtgtcccaggtgcggcagctgcaggagggcgccgcccagctgaggacagtgtatgctggggagcacgccgaggccatcgccagccgggagcaggaggtgctgcagggctggaaggagctgctgagcgcctgtgaagatgcccggctgcacgtgagcagcacagcagatgccctgcgcttccacagccaggtgcgggacctgctgtcctggatggatggcatcgccagccagattggagctgctgacaagcccagagatgtgtcctctgtggaggtgctgatgaactaccaccagggcctgaagacagagctggaggcccgggtgcctgagctgaccacctgccaggagctgggccgcagcctgctgctgaacaagagcgccatggctgatgagatccaggcccagctggacaagctgggcaccaggaaggaggaggtgtctgagaagtgggacagacactgggagtggctgcagcagatgctggaggtgcaccagtttgcccaggaggccgtggtggctgatgcctggctgacagcccaggagcccctgctgcagagccgggagctgggcagctctgtggatgaggtggagcagctgatcagaagacatgaggccttcaggaaggctgctgctgcctgggaggagcgcttcagcagcctgcggcggctgaccaccatcgagaagatcaaggccgagcagagcaagcagccccccacccccctgctgggcaggaagttcttcggggaccccacagagctggccgccaaggccgcccccctgctgcggcctgggggctatgagcggggcctggagcccctggcccggcgggccagtgacaccctgtctgctgaggtgaggaccagggtgggctacgtgcggcaggagctgaagccagagcggctgcagcccagaattgaccggctgcctgagatccctggccgggtggagcctgctgccctgcctgctgccccagaagatgctgctgagaccccagccaccccagctgctgctgagcaggtgcggcccaggcctgagcggcaggagagcgctgacagagctgaggagctgcccaggagaagaagacctgagcggcaggagagcgtggaccagagcgaggaggccgccaggagaagaagacctgagcggcaggagagcgctgagcatgaagctgcccacagcctgaccctgggccgctatgagcagatggagcggcggcgggagcggcgggagcggcggctggagcggcaggagagcagcgagcaggagatgcccatccggggggacctggtgaagggcaaggccaccctggccgacatcgtggagcagctgcaggagaaggaggccggccctggcctgcctgctggccccagcctgccccagccccgggagctgcccccaggccgcctgcccaacggcctggagctgcctgagaggacccccaggccagaccggccccgggcccgggaccggcccaagccccggcggcggccccggccccgggagggcggggagggcggcggcagccgccgcagccgcagcgccccagcccagggcggcagcgccccagcccctcctcctccacccacccacacagtgcagcacgagggcttcctgctgaggaagcgggagctggatgccaacaggaagagcagcaacagatcctgggtgtccctgtactgtgtgctgagcaaaggagagctgggcttctacaaggacagcaaaggacctgccagcggcagcacccatggaggagagcccctgctgagcctgcacaaggccaccagcgaggtggccagtgactacaagaagaagaagcacgtgttcaagctgcagacccaggacggcagcgagttcctgctgcaggccaaggatgaggaggagatgaatggctggctggaggccgtggccagctctgtggccgagcacgccgagatcgcccgctggggccagaccctgcccaccaccagcagcacagatgagggcaaccccaagcgggagggcggggacagaagagccagcggccgcaggaagtag

SEQ ID NO: 171315 - DNA, 11025 bp, Artificial Sequence
  Description of Artificial Sequence: Synthetic coding sequence
atggccggccagccccacagcccccgggagctgctgggcgctgctggccacaggagccggcggcccagcacagagctgcgggtgccccccagccccagcctgaccatggacagccagtatgagaccggccacatcaggaagctgcaggcccggcacatgcagatgcaggagaagaccttcaccaagtggatcaacaacgtgttccagtgtggccaggccggcatcaagatccggaacctgtacacagagctggctgatggcatccacctgctgcggctgctggagctgatcagcggggaggccctgcccccacccagccggggccgcctgcgggtgcacttcctggagaacagcagccgggccctggccttcctgcgggccaaggtgcctgtgcccctcatcggcccagaaaatattgtggatggagaccagaccctcatcctgggcctcatctgggtgatcatcctgcgcttccagatcagccacatcagcctggacaaggaggagtttggagccagcgctgccctgctgagcaccaaggaggccctgctggtgtggtgccagaggaagacagccagctacaccaacgtgaacatcacagacttcagccgctcctggagcgatggcctgggcttcaatgccctgattcatgcccacaggccagacctgctggactatggcagcctgcggccagaccggcccctgcacaacctggcctttgccttcctggtggccgagcaggagctgggcatcgcccagctgctggaccctgaagatgtggccgccgcccagccagatgagaggagcatcatgacctacgtgtccctgtactaccactactgcagccggctgcaccagggccagacagtgcagaggcggctgaccaagatcctgctgcagctgcaggagacagagctgctgcagacccagtatgagcagctggtggccgacctgctgcgctggattgctgagaagcagatgcagctggaggcccgggacttcccagacagcctgcctgccatgaggcagctgctggccgccttcaccatcttccgcacccaggagaagccaccccggctgcagcagagaggagctgctgaggccctgctcttccggctgcagacagccctgcaggcccagaacagaagacccttcctgccccatgagggcctgggcctggccgagctgagccagtgctgggccggcctggagtgggccgaggccgcccggagccaggccctgcagcagaggctgctgcagctgcagaggctggagaccctggcccggcgcttccagcacaaggccgccctgcgggagagcttcctgaaggatgctgagcaggtgctggaccaggcccgggcccccccagccagcctggccaccgtggaggccgctgtgcagaggctgggcatgctggaggccggcatcctgccccaggagggccgcttccaggccctggccgagattgctgacatcctgcggcaggagcagtaccacagctgggcagatgtggcccggcggcaggaggaggtgacagtgcgctggcagaggctgctgcagcacctgcagggccagaggaagcaggtggccgacatgcaggccgtgctgagcctgctgcaggaggtggaggccgccagccaccagctggaggagctgcaggagcccgcccggagcacagcctgtggccagcagctggccgaggtggtggagctgctgcagagacatgacctgctggaggcccaggtgtctgcccatggagcccacgtgagccacctggcccagcagacagctgagctggacagcagcctgggcacctctgtggaggtgctgcaggccaaggcccggaccctggcccagctgcagcagagcctggtggccctggtgcgggcccggcgggccctgctggagcagaccctgcagagagctgagttcctgaggaactgtgaggaggaggaggcctggctgaaggaatgtggccagagggtgggcaatgctgccctgggccgggacctgagccagattgctggggccctgcagaagcacaaggccctggaggccgaggtgcaccgccaccaggccgtgtgtgtggacctggtgcggcggggccgggacctgagcgcccggcggccccccacccagcctgaccccggggagcgggcagaggccgtgcagggcggctggcagctgctgcagaccagggtggtgggccgcggggcccggctgcagacagccctgctggtgctgcagtactttgctgatgctgctgaggccgcctcctggctgcgggagcggcgcagcagcctggagcgggccagctgtggccaggaccaggccgctgctgagaccctgctgcggagacatgtgcggctggagcgggtgctgcgggcctttgctgctgagctgcggcggctggaggagcagggccgggccgccagcgcccgggccagcctcttcaccgtgaacagcgccctgagccccccaggagagagcctgaggaaccctggcccctggagcgaggccagctgccaccctggccctggagatgcctggaagatggccctgcctgctgagccagaccctgactttgaccccaacaccatcctgcagacccaggaccacctgagccaggactatgagagcctgcgggccctggcccagctgcggcgggcccggctggaggaggccatggccctgtttggcttctgcagcagctgtggggagctgcagctgtggctggagaagcagacagtgctgctgcagagggtgcagccccaggccgacaccctggaggtgatgcagctgaagtatgagaacttcctgacagccctggccgtgggcaagggcctgtgggccgaggtgagcagcagcgctgagcagctgcggcagcgctacccaggcaacagcacccagatccagaggcagcaggaggagctgagccagcgctggggccagctggaggccctgaagcgggagaaggctgtgcagctggcccacagcgtggaggtgtgcagcttcctgcaggagtgtggccccacccaggtgcagctgagagatgtgctgctgcagctggaggccctgcagcccggcagcagcgaggacacctgccacgccctgcagctggcccagaagaagaccctggtgctggagcggcgggtgcacttcctgcagagcgtggtggtgaaggtggaggagcccggctacgccgagagccagcccctgcagggccaggtggagaccctgcagggcctgctgaagcaggtgcaggagcaggtggcccagagggcccggcggcaggccgagacccaggcccggcagagcttcctgcaggagagccagcagctgctgctgtgggccgagagcgtgcaggcccagctgcggagcaaggaggtgtctgtggatgtggccagcgcccagaggctgctgcgggagcaccaggacctgctggaggagatccacctgtggcaggagcggctgcagcagctggatgcccagagccagcccatggccgccctggactgcccagacagccaggaggtgcccaacaccctgcgggtgctgggccagcagggccaggagctgaaggtgctgtgggagcagaggcagcagtggctgcaggagggcctggagctgcagaagtttggccgggaggtggatggcttcaccgccacctgtgccaaccaccaggcctggctgcacctggacaacctgggggaggatgtgcgggaggccctgagcctgctgcagcagcaccgggagtttggccgcctgctgagcaccctgggccccagggctgaggccctgcgggcccacggggagaagctggtgcagagccagcaccctgctgcccacacagtgcgggagcagctgcagagcatccaggcccagtggacccggctgcagggccgctctgagcagaggcggcggcagctgctggccagcctgcagctgcaggagtggaagcaggatgtggccgagctgatgcagtggatggaggagaagggcctgatggccgcccacgagcccagcggggcccggaggaacatcctgcagaccctgaagagacatgaagctgctgagagcgagctgctggccacccggcggcacgtggaggccctgcagcaggtgggccgggagctgctgagccggcggccctgtggccaggaggacatccagacccggctgcagggcctgcggagcaagtgggaggccctgaacaggaagatgacagaaagaggagatgagctgcagcaggccggccagcaggagcagctgctgcggcagctgcaggatgccaaggagcagctggagcagctggagggcgccctgcagagcagcgagaccggccaggacctgcggagcagccagaggctgcagaagaggcaccagcagctggagagcgagagcaggaccctggccgccaagatggccgccctggcctccatggcccacggcatggccgccagccctgccatcctggaggagacccagaagcacctgcggcggctggagctgctgcagggccacctggccatccggggcctgcagctgcaggcctctgtggagctgcaccagttctgccacctgagcaacatggagctgtcctgggtggccgagcacatgccccacggcagccccaccagctacacagagtgcctgaatggagcccagagcctgcacaggaagcacaaggagctgcaggtggaggtgaaggcccaccagggccaggtgcagagggtgctgagcagcggccgcagcctggccgccagcggccacccccaggcccagcacatcgtggagcagtgccaggagctggagggccactgggccgagctggagcgggcctgtgaggcccgggcccagtgcctgcagcaggccgtgaccttccagcagtacttcctggatgtgtctgagctggagggctgggtggaggagaagaggcccctggtgagcagccgggactatggaagagatgaagctgccaccctgcggctcatcaacaagcaccaggccctgcaggaggagctggccatctactggagctccatggaggagctggaccagacagcccagaccctgactggacctgaggtgcctgagcagcagagggtggtgcaggagcggctgcgggagcagctgcgggccctgcaggagctggccgccacccgggaccgggagctggagggcaccctgcggctgcacgagttcctgcgggaggccgaggacctgcagggctggctggccagccagaagcaggccgccaagggcggggagagcctgggagaagatcctgagcacgccctgcacctgtgcaccaagtttgccaagttccagcaccaggtggagatgggcagccagagggtggccgcctgccgcctgctggccgagagcctgctggagcggggccacagcgctggccccatggtgcggcagaggcagcaggacctgcagacagcctggagcgagctgtgggagctgacccaggcccggggccacgccctgcgggacacagagaccaccctgcgggtgcaccgggacctgctggaggtgctgacccaggtgcaggagaaggccaccagcctgcccaacaacgtggcccgggacctgtgtggcctggaggcccagctgcggagccaccagggcctggagcgggagctggtgggcacagagcggcagctgcaggagctgctggagacagctggccgggtgcagaagctgtgccccggcccccaggcccatgctgtgcagcagaggcagcaggccgtgacccaggcctgggccgtgctgcagaggaggatggagcagaggcgggcccagctggagcgggcccggctgctggcccgcttcagaacagctgtgcgggactatgcctcctgggccgcccgggtgcggcaggacctgcaggtggaggagagcagccaggagcccagcagcggccccctgaagctgagcgcccaccagtggctgcgggcagagctggaggcccgggagaagctgtggcagcaggccacccagctgggccagcaggccctgctggccgccggcacccccaccaaggaggtgcaggaggagctgcgggccctgcaggaccagagggaccaggtgtaccagacctgggccaggaagcaggagcggctgcaggccgagcagcaggagcagctgttcctgagagaatgtggccgcctggaggagatcctggccgcccaggaggtgtccctgaagaccagcgccctgggcagctctgtggaggaggtggagcagctgatcaggaagcatgaggtgttcctgaaggtgctgacagcccaggacaagaaggaggccgccctgcgggagcggctgaagaccctgcggcggccccgggtgcgggaccggctgcccatcctgctgcagaggaggatgagggtgaaggagctggccgagagccggggccacgccctgcacgccagcctgctgatggccagcttcacccaggccgccacccaggccgaggactggatccaggcctgggcccagcagctgaaggagcctgtgcccccaggggacctgcgggacaagctgaagcccctgctgaagcaccaggcctttgaggccgaggtgcaggcccacgaggaggtgatgacctctgtggccaagaagggggaggccctgctggcccagagccaccccagggctggggaggtgtcccagaggctgcagggcctgaggaagcactgggaggacctgcggcaggccatggccctgcggggccaggagctggaggacagaagaaacttcctggagttcctgcagagggtggacctggccgaggcctggatccaggagaaggaggtgaagatgaatgtgggggacctgggccaggacctggagcactgcctgcagctgcggcggcggctgcgggagttccggggcaacagcgctggggacacagtgggagatgcctgcatccgcagcatcagtgacctgagcctgcagctgaagaacagagatcctgaggaggtgaagatcatctgccagaggaggagccagctgaacaaccgctgggccagcttccacggcaacctgctgcgctaccagcagcagctggagggcgccctggagatccacgtgctgagccgggagctggacaacgtgaccaagaggatccaggagaaggaggccctgatccaggccctggactgtgggaaggacctggagagcgtgcagaggctgctgaggaagcatgaggagctggagcgggaggtgcaccccatccaggcccaggtggagagcctggagcgggaggtgggccgcctgtgccagaggagccctgaggccgcccacggcctgcggcaccggcagcaggaggtggccgagagctggtggcagctgcggagccgggcccagaagaggcgggaggccctggatgccctgcaccaggcccagaagctgcaggccatgctgcaggagctgctggtgtctgcccagaggctgcgggcccagatggacaccagccctgcccccaggagccctgtggaggcccggaggatgctggaggagcaccaggagtgcaaggccgagctggacagctggacagacagcatcagcctggcccggagcacaggccagcagctgctgacagctggccaccccttcagcagtgacatccggcaggtgctggccggcctggagcaggagctgagcagcctggagggcgcctggcaggagcaccagctgcagctgcagcaggccctggagctgcagctgttcctgagctctgtggagaagatggagcgctggctgtgcagcaaggaggacagcctggccagcgagggcctgtgggaccccctggcccccatggagcccctgctgtggaagcacaagatgctggagtgggacctggaggtgcaggccggcaagatcagcgccctggaggccacagcccggggcctgcaccagggcggccaccctgaggcccagagcgccctgggccgctgccaggccatgctgctgaggaaggaggccctcttccggcaggccggcacccggcggcaccggctggaggagctgcggcagctgcaggccttcctgcaggacagccaggaggtggccgcctggctgcgggagaagaacctggtggccctggaggagggcctgctggacacagccatgctgcctgcccagctgcagaagcagcagaacttccaggccgagctggatgcctccatgcaccagcagcaggagctgcagcgggagggccagaggctgctgcagggcggccacccagccagcgaggccatccaggagcggctggaggagctgggcgccctgtggggcgagctgcaggacaacagccagaagaaggtggccaagctgcagaaggcctgtgaggccctgcggctgcggcgctccatggaggagctggagaactggctggagcccatcgaggtggagctgcgggcccccaccgtgggccaggccctgcccggggtgggggagctgctgggcacccagcgggagctggaggccgctgtggacaagaaggcccggcaggccgaggccctgctgggccaggcccaggcctttgtgcgggagggccactgcctggcccaggatgtggaggagcaggcccggcggctgctgcagcgcttcaagagcctgcgggagcccctgcaggagaggagaacagccctggaggcccggagcctgctgctgaagttcttcagagatgctgatgaggagatggcctgggtgcaggagaagctgcccctggccgccgcccaggactatggccagagcctgtctgctgtgcgccacctgcaggagcagcaccagaacctggagagcgagatgagcagccatgaggccctgaccagggtggtgctgggcaccggctacaagctggtgcaggccggccactttgctgcccacgaggtggccgcccgggtgcagcagctggagaaggccatggcccacctgcgggcagaggccgcccggcggcggctgctgctgcagcaggcccaggaggcccagcagttcctgacagagctgctggaggccggctcctggctggccgagcggggccacgtgctggacagcgaggacatgggccacagcgctgaggccacccaggccctgctgcggcggctggaggccaccaagagggacctggaggccttcagccccagaattgagcggctgcagcagacagctgccctgctggagagcaggaagaaccctgagagccccaaggtgctggcccagctgcaggccgtgcgggaggcccacgccgagctgctgcggcgggcagaggcccggggccacggcctgcaggagcagctgcagctgcaccagctggagcgggagaccctgctgctggatgcctggctgaccaccaaggccgccacagctgagagccaggactatggccaggacctggagggcgtgaaggtgctggaggagaagtttgatgccttcaggaaggaggtgcagagcctgggccaggccaaggtgtatgccctgaggaagctggccggcaccctggagcggggggccccccggcgctacccccacatccaggcccagaggagccgcatcgaggccgcctgggagcggctggaccaggccatcaaggccaggacagagaacctggccgccgcccacgaggtgcacagcttccagcaggccgctgctgagctgcagggccgcatgcaggagaagacagccctgatgaagggggaggatggcggccacagcctgagctctgtgaggaccctgcagcagcagcaccggcggctggagcgggagctggaggccatggagaaggaggtggcccggctgcagacagaggcctgccgcctgggccagctgcaccctgctgcccctgggggcctggccaaggtgcaggaggcctgggccaccctgcaggccaaggcccaggagcggggccagtggctggcccaggccgcccagggccacgccttcctgggccgctgccaggagctgctggcctgggcccaggagcggcaggagctggccagcagcgaggagctggccgaggatgtggccggggctgagcagctgctgggccagcacgaggagctgggccaggagatcagagaatgtcggctgcaggcccaggacctgcggcaggagggccagcagctggtggacaacagccacttcatgtctgctgaggtgacagaatgtctgcaggagctggagggccgcctgcaggagctggaggaggcctgggccctgcgctggcagagatgtgccgagagctggggcctgcagaagctgcggcagaggctggagcaggccgaggcctggctggcctgctgggagggcctgctgctgaagccagactatggccacagcgtgtctgatgtggagctgctgctgcaccgccaccaggacctggagaagctgctggccgcccaggaggagaagtttgcccagatgcagaagacagagatggagcaggagctgctgctgcagccccaggagctgaagccaggccgggccggcagcagcctgaccagcttccagtggaggcccagcggccaccagggcctgggcgcccagctggccgagacccgggacccccaggatgccaagggcacccccaccatggagggcagcctggagttcaagcagcacctgctgcccggcggccggcagcccagcagcagctcctgggacagctgccggggcaacctgcagggcagcagcctgagcctcttcctggatgagaggatggctgctgagaaggtggccagcatcgccctgctggacctgaccggggcccgctgtgagcggctgcggggcagacatggcaggaagcacaccttcagcctgcggctgaccagcggggctgagatcctgtttgctgcccccagcgaggagcaggccgagagctggtggagggccctgggcagcacagctgcccagagcctgagccccaagctgaaggccaagcctgtgagcagcctgaatgaatgtaccaccaaggatgcccggcccggctgcctgctgcggagtgacccctag

SEQ ID NO: 171316 - DNA, 942 bp, Artificial Sequence
  Description of Artificial Sequence: Synthetic coding sequence
atgaggcacaaccagatgtgctgtgagaccccacccaccgtgacagtgtatgtgaagagcggcagcaacagaagccaccagcccaagaagcccatcaccctgaagaggcccatctgcaaggacaactggcaggcctttgagaagaacacccacaacaacaacaagagcaagaggcccaagggcccctgcctggtgatccagaggcaggacatgacagccttcttcaagctgtttgatgatgacctgatccaggacttcctgtggatggactgctgctgcaagattgctgacaagtacctgctggccatgacctttgtgtacttcaagagggccaagttcaccatcagcgagcacacccgcatcaacttcttcatcgccctgtacctggccaacacagtggaggaggatgaggaggagaccaagtatgagatcttcccctgggccctgggcaagaactggaggaagctgttccccaacttcctgaagctgcgggaccagctgtgggacagaattgactaccgggccatcgtgtcccggcgctgctgtgaggaggtgatggccatcgcccccacccactacatctggcagcgggagaggtctgtgcaccacagcggggctgtgaggaactacaacagagatgaggtgcagctgccccggggccccagcgccacccctgtggactgcagcctgtgtgggaagaagagaagatatgtgcggctgggcctgagcagcagcagcagcctgagcagccacacagctggggtgacagagaagcacagccaggacagctacaacagcctgtccatggacatcatcggggaccccagccaggcctacacaggcagcgaggtggtgaatgaccaccagagcaacaagggcaagaagaccaacttcctgaagaaggacaagtccatggagtggttcaccggcagcgaggagtag

SEQ ID NO: 171317 - DNA, 942 bp, Artificial Sequence; identical to SEQ ID NO: 171316
  Description of Artificial Sequence: Synthetic coding sequence

SEQ ID NO: 171318 - DNA, 384 bp, Artificial Sequence
  Description of Artificial Sequence: Synthetic coding sequence
atgaggcacaaccagatgtgctgtgagaccccacccaccgtgacagtgtatgtgaagagcggcagcaacagaagccaccagcccaagaagcccatcaccctgaagaggcccatctgcaaggacaactggcaggcctttgagaagaacacccacaacaacaacaagagcaagaggcccaagggcccctgcctggtgatccagaggcaggacatgacagccttcttcaagctgtttgatgatgacctgatccaggacttcctgtggatggactgctgctgcaagattgctgacaagtacctgctggccatgacctttgtgtacttcaagagggccaagttcaccatcagcgagcacacccgcatcaacttcttcatcgccctgtag

SEQ ID NO: 171319 - DNA, 882 bp, Artificial Sequence
  Description of Artificial Sequence: Synthetic coding sequence
atgctgtgggccatccctgagctgggcagcccctgccccatcagcatctcctatgagatgtctgacagccaggaccccaccaccagccctgtggtgaccacccaggtggagctgggcggctgcagccggcagggcggcggcaatggcttcctgcgcttccggcagcaccaggaggtgcaggccttcctgagcctgctggaggacagctttgtgcaggagttcctgagcaaggacccctgcttccagatcagtgacaagtacctgctggccatggtgctggtgtacttccagagggcccacctgaagctgtctgagtacacccacagcagcctcttcctggccctgtacctggccaatgacatggaggaggacctggagggccccaagtgtgagatcttcccctgggccctgggcaaggactggtgcctgcgggtgggcaagttcctgcaccagagggacaagctgtgggccaggatgggcttccgggctgtggtgtcccggcagtgctgtgaggaggtgatggccaaggagcccttccactgggcctggacccgggacagaagaccccaccacggcggcgtgcagagggtgtgcccccaggtgcctgtgcggctgccccggggccctggcctgagccccccccactgcagcccctgtggcctgccccagcactgcagcagccacctgctgaagcctgtgagcagcaagtgccccagcctgaccagcgagtgccacaggcctcccagccagaactacctgagccgggtgaagaatgcctggggcggggacttcctgattgtgctgcccccccagatgcagctggagcccggcacctacagcctgcgcatcttccccaagcccccagcccggcccggccactag

SEQ ID NO: 171320 - DNA, 1122 bp, Artificial Sequence
  Description of Artificial Sequence: Synthetic coding sequence
atgaatgtggacaagttcctgattgtgtgctacctgaagaaggaggtgtggggctttgagagctacagcctgagcggcaccacctgcttccagtggaactactttgtgtggagcctgcgcttcttcttcagctgtggcagcagcaagtaccacctgacccccctgcccatcaagaaggtggactacccccacaagaggggccagaactggggcagctatgtgcacaacagcctgccccgcttcaactgggactaccgcagctgcttccacacctggaagagggccagtgacaaccgggagcgggcctatgagcacagcgcctacggccaccacgagcggggcactggaggctttgacaggaccaggcactatgaccaggactactacagagacccccgggagaggaccctgcagcacggcctgtactatgccagccgcagccgcagccccaacagatttgatgcccatgaccccaggtatgagccccgggcccgggagcagttcaccctgcccagcgtggtgcaccgggacatctacagagatgacatcacccgggaggtgcggggccggcggcctgagaggaactaccagcacagccgcagccgcagcccccacagcagccagagcaggaaccagagcccccagaggctggccagccaggccagccggcccaccaggagccccagcggcagcggcagccgcagccgcagcagcagcagtgacagcatcagcagcagcagcagcaccagcagtgacagcagtgacagcagcagcagcagcagtgatgacagccctgcccggtctgtgcagagcgctgctgtgcctgcccccaccagccagctgctgagcagcctggagaaggatgagcccaggaagagctttggcatcaaggtgcagaacctgcctgtgcgcagcacagacaccagcctgaaggatggcctcttccacgagttcaagaagtttgggaaggtgacctctgtgcagatccacggcaccagcgaggagagatatggcctggtgttcttccggcagcaggaggaccaggagaaggccctgacagccagcaagggcaagctgttcttcggcatgcagatcgaggtgacagcctggattggcccctag

SEQ ID NO: 171321 - DNA, 10995 bp, Artificial Sequence
  Description of Artificial Sequence: Synthetic coding sequence
atggtgcgggagaccaggcacctgtgggtgggcaacctgcctgaaaatgtgcgggaggagaagatcatcgagcacttcaagagatatggccgggtggagagcgtgaagatcctgcccaagaggggcagcgagggcggcgtggccgcctttgtggactttgtggacatcaagagcgcccagaaggcccacaacagcgtgaacaagatgggagaccgggacctgaggacagactacaatgaacctggcaccatccccagcgctgcccggggcctggatgacacagtgtccatcgccagccgcagccgggaggtgtctggcttccggggcggcggcggcggccctgcctacggccccccacccagcctgcacgcccgggagggccgctatgaaagaaggctggatggagccagtgacaaccgggagcgggcctatgagcacagcgcctacggccaccacgagcggggcaccggcggctttgacaggaccaggcactatgaccaggactactacagagacccccgggagaggaccctgcagcacggcctgtactatgccagccgcagccgcagccccaacagatttgatgcccatgaccccaggtatgagccccgggcccgggagcagttcaccctgcccagcgtggtgcaccgggacatctacagagatgacatcacccgggaggtgcggggcagaagacctgagaggaactaccagcacagccgcagccgcagcccccacagcagccagagcaggaaccagagcccccagaggctggccagccaggccagccggcccaccaggagccccagcggcagcggcagccgcagccgcagcagcagcagtgacagcatcagcagcagcagcagcaccagcagtgacagcagtgacagcagcagcagcagcagtgatgacagccctgcccggtctgtgcagagcgctgctgtgcctgcccccaccagccagctgctgagcagcctggagaaggatgagcccaggaagagctttggcatcaaggtgcagaacctgcctgtgcgcagcacagacaccagcctgaaggatggcctcttccacgagttcaagaagtttgggaaggtgacctctgtgcagatccacggcaccagcgaggagagatatggcctggtgttcttccggcagcaggaggaccaggagaaggccctgacagccagcaagggcaagctgttcttcggcatgcagatcgaggtgacagcctggattggccctgagacagaaagtgaaaatgagttccggcccctggatgaaagaattgatgagttccaccccaaggccaccaggaccctcttcatcggcaacctggagaagaccaccacctaccatgacctgaggaacatcttccagagatttggagagatcgtggacatcgacatcaagaaggtgaatggagtgccccagtatgccttcctgcagtactgtgacatcgcctctgtgtgcaaggccatcaagaagatggatggagagtacctgggcaacaaccggctgaagctgggctttgggaagtccatgcccaccaactgtgtgtggctggatggcctgagcagcaatgtgtctgaccagtacctgaccaggcacttctgccgctatggccctgtggtgaaggtggtgtttgaccggctgaagggcatggccctggtgctgtacaatgaaattgaatatgcccaggccgctgtgaaggagaccaagggcaggaagattggaggcaacaagatcaaggtggactttgccaaccgggagagccagctggccttctaccactgcatggagaagagcggccaggacatccgggacttctatgagatgctggccgagcggcgggaggagcggcgggccagctatgactacaaccaggacaggacctactatgaatctgtgaggaccccaggcacctacccagaggacagcagaagagactacccagcccggggccgggagttctacagcgagtgggagacctaccagggcgactactatgagagccgctactatgatgacccccgggagtacagagactacagaaatgacccctatgagcaggacatccgggagtacagctaccggcagcgggagcgggagcgggagcgggagagatttgaaagtgaccgggaccgggaccatgaaagaagacccatcgagaggagccagagccctgtgcacctgcggcggccccagagccctggggccagccccagccaggccgagcggctgcccagcgacagcgagcggcggctgtacagccgcagcagtgacagaagtggcagctgcagcagcctgagccccccaagatatgagaagctggacaagagccggctggagcgctacaccaagaatgagaagacagacaaggagaggacctttgatcctgagcgggtggagcgggagcggcggctcatcaggaaggagaaggtggagaaggacaagacagacaagcagaagaggaagggcaaggtgcacagccccagcagccagagcagcgagacagaccaggagaatgaaagagagcagagccctgagaagcccaggagctgcaacaagctgagccgggagaaggctgacaaggagggcatcgccaagaaccggctggagctgatgccctgtgtggtgctgaccagggtgaaggagaaggagggcaaggtgattgaccacacccctgtggagaagctgaaggccaagctggacaatgacacagtgaagagcagcgccctggaccagaagctgcaggtgtcccagacagagcccgccaagagtgacctgagcaagctggagagcgtgaggatgaaggtgcccaaggagaagggcctgagcagccacgtggaggtggtggagaaggagggccgcctgaaggccaggaagcacctgaagccagagcagcctgcagatggagtgtctgctgtggacctggagaagctggaggccaggaagagaagatttgctgacagcaacctgaaggccgagaagcagaagccagaggtgaagaagagcagccctgagatggaggatgcccgggtgctgagcaagaagcagccagatgtgagcagccgggaggtgatcctgctgcgggagggggaggccgagaggaagcctgtgaggaaggagatcctgaagcgggagagcaagaagatcaagctggaccggctgaacacagtggccagccccaaggactgccaggagctggccagcatctctgtgggcagcggcagccggcccagcagtgacctgcaggcccggctgggggagctggccggggagagcgtggagaaccaggaggtgcagagcaagaagcccatccccagcaagccccagctgaagcagctgcaggtgctggatgaccagggccctgagagagaagatgtgaggaagaactactgcagcctgagagatgagaccccagagaggaagagcggccaggagaagagccacagcgtgaacacagaggagaagattggaattgatattgaccacacccagagctacaggaagcagatggagcagagcaggaggaagcagcagatggagatggagatcgccaagtctgagaagtttggcagccccaagaaggatgtggatgaatatgaaagaagaagcctggtgcatgaggtgggcaagccaccccaggatgtgacagatgacagcccccccagcaagaagaagaggatggaccacgtggactttgacatctgcaccaagcgggagaggaactaccgcagcagccggcagatcagtgaagattctgagaggactggaggcagccccagcgtgcgccacggcagcttccatgaagatgaggaccccatcggcagcccccggctgctgtctgtgaagggcagccccaaggtggatgagaaggtgctgccctacagcaacatcaccgtgcgggaggagagcctgaagttcaacccctatgacagcagccggcgggagcagatggctgacatggccaagatcaagctgtctgtgctgaacagtgaagatgagctgaaccgctgggacagccagatgaagcaggatgctggccgctttgatgtgtccttccccaacagcatcatcaagagggacagcctgaggaagaggtctgtgcgggacctggagcctggagaggtgcccagcgacagtgatgaagatggagagcacaagagccacagcccccgggccagcgccctgtatgagagcagccggctgtccttcctgctgcgggaccgggaggacaagctgcgggagagagatgagcggctgagcagcagcctggagaggaacaagttctacagctttgccctggacaagaccatcaccccagacaccaaggccctgctggagcgggccaagagcctgagcagcagccgggaggagaactggagcttcctggactgggacagcagatttgccaacttcaggaacaacaaggacaaggagaaggtggacagcgccccccggcccatccccagctggtacatgaagaagaagaagatcagaacagacagcgagggcaagatggatgacaagaaggaggaccacaaggaggaggagcaggagcggcaggagctgtttgccagccgcttcctgcacagcagcatctttgagcaggacagcaagaggctgcagcacctggagaggaaggaggaggacagcgacttcatcagcggccgcatctacggcaagcagaccagcgagggcgccaacagcaccacagacagcatccaggagcctgtggtgctcttccacagccgcttcatggagctgaccaggatgcagcagaaggagaaggagaaggaccagaagcccaaggaggtggagaagcaggaggacacagagaaccaccccaagaccccagagagcgcccctgagaacaaggacagcgagctgaagaccccacccagcgtgggccccccatctgtgacagtggtgaccctggagagcgcccccagcgccctggagaagaccaccggggacaagacagtggaggcccccctggtgacagaggagaagacagtggagcccgccaccgtgtctgaggaggccaagccagccagcgagcccgccccagcccctgtggagcagctggagcaggtggacctgcccccaggagctgaccctgacaaggaggccgccatgatgcctgctggggtggaggagggcagcagcggggaccagcccccctacctggatgccaagccacccacccctggggccagcttcagccaggccgagagcaatgtggaccctgagccagacagcacccagcccctgagcaagccagcccagaagtctgaggaggccaatgagcccaaggccgagaagccagatgccacagcagatgctgagccagatgccaaccagaaggccgaggccgcccctgagagccagcccccagccagcgaggacctggaggtggacccccctgtggccgccaaggacaagaagcccaacaagagcaagaggagcaagacccctgtgcaggccgctgctgtgtccatcgtggagaagcctgtgaccaggaagtcagaaagaattgaccgggagaagctgaagaggagcaacagccccagaggagaggcccagaagctgctggagctgaagatggaggccgagaagatcaccaggacagccagcaagaacagcgctgctgacctggagcaccctgagcccagcctgcccctgagcaggaccaggagaagaaatgtgcgctctgtgtatgccaccatgggagaccatgaaaatagaagccctgtgaaggagcctgtggagcagccccgggtgaccaggaagaggctggagcgggagctgcaggaggccgctgctgtgcccaccaccccaagaagaggccggccccccaagacccggcggcgggcagatgaggaggaggagaatgaggccaaggagcctgctgagaccctgaagcccccagagggctggaggagccccaggagccagaagacagctgctgggggcggcccccagggcaagaagggcaagaatgagcccaaggtggatgccaccaggcctgaggccaccacagaggtgggcccccagattggagtgaaggagagctccatggagcccaaggctgctgaggaggaggccggcagcgagcagaagagggacaggaaggatgctggaacagacaagaaccccccagagacagcccctgtggaggtggtggagaagaagccagcccctgagaagaacagcaagagcaagaggggccgcagcaggaacagccggctggccgtggacaagagcgccagcctgaagaatgtggatgctgctgtgagccccagaggagctgctgcccaggccggggagcgggagagcggcgtggtggccgtgtccccagagaagtctgagagcccccagaaggaggatggcctgagcagccagctgaagagtgaccctgtggaccctgacaaggagcctgagaaggaggatgtgtctgccagcggccccagccctgaggccacccagctggccaagcagatggagctggagcaggccgtggagcacatcgccaagctggccgaggccagcgccagcgctgcctacaaggcagatgcccctgagggcctggccccagaagatcgggacaagccagcccaccaggccagcgagacagagctggccgccgccatcggcagcatcatcaatgacatctctggagagcctgagaacttccctgcccccccaccctacccaggagagagccagacagacctgcagcccccagctggggcccaggccctgcagcccagcgaggagggcatggagacagatgaggccgtgtctggcatcctggagacagaagctgccacagagagcagccggccccctgtgaatgccccagaccccagcgctggccccacagacaccaaggaggcccggggcaacagcagcgagaccagccacagcgtgcctgaggccaagggcagcaaggaggtggaggtgaccctggtgaggaaggacaagggccggcagaagaccaccaggagcaggaggaagaggaacaccaacaagaaggtggtggcccctgtggagagccacgtgcctgagagcaaccaggcccagggcgagagccctgctgccaatgaaggcaccaccgtgcagcaccctgaggccccccaggaggagaagcagagcgagaagccccacagcaccccaccccagagctgcaccagtgacctgagcaagatccccagcacagagaacagcagccaggagatctctgtggaggagaggacccccaccaaggcctctgtgcccccagacctgcccccaccaccccagcctgcccctgtggatgaggagccccaggcccgcttccgggtgcacagcatcatcgagagtgaccctgtgaccccacccagcgaccccagcatccccatccccaccctgcccagcgtgacagctgccaagctgagcccccctgtggccagcggcggcatcccccaccagagcccccccaccaaggtgacagagtggatcacccggcaggaggagccccgggcccagagcacccccagccctgccctgcccccagacaccaaggccagtgatgtggacaccagcagcagcaccctgaggaagatcctgatggaccccaagtatgtgtctgccacctctgtgaccagcacctctgtgaccacagccatcgccgagcctgtgtctgctgccccctgcctgcacgaggcccctcctcctcctgtggacagcaagaagcccctggaggagaagacagcccctcctgtgaccaacaacagcgagatccaggccagcgaggtgctggtggccgctgacaaggagaaggtggcccctgtgattgcccccaagatcaccagcgtcatcagcaggatgcctgtgtccattgacctggagaacagccagaagatcaccctggccaagccagccccccagaccctgaccggcctggtgtctgccctgaccggcctggtgaatgtgtccctggtgcctgtgaatgccctgaagggccctgtgaagggctctgtgaccaccctgaagagcctggtgtccaccccagctggccctgtgaatgtgctgaagggccctgtgaatgtgctgactggacctgtgaatgtgctgaccacccctgtgaatgccaccgtgggcaccgtgaatgctgcccctggcaccgtgaatgctgctgccagcgctgtgaatgccacagccagcgctgtgacagtgacagctggagctgtgacagctgccagcggcggcgtgacagccaccactggaacagtgaccatggccggggctgtgattgcccccagcaccaagtgcaagcagagggccagcgccaatgaaaacagccgcttccaccctggctccatgcctgtgattgatgacaggcctgcagatgctggcagcggggccggcctgcgggtgaacaccagcgagggcgtggtgctgctgagctacagcggccagaagacagagggcccccagaggatcagcgccaagatcagccagatccccccagccagcgccatggacatcgagttccagcagagcgtgtccaagagccaggtgaagccagacagcgtgacagccagccagccccccagcaagggcccccaggccccagctggctacgccaacgtggccacccacagcaccctggtgctgacagcccagacctacaatgccagccctgtgatcagctctgtgaaggctgaccggcccagcctggagaagccagagcccatccacctgtctgtgtccacccctgtgacccagggcggcaccgtgaaggtgctgacccagggcatcaacaccccacctgtgctggtgcacaaccagctggtgctgacccccagcatcgtgaccaccaacaagaagctggccgaccctgtgaccctgaagattgagaccaaggtgctgcagcctgccaacctgggcagcaccctgaccccccaccaccccccagccctgcccagcaagctgcccacagaggtgaaccacgtgcccagcggccccagcatcccagctgacagaacagtgagccacctggccgccgccaagctggatgcccacagcccccggcccagcggccctggccccagcagcttcccccgggccagccaccccagcagcacagccagcacagccctgagcaccaatgccaccgtgatgctggccgccggcatccctgtgccccagttcatcagcagcatccaccctgagcagagcgtcatcatgccaccccacagcatcacccagacagtgtccctgagccacctgagccagggcgaggtgaggatgaacacccccaccctgcccagcatcacctacagcatccggcctgaggccctgcacagcccccgggcccccctgcagccccagcagatcgaggtgcgggccccccagagggccagcaccccccagcctgccccagctggggtgcctgccctggccagccagcaccccccagaggaggaggtgcactaccacctgcctgtggcccgggccacagcccctgtgcagagcgaggtgctggtgatgcagagcgagtaccgcctgcacccctacacagtgcccagagatgtgcgcatcatggtgcacccccacgtgacagctgtgtctgagcagcccagggctgctgatggagtggtgaaggtgcccccagccagcaaggccccccagcagcccgggaaggaggccgccaagaccccagatgccaaggccgcccccacccccaccccagcccctgtgcctgtgcctgtgcccctgcctgccccagccccagccccccacggggaggcccgcatcctgactgtgacccccagcaaccagctgcagggcctgcccctgaccccacctgtggtggtgacccatggagtgcagatcgtgcacagcagtggagagctgttccaggagtaccgctacggggacatccgcacctaccaccccccagcccagctgacccacacccagtttcctgctgccagctctgtgggcctgcccagcaggaccaagacagctgcccagggccccccacctgagggggagcccctgcagcccccccagcctgtgcagagcacccagcctgcccagcctgccccaccctgcccccccagccagctgggccagcccggccagccccccagcagcaagatgccccaggtgtcccaggaggccaagggcacccagacaggagtggagcagccccggctgcctgctggccctgccaaccggcccccagagccccacacccaggtgcagagggcccaggccgagaccggccccaccagcttccccagccctgtgtctgtgtccatgaagccagacctgcctgtgtccctgcccacccagacagcccccaagcagcccctgtttgtgcccaccaccagcggccccagcaccccacctggcctggtgctgccccacacagagttccagcctgcccccaagcaggacagcagcccccacctgaccagccagaggcctgtggacatggtgcagctgctgaagaagtaccccatcgtgtggcagggcctgctggccctgaagaatgacacagctgctgtgcagctgcactttgtgtctggcaacaacgtgctggcccacaggagcctgcccctgtctgagggcggcccccccctgagaattgcccagaggatgaggctggaggccacccagctggagggcgtggcccggaggatgacagtggagacagactactgcctgctgctggccctgccctgtggccgggaccaggaggatgtggtgtcccagacagagagcctgaaggccgccttcatcacctacctgcaggccaagcaggccgccggcatcatcaacgtgcccaaccctggcagcaaccagcctgcctacgtgctgcagatcttccccccctgtgagttcagcgagagccacctgagccggctggccccagacctgctggccagcatcagcaacatcagcccccacctgatgattgtgattgcctctgtgtag

SEQ ID NO: 171322 - DNA, 1122 bp, Artificial Sequence; identical to SEQ ID NO: 171320
  Description of Artificial Sequence: Synthetic coding sequence

SEQ ID NO: 171323 - DNA, 894 bp, Artificial Sequence
  Description of Artificial Sequence: Synthetic coding sequence
tgacaggccagccggcccaccaggagccccagcggcagcggcagccgcagccgcagcagcagcagtgacagcatcagcagcagcagcagcaccagcagtgacagcgacagcagcagcagcagcagtgatgacagccctgcccggtctgtgcagagcgctgctgtgcctgcccccaccagccagctgctgagcagcctggagaaggatgagcccaggaagagctttggcatcaaggtgcagaacctgcctgtgcgcagcacagacaccagcctgaaggatggcctcttccacgagttcaagaagtttgggaaggtgacctctgtgcagatccacggcaccagcgaggagagatatggcctggtgttcttccggcagcaggaggaccaggagaaggccctgacagccagcaagggcaagctgttcttcggcatgcagatcgaggtgacagcctggattggccctgagacagaaagtgaaaatgagttccggcccctggatgaaagaattgatgagttccaccccaaggccaccaggaccctcttcatcggcaacctggagaagaccaccacctaccatgacctgaggaacatcttccagagatttggagagatcgtggacatcgacatcaagaaggtgaatggagtgccccagtatgccttcctgcagtactgtgacatcgcctctgtgtgcaaggccatcaagaagatggatggagagtacctgggcaacaaccggctgaagctgggctttgggaagtccatgcccaccaactgtgtgtggctggatggcctgagcagcaatgtgtctgaccagtacctgaccaggcacttctgccgctatggccctgtggtgaaggtggtgtttgaccggctgaagggcatggccctggtgtag

SEQ ID NO: 171324 - DNA, 885 bp, Artificial Sequence
  Description of Artificial Sequence: Synthetic coding sequence
atgagcccccggggcaccggctgcagcgctggcctgctgatgacagtgggctggctgctgctggccggcctgcagagcgcccggggcaccaacgtgacagctgctgtgcaggatgctggcctggcccatgaaggagagggggaggaggagacagagaacaatgacagcgagacagctgagaactatgcccctcctgagacagaagatgtgagcaacagaaatgtggtgaaggaggtggagtttggcatgtgcaccgtgacctgtggcatcggcgtgcgggaggtgatcctgaccaacggctgccctggaggagagagcaaatgtgtggtgcgggtggaggagtgccggggccccacagactgtggctggggcaagcccatcagcgagagcctggagagcgtgcggctggcctgcatccacaccagccccctgaaccgcttcaagtacatgtggaagctgctgcggcaggaccagcagagcatcatcctggtgaatgattctgccatcctggaggtgaggaaggagagccaccccctggcctttgaatgtgacaccctggacaacaatgaaattgtggccaccatcaagttcaccgtgtacaccagcagcgagctgcagatgaggaggagcagcctgcctgccacagatgctgccctgatctttgtgctgaccatcggggtcatcatctgtgtgttcatcatcttcctgctgatcttcatcatcatcaactgggccgctgtgaaggccttctggggcgccaaggccagcaccccagaggtgcagagcgagcagagctctgtgcgctacaaggacagcaccagcctggaccagctgcccacagagatgcctggagaagatgatgccctgtctgagtggaatgaatag

SEQ ID NO: 171325 - DNA, 648 bp, Artificial Sequence
  Description of Artificial Sequence: Synthetic coding sequence
atggtgtctgccctgcggggggcccccctcatccgggtgcacagcagccctgtgagcagccccagcgtgtctggcccccggcggctggtgtcctgcctgagcagccagagcagcgccctgagccagagcggcggcggcagcaccagcgctgctggcatcgaggcccggagccgggccctgcggcggcgctggtgcccagctggcatcatgctgctggccctggtgtgcctgctgagctgcctgctgcccagcagcgaggccaagctgtatggccgctgtgagctggcccgggtgctgcatgactttggcctggatggctaccggggctacagcctggccgactgggtgtgcctggcctacttcaccagcggcttcaatgctgctgccctggactatgaagcagatggcagcaccaacaacggcatcttccagatcaacagccgccgctggtgcagcaacctgaccccaaatgtgcccaacgtgtgcaggatgtactgcagcgacctgctgaaccccaacctgaaggacaccgtcatctgtgccatgaagatcacccaggagccccagggcctgggctactgggaggcctggaggcaccactgccagggcaaggacctgacagagtgggtggatggctgtgacttctag

SEQ ID NO: 171326 - DNA, 627 bp, Artificial Sequence
  Description of Artificial Sequence: Synthetic coding sequence
atgatccaggaggaccacgagggcagccaggatggaggagtgcacagcagccctgtgagcagccccagcgtgtctggcccccggcggctggtgtcctgcctgagcagccagagcagcgccctgagccagagcggcggcggcagcaccagcgctgctggcatcgaggcccggagccgggccctgcggcggcgctggtgcccagctggcatcatgctgctggccctggtgtgcctgctgagctgcctgctgcccagcagcgaggccaagctgtatggccgctgtgagctggcccgggtgctgcatgactttggcctggatggctaccggggctacagcctggccgactgggtgtgcctggcctacttcaccagcggcttcaatgctgctgccctggactatgaagcagatggcagcaccaacaacggcatcttccagatcaacagccgccgctggtgcagcaacctgacccccaacgtgcccaacgtgtgcaggatgtactgcagcgacctgctgaaccccaacctgaaggacaccgtcatctgtgccatgaagatcacccaggagccccagggcctgggctactgggaggcctggaggcaccactgccagggcaaggacctgacctag

SEQ ID NO: 171327 - DNA, 339 bp, Artificial Sequence
  Description of Artificial Sequence: Synthetic coding sequence
atggtgtctgccctgcggggggcccccctcatccgggtgtgcctggcctacttcaccagcggcttcaatgctgctgccctggactatgaagcagatggcagcaccaacaacggcatcttccagatcaacagccgccgctggtgcagcaacctgacccccaacgtgcccaacgtgtgcaggatgtactgcagcgacctgctgaaccccaacctgaaggacaccgtcatctgtgccatgaagatcacccaggagccccagggcctgggctactgggaggcctggaggcaccactgccagggcaaggacctgacagagtgggtggatggctgtgacttctag

SEQ ID NO: 171328 - DNA, 372 bp, Artificial Sequence
  Description of Artificial Sequence: Synthetic coding sequence
atgaccagcggctggacagacaccggggacacagcctggctgacagcctatgccctgccctatgctggggtgtgcctggcctacttcaccagcggcttcaatgctgctgccctggactatgaagcagatggcagcaccaacaacggcatcttccagatcaacagccgccgctggtgcagcaacctgaccccaaatgtgcccaacgtgtgcaggatgtactgcagcgacctgctgaaccccaacctgaaggacaccgtcatctgtgccatgaagatcacccaggagccccagggcctgggctactgggaggcctggaggcaccactgccagggcaaggacctgacagagtgggtggatggctgtgacttctag

SEQ ID NO: 171329 - DNA, 375 bp, Artificial Sequence
  Description of Artificial Sequence: Synthetic coding sequence
atggtgctgtgctggctgctgctgctggtgatggccctgcccccaggcaccaccggggtgaaggactgtgtgttctgtgagctgacagacagcatgcagtgccccggcacctacatgcactgtggagatgatgaggactgcttcaccggccatggagtggcccctggcactggacctgtgatcaacaagggctgcctgcgggccaccagctgtggcctggaggagcctgtgtcctacagaggagtgacctacagcctgaccaccaactgctgcaccggccgcctgtgcaacagagcccccagcagccagacagtgggcgccaccaccagcctggccctgggcctgggcatgctgctgcccccccggctgctgtag

SEQ ID NO: 171330 - DNA, 480 bp, Artificial Sequence
  Description of Artificial Sequence: Synthetic coding sequence
atgaaggcctggggcaccgtggtggtgaccctggccaccctgatggtggtgacagtggatgccaagatctatgaaagatgtgagctggccgcccggctggagcgggccggcctgaatggctacaagggctacggcgtgggggactggctgtgcatggcccactatgaaagtggctttgacacagcctttgtggaccacaacccagatggcagcagtgaatatggcatcttccagctgaacagcgcctggtggtgtgacaatggcatcacccccaccaagaacctgtgccacatggactgccacgacctgctgaacagacacatcctggatgacatccgctgtgccaagcagatcgtgagcagccagaatggcctgagcgcctggacctcctggaggctgcactgcagcggccatgacctgtctgagtggctgaagggctgtgacatgcacgtgaagattgaccccaagatccacccctag

SEQ ID NO: 171331 - DNA, 480 bp, Artificial Sequence; identical to SEQ ID NO: 171330
  Description of Artificial Sequence: Synthetic coding sequence

SEQ ID NO: 171332 - DNA, 3207 bp, Artificial Sequence
  Description of Artificial Sequence: Synthetic coding sequence
atgaggtctgctgccaagccctggaacccagccatccgggccggcggccacggccctgacagagtgcggcccctgcctgctgccagcagcggcatgaagagcagcaagagcagcaccagcctggcctttgagagccggctgagccggctgaagagggccagcagcgaggacaccctgaacaagccaggcagcacagctgccagcggcgtggtgcggctgaagaagacagccacagctggggccatcagcgagctgacagagagccggctgcggagcggcaccggggccttcaccaccaccaagaggacaggcatcccagccccccgggagttctctgtgacagtgtcccgggagaggtctgtgccccggggccccagcaaccccaggaagtctgtgagcagccccaccagcagcaacacccccacccccaccaagcacctgcggacccccagcaccaagcccaagcaggagaatgaaggaggagagaaggccgccctggagagccaggtgcgggagctgctggccgaggccaaggccaaggacagcgagatcaaccggctgcggtctgagctgaagaagtacaaggagaagaggaccctgaatgctgagggcacagatgccctgggccccaacgtggatggcacctctgtgtcccctggggacacagagcccatgatccgggccctggaggagaagaacaagaacttccagaaggagctgagtgacctggaggaggagaacagagtgctgaaggagaagctgatctacctggagcacagccccaacagcgagggcgccgccagccacactggagacagcagctgccccaccagcatcacccaggagagcagctttggcagccccactggaaaccagatgagcagtgacattgatgagtacaagaagaacatccatggaaatgccctgcggaccagcggcagcagcagcagtgatgtgaccaaggccagcctgagcccagatgccagtgactttgagcacatcacagctgagacccccagccggcccctgagcagcaccagcaaccccttcaagagcagcaagtgcagcacagctggcagcagccccaacagcgtgtctgagctgagcctggccagcctgacagagaagatccagaagatggaggagaaccaccacagcacagctgaggagctgcaggccaccctgcaggagctgagtgaccagcagcagatggtgcaggagctgacagcagaaaatgagaagctggtggatgagaagaccatcctggagaccagcttccaccagcaccgggagagagctgagcagctgagccaggagaatgagaagctgatgaacctgctgcaggagcgggtgaagaatgaggagcccaccacccaggagggcaagatcatcgagctggagcagaagtgcaccggcatcctggagcagggccgctttgagcgggagaagctgctgaacatccagcagcagctgacctgcagcctgaggaaggtggaggaggagaaccagggcgccctggagatgatcaagaggctgaaggaggagaatgagaagctgaatgagttcctggagctggagcggcacaacaacaacatgatggccaagaccctggaggagtgccgggtgaccctggagggcctgaagatggagaatggcagcctgaagagccacctgcagggcgagaagcagaaggccacagaggccagcgctgtggagcagacagctgagagctgtgaggtgcaggagatgctgaaggtggcccgggcagagaaggacctgctggagctgagctgcaatgagctgcggcaggagctgctgaaggccaatggagagatcaagcacgtgagcagcctgctggccaaggtggagaaggactacagctacctgaaggagatctgtgaccaccaggccgagcagctgagcaggaccagcctgaagctgcaggagaaggccagcgagagtgatgctgagatcaaggacatgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagcagagctgcccctcctcctgtggatgaggagcctgagagcagcgaggtggatgctgctggccgctggccaggagtgtgtgtgtccaggaccagccccaccccacctgagagcgccaccaccgtgaagagcctcatcaagagctttgacctgggccggcctgggggcgccggccagaacatctctgtgcacaagacccccaggagccccctgagcggcatccctgtgaggacagccccagctgctgctgtgagccccatgcagaggcacagcacctacagctctgtgcggcctgccagccggggcgtgacccagaggctggacctgcctgacctgcccctgagtgacatcctgaagggccgcacagagaccctgaagccagacccccacctgaggaagagccccagcctggagagcctgagcaggcctcccagcctgggctttggagacacccggctgctgagcgccagcacccgggcctggaagccccagagcaagctgtctgtggagaggaaggaccccctggccgccctggcccgggagtatggaggcagcaagagaaatgccctgctgaagtggtgccagaagaagacccagggctacgccaacatcgacatcaccaacttcagcagctcctggagcgatggcctggccttctgtgccctgctgcacacctacctgcctgcccacatcccctaccaggagctgaacagccaggagaagaagaggaacctgctgctggcctttgaagctgctgagagcgtgggcatcaagcccagcctggagctgtctgagatgctgtacacagacagaccagactggcagagcgtgatgcagtatgtggcccagatctacaagtactttgagacctag

SEQ ID NO: 171333 - DNA, 2112 bp, Artificial Sequence
  Description of Artificial Sequence: Synthetic coding sequence
atgggcaaccacagcggccgcccagaagatcctgagcccggggccttcaccaccaccaagaggacaggcatcccagccccccgggagttctctgtgacagtgtcccgggagaggtctgtgccccggggccccagcaaccccaggaagtctgtgagcagccccaccagcagcaacacccccacccccaccaagcacctgcggacccccagcaccaagcccaagcaggagaatgaaggaggagagaaggccgccctggagagccaggtgcgggagctgctggccgaggccaaggccaaggacagcgagatcaaccggctgcggtctgagctgaagaagtacaaggagaagaggaccctgaatgctgagggcacagatgccctgggccccaacgtggatggcacctctgtgtcccctggggacacagagcccatgatccgggccctggaggagaagaacaagaacttccagaaggagctgagtgacctggaggaggagaacagagtgctgaaggagaagctgatctacctggagcacagccccaacagcgagggcgccgccagccacactggagacagcagctgccccaccagcatcacccaggagagcagctttggcagccccaccggcaaccagatgagcagtgacattgatgagtacaagaagaacatccacggcaatgccctgcggaccagcggcagcagcagcagtgatgtgaccaaggccagcctgagcccagatgccagtgactttgagcacatcacagctgagacccccagccggcccctgagcagcaccagcaaccccttcaagagcagcaagtgcagcacagctggcagcagccccaacagcgtgtctgagctgagcctggccagcctgacagagaagatccagaagatggaggagaaccaccacagcacagctgaggagctgcaggccaccctgcaggagctgagtgaccagcagcagatggtgcaggagctgacagcagaaaatgagaagctggtggatgagaagaccatcctggagaccagcttccaccagcaccgggagcgggcagagcagctgagccaggagaatgagaagctgatgaacctgctgcaggagcgggtgaagaatgaggagcccaccacccaggagggcaagatcatcgagctggagcagaagtgcaccggcatcctggagcagggccgctttgagcgggagaagctgctgaacatccagcagcagctgacctgcagcctgaggaaggtggaggaggagaaccagggcgccctggagatgatcaagaggctgaaggaggagaatgagaagctgaatgagttcctggagctggagcggcacaacaacaacatgatggccaagaccctggaggagtgccgggtgaccctggagggcctgaagatggagaatggcagcctgaagagccacctgcagggcgagaagcagaaggccacagaggccagcgctgtggagcagacagctgagagctgtgaggtgcaggagatgctgaaggtggcccgggcagagaaggacctgctggagctgagctgcaatgagctgcggcaggagctgctgaaggccaacggggagatcaagcacgtgagcagcctgctggccaaggtggagaaggactacagctacctgaaggagatctgtgaccaccaggccgagcagctgagcaggaccagcctgaagctgcaggagaaggccagcgagagtgatgctgagatcaaggacatgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagccgggccgccccaccctag

SEQ ID NO: 171334 - DNA, 2130 bp, Artificial Sequence
  Description of Artificial Sequence: Synthetic coding sequence
atgggcaaccacagcggccgcccagaagatcctgagcccggggccttcaccaccaccaagaggacaggcatcccagccccccgggagttctctgtgacagtgtcccgggagaggtctgtgccccggggccccagcaaccccaggaagtctgtgagcagccccaccagcagcaacacccccacccccaccaagcacctgcggacccccagcaccaagcccaagcaggagaatgaaggaggagagaaggccgccctggagagccaggtgcgggagctgctggccgaggccaaggccaaggacagcgagatcaaccggctgcggtctgagctgaagaagtacaaggagaagaggaccctgaatgctgagggcacagatgccctgggccccaacgtggatggcacctctgtgtcccctggggacacagagcccatgatccgggccctggaggagaagaacaagaacttccagaaggagctgagtgacctggaggaggagaacagagtgctgaaggagaagctgatctacctggagcacagccccaacagcgagggcgccgccagccacactggagacagcagctgccccaccagcatcacccaggagagcagctttggcagccccaccggcaaccagatgagcagtgacattgatgagtacaagaagaacatccacggcaatgccctgcggaccagcggcagcagcagcagtgatgtgaccaaggccagcctgagcccagatgccagtgactttgagcacatcacagctgagacccccagccggcccctgagcagcaccagcaaccccttcaagagcagcaagtgcagcacagctggcagcagccccaacagcgtgtctgagctgagcctggccagcctgacagagaagatccagaagatggaggagaaccaccacagcacagctgaggagctgcaggccaccctgcaggagctgagtgaccagcagcagatggtgcaggagctgacagcagaaaatgagaagctggtggatgagaagaccatcctggagaccagcttccaccagcaccgggagcgggcagagcagctgagccaggagaatgagaagctgatgaacctgctgcaggagcgggtgaagaatgaggagcccaccacccaggagggcaagatcatcgagctggagcagaagtgcaccggcatcctggagcagggccgctttgagcgggagaagctgctgaacatccagcagcagctgacctgcagcctgaggaaggtggaggaggagaaccagggcgccctggagatgatcaagaggctgaaggaggagaatgagaagctgaatgagttcctggagctggagcggcacaacaacaacatgatggccaagaccctggaggagtgccgggtgaccctggagggcctgaagatggagaatggcagcctgaagagccacctgcagggcgagaagcagaaggccacagaggccagcgctgtggagcagacagctgagagctgtgaggtgcaggagatgctgaaggtggcccgggcagagaaggacctgctggagctgagctgcaatgagctgcggcaggagctgctgaaggccaacggggagatcaagcacgtgagcagcctgctggccaaggtggagaaggactacagctacctgaaggagatctgtgaccaccaggccgagcagctgagcaggaccagcctgaagctgcaggagaaggccagcgagagtgatgctgagatcaaggacatgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagccgggccgccccacccagcctgggctctgtgtcctag

SEQ ID NO: 171335 - DNA, 2964 bp, Artificial Sequence
  Description of Artificial Sequence: Synthetic coding sequence
atgggcaaccacagcggccgcccagaagatcctgagcccggggccttcaccaccaccaagaggacaggcatcccagccccccgggagttctctgtgacagtgtcccgggagaggtctgtgccccggggccccagcaaccccaggaagtctgtgagcagccccaccagcagcaacacccccacccccaccaagcacctgcggacccccagcaccaagcccaagcaggagaatgaaggaggagagaaggccgccctggagagccaggtgcgggagctgctggccgaggccaaggccaaggacagcgagatcaaccggctgcggtctgagctgaagaagtacaaggagaagaggaccctgaatgctgagggcacagatgccctgggccccaacgtggatggcacctctgtgtcccctggggacacagagcccatgatccgggccctggaggagaagaacaagaacttccagaaggagctgagtgacctggaggaggagaacagagtgctgaaggagaagctgatctacctggagcacagccccaacagcgagggcgccgccagccacactggagacagcagctgccccaccagcatcacccaggagagcagctttggcagccccaccggcaaccagatgagcagtgacattgatgagtacaagaagaacatccacggcaatgccctgcggaccagcggcagcagcagcagtgatgtgaccaaggccagcctgagcccagatgccagtgactttgagcacatcacagctgagacccccagccggcccctgagcagcaccagcaaccccttcaagagcagcaagtgcagcacagctggcagcagccccaacagcgtgtctgagctgagcctggccagcctgacagagaagatccagaagatggaggagaaccaccacagcacagctgaggagctgcaggccaccctgcaggagctgagtgaccagcagcagatggtgcaggagctgacagcagaaaatgagaagctggtggatgagaagaccatcctggagaccagcttccaccagcaccgggagcgggcagagcagctgagccaggagaatgagaagctgatgaacctgctgcaggagcgggtgaagaatgaggagcccaccacccaggagggcaagatcatcgagctggagcagaagtgcaccggcatcctggagcagggccgctttgagcgggagaagctgctgaacatccagcagcagctgacctgcagcctgaggaaggtggaggaggagaaccagggcgccctggagatgatcaagaggctgaaggaggagaatgagaagctgaatgagttcctggagctggagcggcacaacaacaacatgatggccaagaccctggaggagtgccgggtgaccctggagggcctgaagatggagaatggcagcctgaagagccacctgcagggcgagaagcagaaggccacagaggccagcgctgtggagcagacagctgagagctgtgaggtgcaggagatgctgaaggtggcccgggcagagaaggacctgctggagctgagctgcaatgagctgcggcaggagctgctgaaggccaacggggagatcaagcacgtgagcagcctgctggccaaggtggagaaggactacagctacctgaaggagatctgtgaccaccaggccgagcagctgagcaggaccagcctgaagctgcaggagaaggccagcgagagtgatgctgagatcaaggacatgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagccgggccgcccctcctcctgtggatgaggagcctgagagcagcgaggtggatgctgctggccgctggccaggagtgtgtgtgtccaggaccagccccaccccacctgagagcgccaccaccgtgaagagcctcatcaagagctttgacctgggccggcctggaggagctggccagaacatctctgtgcacaagacccccaggagccccctgagcggcatccctgtgaggacagccccagctgctgctgtgagccccatgcagaggcacagcacctacagctctgtgcggcctgccagcagaggagtgacccagaggctggacctgcctgacctgcccctgagtgacatcctgaagggccgcacagagaccctgaagccagacccccacctgaggaagagccccagcctggagagcctgagccggccccccagcctgggctttggagacacccggctgctgagcgccagcacccgggcctggaagccccagagcaagctgtctgtggagaggaaggaccccctggccgccctggcccgggagtatggaggcagcaagagaaatgccctgctgaagtggtgccagaagaagacccagggctacgccaacatcgacatcaccaacttcagcagctcctggagcgatggcctggccttctgtgccctgctgcacacctacctgcctgcccacatcccctaccaggagctgaacagccaggagaagaagaggaacctgctgctggcctttgaggccgctgagagcgtgggcatcaagcccagcctggagctgtctgagatgctgtacacagacagaccagactggcagagcgtgatgcagtatgtggcccagatctacaagtactttgagacctag

SEQ ID NO: 171336 - DNA, 2373 bp, Artificial Sequence
  Description of Artificial Sequence: Synthetic coding sequence
atgaggtctgctgccaagccctggaacccagccatccgggccggcggccacggccctgacagagtgcggcccctgcctgctgccagcagcggcatgaagagcagcaagagcagcaccagcctggcctttgagagccggctgagccggctgaagagggccagcagcgaggacaccctgaacaagccaggcagcacagctgccagcggcgtggtgcggctgaagaagacagccacagctggggccatcagcgagctgacagagagccggctgcggagcggcaccggggccttcaccaccaccaagaggacaggcatcccagccccccgggagttctctgtgacagtgtcccgggagaggtctgtgccccggggccccagcaaccccaggaagtctgtgagcagccccaccagcagcaacacccccacccccaccaagcacctgcggacccccagcaccaagcccaagcaggagaatgaaggaggagagaaggccgccctggagagccaggtgcgggagctgctggccgaggccaaggccaaggacagcgagatcaaccggctgcggtctgagctgaagaagtacaaggagaagaggaccctgaatgctgagggcacagatgccctgggccccaacgtggatggcacctctgtgtcccctggggacacagagcccatgatccgggccctggaggagaagaacaagaacttccagaaggagctgagtgacctggaggaggagaacagagtgctgaaggagaagctgatctacctggagcacagccccaacagcgagggcgccgccagccacactggagacagcagctgccccaccagcatcacccaggagagcagctttggcagccccactggaaaccagatgagcagtgacattgatgagtacaagaagaacatccatggaaatgccctgcggaccagcggcagcagcagcagtgatgtgaccaaggccagcctgagcccagatgccagtgactttgagcacatcacagctgagacccccagccggcccctgagcagcaccagcaaccccttcaagagcagcaagtgcagcacagctggcagcagccccaacagcgtgtctgagctgagcctggccagcctgacagagaagatccagaagatggaggagaaccaccacagcacagctgaggagctgcaggccaccctgcaggagctgagtgaccagcagcagatggtgcaggagctgacagcagaaaatgagaagctggtggatgagaagaccatcctggagaccagcttccaccagcaccgggagagagctgagcagctgagccaggagaatgagaagctgatgaacctgctgcaggagcgggtgaagaatgaggagcccaccacccaggagggcaagatcatcgagctggagcagaagtgcaccggcatcctggagcagggccgctttgagcgggagaagctgctgaacatccagcagcagctgacctgcagcctgaggaaggtggaggaggagaaccagggcgccctggagatgatcaagaggctgaaggaggagaatgagaagctgaatgagttcctggagctggagcggcacaacaacaacatgatggccaagaccctggaggagtgccgggtgaccctggagggcctgaagatggagaatggcagcctgaagagccacctgcagggcgagaagcagaaggccacagaggccagcgctgtggagcagacagctgagagctgtgaggtgcaggagatgctgaaggtggcccgggcagagaaggacctgctggagctgagctgcaatgagctgcggcaggagctgctgaaggccaatggagagatcaagcacgtgagcagcctgctggccaaggtggagaaggactacagctacctgaaggagatctgtgaccaccaggccgagcagctgagcaggaccagcctgaagctgcaggagaaggccagcgagagtgatgctgagatcaaggacatgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagcagagctgccccacccagcctgggctctgtgtcctag

SEQ ID NO: 171337 - DNA, 3090 bp, Artificial Sequence
  Description of Artificial Sequence: Synthetic coding sequence
atgaggtctgctgccaagccctggaacccagccatccgggccggcggccacggccctgacagagtgcggcccctgcctgctgccagcagcggcatgaagagcagcaagagcagcaccagcctggcctttgagagccggctgagccggctgaagagggccagcagcgaggacaccctgaacaagccaggcagcacagctgccagcggcgtggtgcggctgaagaagacagccacagctggggccatcagcgagctgacagagagccggctgcggagcggcaccggggccttcaccaccaccaagaggacaggcatcccagccccccgggagttctctgtgacagtgtcccgggagaggtctgtgccccggggccccagcaaccccaggaagtctgtgagcagccccaccagcagcaacacccccacccccaccaagcacctgcggacccccagcaccaagcccaagcaggagaatgaaggaggagagaaggccgccctggagagccaggtgcgggagctgctggccgaggccaaggccaaggacagcgagatcaaccggctgcggtctgagctgaagaagtacaaggagaagaggaccctgaatgctgagggcacagatgccctgggccccaacgtggatggcacctctgtgtcccctggggacacagagcccatgatccgggccctggaggagaagaacaagaacttccagaaggagctgagtgacctggaggaggagaacagagtgctgaaggagaagctgatctacctggagcacagccccaacagcgagggcgccgccagccacactggagacagcagctgccccaccagcatcacccaggagagcagctttggcagccccactggaaaccagatgagcagtgacattgatgagtacaagaagaacatccatggaaatgccctgcggaccagcggcagcagcagcagtgatgtgaccaaggccagcctgagcccagatgccagtgactttgagcacatcacagctgagacccccagccggcccctgagcagcaccagcaaccccttcaagagcagcaagtgcagcacagctggcagcagccccaacagcgtgtctgagctgagcctggccagcctgacagagaagatccagaagatggaggagaaccaccacagcacagctgaggagctgcaggccaccctgcaggagctgagtgaccagcagcagatggtgcaggagctgacagcagaaaatgagaagctggtggatgagaagaccatcctggagaccagcttccaccagcaccgggagagagctgagcagctgagccaggagaatgagaagctgatgaacctgctgcaggagcgggtgaagaatgaggagcccaccacccaggagggcaagatcatcgagctggagcagaagtgcaccggcatcctggagcagggccgctttgagcgggagaagctgctgaacatccagcagcagctgacctgcagcctgaggaaggtggaggaggagaaccagggcgccctggagatgatcaagaggctgaaggaggagaatgagaagctgaatgagttcctggagctggagcggcacaacaacaacatgatggccaagaccctggaggagtgccgggtgaccctggagggcctgaagatggagaatggcagcctgaagagccacctgcagggcgagaagcagaaggccacagaggccagcgctgtggagcagacagctgagagctgtgaggtgcaggagatgctgaaggtggcccgggcagagaaggacctgctggagctgagctgcaatgagctgcggcaggagctgctgaaggccaatggagagatcaagcacgtgagcagcctgctggccaaggtggagaaggactacagctacctgaaggagatctgtgaccaccaggccgagcagctgagcaggaccagcctgaagctgcaggagaaggccagcgagagtgatgctgagatcaaggacatgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagcagagctgcccctcctcctgtggatgaggagcctgagagcagcgaggtggatgctgctggccgctggccaggagtgtgtgtgtccaggaccagccccaccccacctgagagcgccaccaccgtgaagagcctcatcaagagctttgacctgggccggcctgggggcgccggccagaacatctctgtgcacaagacccccaggagccccctgagcggcatccctgtgaggacagccccagctgctgctgtgagccccatgcagaggcacagcacctacagctctgtgcggcctgccagccggggcgtgacccagaggctggacctgcctgacctgcccctgagtgacatcctgaagggccgcacagagaccctgaagccagacccccacctgaggaagagccccagcctggagagcctgagcaggcctcccagcctgggctttggagacacccggctgctgagcgccagcacccgggcctggaagccccagagcaagctgtctgtggagaggaaggaccccctggccgccctggcccgggagtatggaggcagcaagagaaatgccctgctgaagtggtgccagaagaagacccagggctacgccaagaggaacctgctgctggcctttgaggccgctgagagcgtgggcatcaagcccagcctggagctgtctgagatgctgtacacagacagaccagactggcagagcgtgatgcagtatgtggcccagatctacaagtactttgagacctag

SEQ ID NO: 171338 - DNA, 237 bp, Artificial Sequence
  Description of Artificial Sequence: Synthetic coding sequence
atgaggtctgctgccaagccctggaacccagccatccgggccggcggccacggccctgacagagtgcggcccctgcctgctgccagcagcggcatgaagagcagcaagagcagcaccagcctggcctttgagagccggctgagccggctgaagagggccagcagcgaggacaccctgaacaagccaggcagcacagctgccagcggcgtggtgcggctgaagaagacagccacctag

SEQ ID NO: 171339 - DNA, 1227 bp, Artificial Sequence
  Description of Artificial Sequence: Synthetic coding sequence
atgaaggagaccatctttgagctggaggaccaggtggagcagcacagagctgtgaagctgcacaacaaccagctgatcagcgagctggagagcagcgtcatcaagctggaggagcagaagagtgacctggagcggcagctgaagaccctgaccaagcagatgaaggaggagacagaggagtggaggcgcttccaggccgacctgcagacagctgtggtggtggccaatgacatcaagtgtgaggcccagcaggagctgaggacagtgaagaggaagctgctggaggaggaggagaagaatgcccggctgcagaaggagctgggagatgtgcagggccacggccgggtggtgaccagcagagctgcccctcctcctgtggatgaggagcctgagagcagcgaggtggatgctgctggccgctggccaggagtgtgtgtgtccaggaccagccccaccccacctgagagcgccaccaccgtgaagagcctcatcaagagctttgacctgggccggcctgggggcgccggccagaacatctctgtgcacaagacccccaggagccccctgagcggcatccctgtgaggacagccccagctgctgctgtgagccccatgcagaggcacagcacctacagctctgtgcggcctgccagccggggcgtgacccagaggctggacctgcctgacctgcccctgagtgacatcctgaagggccgcacagagaccctgaagccagacccccacctgaggaagagccccagcctggagagcctgagcaggcctcccagcctgggctttggagacacccggctgctgagcgccagcacccgggcctggaagccccagagcaagctgtctgtggagaggaaggaccccctggccgccctggcccgggagtatggaggcagcaagagaaatgccctgctgaagtggtgccagaagaagacccagggctacgccaacatcgacatcaccaacttcagcagctcctggagcgatggcctggccttctgtgccctgctgcacacctacctgcctgcccacatcccctaccaggagctgaacagccaggagaagaagaggaacctgctgctggcctttgaagctgctgagagcgtgggcatcaagcccagcctggagctgtctgagatgctgtacacagacagaccagactggcagagcgtgatgcagtatgtggcccagatctacaagtactttgagacctag

SEQ ID NO: 171340 - DNA, 3354 bp, Artificial Sequence
  Description of Artificial Sequence: Synthetic coding sequence
atgaagaaggccagccgctctgtgggctctgtgcccaaggtgtctgccatcagcaagacccagacagctgagaagatcaagccagagaacagcagcagcgccagcactggaggcaagctggtgaagccaggcacagctgccagcctgagcaagaccaagagcagtgatgacctgctggccggcatggccggcggcgtgacagtgaccaacggggtgaagggcaagaagagcacctgccccagcgctgcccccagcgccagcgccccagccatgaccaccgtggagaacaagagcaagatcagcactggaacagccagcagcaccaagaggagcaccagcacaggcaacaaggagagcagcagcacccgggagcggctgcgggagaggacccggctgaaccagagcaagaagctgcccagcgctggccagggcgccaatgacatggccctggccaagaggagccgcagcaggacagccacagaatgtgatgtgaggatgagcaagagcaagagtgacaaccagatcagtgacagagctgccctggaggccaaggtgaaggacctgctgaccctggccaagaccaaggatgtggagatcctgcacctgagaaatgagctgcgggacatgagggcccagctgggcatcaatgaagaccacagtgaaggagatgagaagtctgagaaggagaccatcatggcccaccagcccacagatgtggagagcaccctgctgcagctgcaggagcagaacacagccatccgggaggagctgaaccagctgaagaatgaaaataggatgctgaaggaccggctgaatgccctgggcttcagcctggagcagaggctggacaacagcgagaagctgtttggctaccagagcctgagccctgagatcaccccagacaaccagagtgatggcggcggcaccctgaccagctctgtggagggcagcgcccctggctctgtggaggacctgctgagccaggatgagaacaccctgatggaccaccagcacagcaacagcatggacaacctggacagcgagtgcagcgaggtgtaccagcccctgaccagcagtgatgatgccctggatgcccccagcagcagcgagagcgagggcatccccagcattgaaagaagcaggaagggcagcagtggaaatgccagcgaggtgtctgtggcctgcctgacagagcgcatccaccagatggaggagaaccagcacagcaccagcgaggagctgcaggccaccctgcaggagctggccgacctgcagcagatcacccaggagctgaacagtgaaaatgaaaggctgggggaggagaaggtgatcctgatggagagcctgtgccagcagagcgacaagctggagcacttcagccggcagatcgagtacttccgcagcctgctggatgagcaccacatctcctatgtgattgatgaagatgtgaagagcggccgctacatggagctggagcagcgctacatggacctggccgagaatgccaggtttgagcgggagcagctgctgggcgtgcagcagcacctgagcaacaccctgaagatggccgagcaggacaacaaggaggcccaggagatgattggagccctgaaggagaggagccaccacatggagcgcatcatcgagagcgagcagaagggcaaggccgccctggccgccaccctggaggagtacaaggccaccgtggccagtgaccagatcgagatgaaccggctgaaggcccagctggagaatgagaagcagaaggtggccgagctgtacagcatccacaacagcggggacaagagtgacatccaggacctgctggagagcgtgcggctggacaaggagaaggccgagaccctggccagcagcctgcaggaggacctggcccacaccagaaatgatgccaaccggctgcaggatgccatcgccaaggtggaggatgagtaccgggccttccaggaggaggccaagaagcagatcgaggacctgaacatgaccctggagaagctgcggagtgacctggatgagaaggagacagagaggagtgacatgaaggagaccatctttgagctggaggatgaggtggagcagcacagagctgtgaagctgcatgacaacctgatcatcagtgacctggagaacacagtgaagaagctgcaggaccagaagcatgacatggagcgggagatcaagaccctgcaccggcggctgcgggaggagagcgctgagtggaggcagttccaggccgacctgcagacagctgtggtgattgccaatgacatcaagtctgaggcccaggaggagattggagacctgaagaggcggctgcacgaggcccaggagaagaatgagaagctgaccaaggagctggaggagatcaagagcaggaagcaggaggaggagcggggccgggtgtacaactacatgaatgctgtggagcgggacctggccgccctgcggcagggcatgggcctgagcagaagaagcagcaccagcagcgagcccacccccaccgtgaagaccctcatcaagagctttgacagcgccagccaggtgcccaacccagctgctgctgccatccccaggacccccctgagccccagccccatgaagaccccacctgctgctgctgtgagccccatgcagaggcacagcatcagcggccccatcagcaccagcaagcccctgacagccctgagtgacaagaggcccaactacggggagatccctgtgcaggagcacctgctgcggaccagcagcgccagcaggcctgccagcctgccccgggtgcctgccatggagagcgccaagaccctgtctgtgtccagaagaagcagcgaggaggtgaagagggacatcagcgcccaggagggcgccagccctgccagcctgatggccatgggcaccaccagcccccagctgagcctgagcagcagccccacagcctctgtgacccccaccaccaggagccgcatccgggaggagaggaaggaccccctgagcgccctggcccgggagtatggaggcagcaagagaaatgccctgctgaagtggtgccagaagaagacagagggctaccagaacatcgacatcaccaacttcagcagctcctggaatgatggcctggccttctgtgccctgctgcacacctacctgcctgcccacatcccctaccaggagctgaacagccaggacaagagaagaaacttcatgctggccttccaggccgctgagagcgtgggcatcaagagcaccctggacatcaatgagatggtgaggacagagaggccagactggcagaatgtgatgctgtatgtgacagccatctacaagtactttgagacctag

SEQ ID NO: 171341 - DNA, 2820 bp, Artificial Sequence
  Description of Artificial Sequence: Synthetic coding sequence
gtgcctgaggccgtgcgctggggctacttcatccctgagcagagccagtttgcctgcaagtgcatcaccaagaggcagcccaggatgaagaaggccagccgctctgtgggctctgtgcccaaggtgtctgccatcagcaagacccagacagctgagaagatcaagccagagaacagcagcagcgccagcactggaggcaagctggtgaagccaggcacagctgccagcctgagcaagaccaagagcagtgatgacctgctggccggcatggccggcggcgtgacagtgaccaacggggtgaagggcaagaagagcacctgccccagcgctgcccccagcgccagcgccccagccatgaccaccgtggagaacaagagcaagatcagcactggaacagccagcagcaccaagaggagcaccagcacaggcaacaaggagagcagcagcacccgggagcggctgcgggagaggacccggctgaaccagagcaagaagctgcccagcgctggccagggcgccaatgacatggccctggccaagaggagccgcagcaggacagccacagaatgtgatgtgaggatgagcaagagcaagagtgacaaccagatcagtgacagagctgccctggaggccaaggtgaaggacctgctgaccctggccaagaccaaggatgtggagatcctgcacctgagaaatgagctgcgggacatgagggcccagctgggcatcaatgaagaccacagtgaaggagatgagaagtctgagaaggagaccatcatggcccaccagcccacagatgtggagagcaccctgctgcagctgcaggagcagaacacagccatccgggaggagctgaaccagctgaagaatgaaaataggatgctgaaggaccggctgaatgccctgggcttcagcctggagcagaggctggacaacagcgagaagctgtttggctaccagagcctgagccctgagatcaccccagacaaccagagtgatggcggcggcaccctgaccagctctgtggagggcagcgcccctggctctgtggaggacctgctgagccaggatgagaacaccctgatggaccaccagcacagcaacagcatggacaacctggacagcgagtgcagcgaggtgtaccagcccctgaccagcagtgatgatgccctggatgcccccagcagcagcgagagcgagggcatccccagcattgaaagaagcaggaagggcagcagtggaaatgccagcgaggtgtctgtggcctgcctgacagagcgcatccaccagatggaggagaaccagcacagcaccagcgaggagctgcaggccaccctgcaggagctggccgacctgcagcagatcacccaggagctgaacagtgaaaatgaaaggctgggggaggagaaggtgatcctgatggagagcctgtgccagcagagcgacaagctggagcacttcagccggcagatcgagtacttccgcagcctgctggatgagcaccacatctcctatgtgattgatgaagatgtgaagagcggccgctacatggagctggagcagcgctacatggacctggccgagaatgccaggtttgagcgggagcagctgctgggcgtgcagcagcacctgagcaacaccctgaagatggccgagcaggacaacaaggaggcccaggagatgattggagccctgaaggagaggagccaccacatggagcgcatcatcgagagcgagcagaagggcaaggccgccctggccgccaccctggaggagtacaaggccaccgtggccagtgaccagatcgagatgaaccggctgaaggcccagctggagaatgagaagcagaaggtggccgagctgtacagcatccacaacagcggggacaagagtgacatccaggacctgctggagagcgtgcggctggacaaggagaaggccgagaccctggccagcagcctgcaggaggacctggcccacaccagaaatgatgccaaccggctgcaggatgccatcgccaaggtggaggatgagtaccgggccttccaggaggaggccaagaagcagatcgaggacctgaacatgaccctggagaagctgcggagtgacctggatgagaaggagacagagaggagtgacatgaaggagaccatctttgagctggaggatgaggtggagcagcacagagctgtgaagctgcatgacaacctgatcatcagtgacctggagaacacagtgaagaagctgcaggaccagaagcatgacatggagcgggagatcaagaccctgcaccggcggctgcgggaggagagcgctgagtggaggcagttccaggccgacctgcagacagctgtggtgattgccaatgacatcaagtctgaggcccaggaggagattggagacctgaagaggcggctgcacgaggcccaggagaagaatgagaagctgaccaaggagctggaggagatcaagagcaggaagcaggaggaggagcggggccgggtgtacaactacatgaatgctgtggagcgggacctggccgccctgcggcagggcatgggcctgagcagaagaagcagcaccagcagcgagcccacccccaccgtgaagaccctcatcaagagctttgacagcgccagccaggtgcccaacccagctgctgctgccatccccaggacccccctgagccccagccccatgaagaccccacctgctgctgctgtgagccccatgcagatggagagcagctctgtggcccatgctggcatgcagtggagggacctgggcagcctgcagcccctgcccccaggcttcaagtag

SEQ ID NO: 171342 - DNA, 2370 bp, Artificial Sequence
  Description of Artificial Sequence: Synthetic coding sequence
atgaagaaggccagccgctctgtgggctctgtgcccaaggtgtctgccatcagcaagacccagacagctgagaagatcaagccagagaacagcagcagcgccagcactggaggcaagctggtgaagccaggcacagctgccagcctgagcaagaccaagagcagtgatgacctgctggccggcatggccggcggcgtgacagtgaccaacggggtgaagggcaagaagagcacctgccccagcgctgcccccagcgccagcgccccagccatgaccaccgtggagaacaagagcaagatcagcactggaacagccagcagcaccaagaggagcaccagcacaggcaacaaggagagcagcagcacccgggagcggctgcgggagaggacccggctgaaccagagcaagaagctgcccagcgctggccagggcgccaatgacatggccctggccaagaggagccgcagcaggacagccacagaatgtgatgtgaggatgagcaagagcaagagtgacaaccagatcagtgacagagctgccctggaggccaaggtgaaggacctgctgaccctggccaagaccaaggatgtggagatcctgcacctgagaaatgagctgcgggacatgagggcccagctgggcatcaatgaagaccacagtgaaggagatgagaagtctgagaaggagaccatcatggcccaccagcccacagatgtggagagcaccctgctgcagctgcaggagcagaacacagccatccgggaggagctgaaccagctgaagaatgaaaataggatgctgaaggaccggctgaatgccctgggcttcagcctggagcagaggctggacaacagcgagaagctgtttggctaccagagcctgagccctgagatcaccccagacaaccagagtgatggcggcggcaccctgaccagctctgtggagggcagcgcccctggctctgtggaggacctgctgagccaggatgagaacaccctgatggaccaccagcacagcaacagcatggacaacctggacagcgagtgcagcgaggtgtaccagcccctgaccagcagtgatgatgccctggatgcccccagcagcagcgagagcgagggcatccccagcattgaaagaagcaggaagggcagcagtggaaatgccagcgaggtgtctgtggcctgcctgacagagcgcatccaccagatggaggagaaccagcacagcaccagcgaggagctgcaggccaccctgcaggagctggccgacctgcagcagatcacccaggagctgaacagtgaaaatgaaaggctgggggaggagaaggtgatcctgatggagagcctgtgccagcagagcgacaagctggagcacttcagccggcagatcgagtacttccgcagcctgctggatgagcaccacatctcctatgtgattgatgaagatgtgaagagcggccgctacatggagctggagcagcgctacatggacctggccgagaatgccaggtttgagcgggagcagctgctgggcgtgcagcagcacctgagcaacaccctgaagatggccgagcaggacaacaaggaggcccaggagatgattggagccctgaaggagaggagccaccacatggagcgcatcatcgagagcgagcagaagggcaaggccgccctggccgccaccctggaggagtacaaggccaccgtggccagtgaccagatcgagatgaaccggctgaaggcccagctggagaatgagaagcagaaggtggccgagctgtacagcatccacaacagcggggacaagagtgacatccaggacctgctggagagcgtgcggctggacaaggagaaggccgagaccctggccagcagcctgcaggaggacctggcccacaccagaaatgatgccaaccggctgcaggatgccatcgccaaggtggaggatgagtaccgggccttccaggaggaggccaagaagcagatcgaggacctgaacatgaccctggagaagctgcggagtgacctggatgagaaggagacagagaggagtgacatgaaggagaccatctttgagctggaggatgaggtggagcagcacagagctgtgaagctgcatgacaacctgatcatcagtgacctggagaacacagtgaagaagctgcaggaccagaagcatgacatggagcgggagatcaagaccctgcaccggcggctgcgggaggagagcgctgagtggaggcagttccaggccgacctgcagacagctgtggtgattgccaatgacatcaagtctgaggcccaggaggagattggagacctgaagaggcggctgcacgaggcccaggagaagaatgagaagctgacctag

SEQ ID NO: 171343 - DNA, 3354 bp, Artificial Sequence; identical to SEQ ID NO: 171340
  Description of Artificial Sequence: Synthetic coding sequence

SEQ ID NO: 171344 - DNA, 3237 bp, Artificial Sequence
  Description of Artificial Sequence: Synthetic coding sequence
atgaagaaggccagccgctctgtgggctctgtgcccaaggtgtctgccatcagcaagacccagacagctgagaagatcaagccagagaacagcagcagcgccagcactggaggcaagctggtgaagccaggcacagctgccagcctgagcaagaccaagagcagtgatgacctgctggccggcatggccggcggcgtgacagtgaccaacggggtgaagggcaagaagagcacctgccccagcgctgcccccagcgccagcgccccagccatgaccaccgtggagaacaagagcaagatcagcactggaacagccagcagcaccaagaggagcaccagcacaggcaacaaggagagcagcagcacccgggagcggctgcgggagaggacccggctgaaccagagcaagaagctgcccagcgctggccagggcgccaatgacatggccctggccaagaggagccgcagcaggacagccacagaatgtgatgtgaggatgagcaagagcaagagtgacaaccagatcagtgacagagctgccctggaggccaaggtgaaggacctgctgaccctggccaagaccaaggatgtggagatcctgcacctgagaaatgagctgcgggacatgagggcccagctgggcatcaatgaagaccacagtgaaggagatgagaagtctgagaaggagaccatcatggcccaccagcccacagatgtggagagcaccctgctgcagctgcaggagcagaacacagccatccgggaggagctgaaccagctgaagaatgaaaataggatgctgaaggaccggctgaatgccctgggcttcagcctggagcagaggctggacaacagcgagaagctgtttggctaccagagcctgagccctgagatcaccccagacaaccagagtgatggcggcggcaccctgaccagctctgtggagggcagcgcccctggctctgtggaggacctgctgagccaggatgagaacaccctgatggaccaccagcacagcaacagcatggacaacctggacagcgagtgcagcgaggtgtaccagcccctgaccagcagtgatgatgccctggatgcccccagcagcagcgagagcgagggcatccccagcattgaaagaagcaggaagggcagcagtggaaatgccagcgaggtgtctgtggcctgcctgacagagcgcatccaccagatggaggagaaccagcacagcaccagcgaggagctgcaggccaccctgcaggagctggccgacctgcagcagatcacccaggagctgaacagtgaaaatgaaaggctgggggaggagaaggtgatcctgatggagagcctgtgccagcagagcgacaagctggagcacttcagccggcagatcgagtacttccgcagcctgctggatgagcaccacatctcctatgtgattgatgaagatgtgaagagcggccgctacatggagctggagcagcgctacatggacctggccgagaatgccaggtttgagcgggagcagctgctgggcgtgcagcagcacctgagcaacaccctgaagatggccgagcaggacaacaaggaggcccaggagatgattggagccctgaaggagaggagccaccacatggagcgcatcatcgagagcgagcagaagggcaaggccgccctggccgccaccctggaggagtacaaggccaccgtggccagtgaccagatcgagatgaaccggctgaaggcccagctggagaatgagaagcagaaggtggccgagctgtacagcatccacaacagcggggacaagagtgacatccaggacctgctggagagcgtgcggctggacaaggagaaggccgagaccctggccagcagcctgcaggaggacctggcccacaccagaaatgatgccaaccggctgcaggatgccatcgccaaggtggaggatgagtaccgggccttccaggaggaggccaagaagcagatcgaggacctgaacatgaccctggagaagctgcggagtgacctggatgagaaggagacagagaggagtgacatgaaggagaccatctttgagctggaggatgaggtggagcagcacagagctgtgaagctgcatgacaacctgatcatcagtgacctggagaacacagtgaagaagctgcaggaccagaagcatgacatggagcgggagatcaagaccctgcaccggcggctgcgggaggagagcgctgagtggaggcagttccaggccgacctgcagacagctgtggtgattgccaatgacatcaagtctgaggcccaggaggagattggagacctgaagaggcggctgcacgaggcccaggagaagaatgagaagctgaccaaggagctggaggagatcaagagcaggaagcaggaggaggagcggggccgggtgtacaactacatgaatgctgtggagcgggacctggccgccctgcggcagggcatgggcctgagcagaagaagcagcaccagcagcgagcccacccccaccgtgaagaccctcatcaagagctttgacagcgccagccaggtgcccaacccagctgctgctgccatccccaggacccccctgagccccagccccatgaagaccccacctgctgctgctgtgagccccatgcagaggcacagcatcagcggccccatcagcaccagcaagcccctgacagccctgagtgacaagaggcccaactacggggagatccctgtgcaggagcacctgctgcggaccagcagcgccagcaggcctgccagcctgccccgggtgcctgccatggagagcgccaagaccctgtctgtgtccagaagaagcagcgaggaggtgaagagggacatcagcgcccaggagggcgccagccctgccagcctgatggccatgggcaccaccagcccccagctgagcctgagcagcagccccacagcctctgtgacccccaccaccaggagccgcatccgggaggagaggaaggaccccctgagcgccctggcccgggagtatggaggcagcaagagaaatgccctgctgaagtggtgccagaagaagacagagggctaccagaggaggaacttcatgctggccttccaggccgctgagagcgtgggcatcaagagcaccctggacatcaatgagatggtgaggacagagaggccagactggcagaatgtgatgctgtatgtgacagccatctacaagtactttgagacctag

SEQ ID NO: 171345 - DNA, 2781 bp, Artificial Sequence
  Description of Artificial Sequence: Synthetic coding sequence
atgaccaccaaggactaccccagcctgtggggcttcggcaccaccaagaccttcaagatccccatcgagcacctggacttcaagtacatcgagaagtgcagtgatgtgaagcacctggagaagatcctgtgtgtgctgcggagcggggaggagggctactacccagagctgacagagttctgtgagaagcacctgcaggccctggcccctgagagccgggccctgaggaaggacaagccagctgccacagctgccagcttcaccgctgaggagtgggagaagattgatggagacatcaagtcctgggtgtctgagatcaagaaggaggaggacaagatgcacttccacgagacagagaccttccctgccatgaaggacaacctgccccctgtgcggggcagcaacagctgcctgcacgtgggcaaggagaagtacagcaagaggcccaccaagaagaagaccccccgggactatgcagagtgggacaagtttgatgtggagaaggaatgtctgaagattgatgaggactacaaggagaagacagtgattgacaagagccacctgagcaagattgagaccagaattgacacagctggcctgacagagaaggagaaggacttcctggccacccgggagaaggagaagggaaatgaggccttcaacagcggggactatgaggaggccgtgatgtactacaccaggagcatcagcgccctgcccaccgtggtggcctacaacaacagagcccaggccgagatcaagctgcagaactggaacagcgccttccaggactgtgagaaggtgctggagctggagcctggaaatgtgaaggccctgctgcggcgggccaccacctacaagcaccagaacaagctgcgggaggccacagaggacctgagcaaggtgctggatgtggagccagacaatgacctggccaagaagaccctgtctgaggtggagcgggacctgaagaacagcgaggccgccagcgagacccagaccaagggcaagaggatggtgatccaggagattgaaaattctgaagatgaggagggcaagagcggcaggaagcatgaagatggcggcggggacaagaagccagctgagcctgctggagctgcccgggccgcccagccctgtgtgatgggcaacatccagaagaagctgaccgggaaggccgagggcggcaagaggcctgcccggggggccccccagaggggccagaccccagaggccggggctgacaagaggagcccccggcgggccagcgctgctgctgctgctgggggcggggccaccggccaccctgggggcggccagggcgcagaaaatcctgctggcctgaagagccagggcaatgaactcttccgcagcggccagtttgctgaggccgccggcaagtacagcgctgccatcgccctgctggagcccgccggcagcgagattgctgatgacctgagcatcctgtacagcaacagagctgcctgctacctgaaggagggcaactgcagcggctgcatccaggactgcaacagagccctggagctgcaccccttctccatgaagcccctgctgcggcgggccatggcctatgagaccctggagcagtatggcaaggcctacgtggactacaagacagtgctgcagattgactgtggcctgcagctggccaatgacagcgtgaaccggctgagccgcatcctgatggagctggatggccccaactggagggagaagctgagccccatcccagctgtgcctgcctctgtgcccctgcaggcctggcacccagccaaggagatgatcagcaagcaggccggggacagcagcagccaccggcagcagggcatcacagatgagaagaccttcaaggccctgaaggaggagggcaaccagtgtgtgaatgacaagaactacaaggatgccctgagcaagtacagcgagtgcctgaagatcaacaacaaggaatgtgccatctacaccaacagagccctgtgctacctgaagctgtgccagtttgaggaggccaagcaggactgtgaccaggccctgcagctggctgatggaaatgtgaaggccttctaccgccgggccctggcccacaagggcctgaagaactaccagaagagcctgattgacctgaacaaggtgatcctgctggaccccagcatcatcgaggccaagatggagctggaggaggtgacccggctgctgaacctgaaggacaagacagcccccttcaacaaggagaaggagaggaggaagattgagatccaggaggtgaatgaaggcaaggaggagcccggccggcctgctggggaggtgtccatgggctgcctggccagcgagaagggcggcaagagcagccgcagcccagaagatcctgagaagctgcccatcgccaagcccaacaatgcctatgaatttggccagatcatcaatgccctgagcaccaggaaggacaaggaggcctgtgcccacctgctggccatcacagcccccaaggacctgcccatgttcctgagcaacaagctggagggggacaccttcctgctgctgatccagagcctgaagaacaacctgattgagaaggaccccagcctggtgtaccagcacctgctgtacctgagcaaggccgagcgcttcaagatgatgctgaccctcatcagcaagggccagaaggagctgattgagcagctgtttgaggacctgagtgacacccccaacaaccacttcaccctggaggacatccaggccctgaagaggcagtatgagctgtag

SEQ ID NO: 171346 - DNA, 2781 bp, Artificial Sequence; identical to SEQ ID NO: 171345
  Description of Artificial Sequence: Synthetic coding sequence

SEQ ID NO: 171347 - DNA, 1044 bp, Artificial Sequence
  Description of Artificial Sequence: Synthetic coding sequence
atggccgcccagaggggcatgcccagcagcgctgtgcgggtgctggaggaggccctgggcatgggcctgacagctgctggagatgcccgggacacagcagatgctgtggccgctgagggcgcctactacctggagcaggtgaccatcacagaggcctctgaagatgattatgaatatgaggagatcccagatgacaacttcagcatccctgagggggaggaggacctggccaaggccatccagatggcccaggagcaggccacagacacagagatcctggagaggaagacagtgctgcccagcaagcatgctgtgcctgaggtgattgaggacttcctgtgcaacttcctgatcaagatgggcatgaccaggaccctggactgcttccagagcgagtggtatgagctgatccagaagggcgtgacagagctgaggacagtgggcaatgtgcctgatgtgtacacccagatcatgctgctggagaatgaaaacaagaacctgaagaaggacctgaagcactacaagcaggccgctgacaaggcccgggaggacctgctgaagatccagaaggagcgggacttccacaggatgcaccacaagagaattgtgcaggagaagaacaagctgatcaatgacctgaagggcctgaagctgcactacgccagctatgagcccaccatccgggtgctgcacgagaagcaccacaccctgctgaaggagaagatgctgaccagcctggagcgggacaaggtggtgggccagatcagcggcctgcaggagaccctgaagaagctgcagaggggccacagctaccacggcccccagatcaaggtggaccacagccgggagaaggaaaatgcccctgagggccccacccagaagggcctgcgggaggcccgggagcagaacaagtgcaagaccaagatgaagggcaacaccaagcagtggacaggcaacagccagacctggaacaagacagtgcccctgcaggacaccatcggccggcggcaggagaacaacagcgcccaccagcacatcgactag

SEQ ID NO: 171348 - DNA, 1896 bp, Artificial Sequence
  Description of Artificial Sequence: Synthetic coding sequence
atggccgcccagaggggcatgcccagcagcgctgtgcgggtgctggaggaggccctgggcatgggcctgacagctgctggagatgcccgggacacagcagatgctgtggccgctgagggcgcctactacctggagcaggtgaccatcacagaggcctctgaagatgattatgaatatgaggagatcccagatgacaacttcagcatccctgagggggaggaggacctggccaaggccatccagatggcccaggagcaggccacagacacagagatcctggagaggaagacagtgctgcccagcaagcatgctgtgcctgaggtgattgaggacttcctgtgcaacttcctgatcaagatgggcatgaccaggaccctggactgcttccagagcgagtggtatgagctgatccagaagggcgtgacagagctgaggacagtgggcaatgtgcctgatgtgtacacccagatcatgctgctggagaatgaaaacaagaacctgaagaaggacctgaagcactacaagcaggccgctgacaaggcccgggaggacctgctgaagatccagaaggagcgggacttccacaggatgcaccacaagagaattgtgcaggagaagaacaagctgatcaatgacctgaagggcctgaagctgcactacgccagctatgagcccaccatccgggtgctgcacgagaagcaccacaccctgctgaaggagaagatgctgaccagcctggagcgggacaaggtggtgggccagatcagcggcctgcaggagaccctgaagaagctgcagaggggccacagctaccacggcccccagatcaaggtggaccacagccgggagaaggaaaatgcccctgagggccccacccagaagggcctgcgggaggcccgggagcagaacaagtgcaagaccaagatgaagggcaacaccaaggacagcgagttccccatcgacatgcagcccaaccccaacctgaatgtgtccaaggagagcctgagccctgccaagtttgactacaagctgaagaacatcttccggctgcacgagctgcctgtgtcctgtgtgtccatgcagccccacaaggacatcctggtgtcctgtggggaggaccggctgtggaaggtgctgggcctgcccaagtgcaatgtgctgctgactggatttggccacacagactggctgagtgactgctgcttccaccccagcggggacaagctggccaccagcagcggggacaccaccgtgaagctgtgggacctgtgcaagggggactgcatcctgacctttgagggccacagcagagctgtgtggagctgcacctggcacagctgtggcaactttgtggccagcagcagcctggacaagaccagcaagatctgggatgtgaacagcgagcgctgccgctgcaccctgtatggccacacagacagcgtgaacagcattgagttcttccccttcagcaacaccctgctgaccagcagcgctgacaagaccctgagcatctgggatgccaggacaggcatctgtgagcagagcctgtatggccacatgcacagcatcaatgatgccatctttgacccccggggccacatgattgccagctgtgatgcctgtggggtgaccaagctgtgggacttcaggaagctgctgcccatcgtgtccattgacatcggccccagccctggaaatgaggtgaactttgacagcagcggccgggtgctggcccaggccagcggaaatggagtcatccacctgctggacctgaagtctggagagatccacaagctgatgggccatgaaaatgaggcccacacagtggtgttcagccatgatggagagatcctcttcagcggcggcagtgatggcaccgtgaggacctggagctag

SEQ ID NO: 171349 - DNA, 1614 bp, Artificial Sequence
  Description of Artificial Sequence: Synthetic coding sequence
atgaccatgaacatgaagcgctaccagatgaccatcctggccagccagaaggtgaagaagatctggcagaagcagttccgctggcccaagaaccggctgcagatcctgaagttctggtatgagctgatccagaagggcgtgacagagctgaggacagtgggcaatgtgcctgatgtgtacacccagatcatgctgctggagaatgaaaacaagaacctgaagaaggacctgaagcactacaagcaggccgctgacaaggcccgggaggacctgctgaagatccagaaggagcgggacttccacaggatgcaccacaagagaattgtgcaggagaagaacaagctgatcaatgacctgaagggcctgaagctgcactacgccagctatgagcccaccatccgggtgctgcacgagaagcaccacaccctgctgaaggagaagatgctgaccagcctggagcgggacaaggtggtgggccagatcagcggcctgcaggagaccctgaagaagctgcagaggggccacagctaccacggcccccagatcaaggtggaccacagccgggagaaggaaaatgcccctgagggccccacccagaagggcctgcgggaggcccgggagcagaacaagtgcaagaccaagatgaagggcaacaccaaggacagcgagttccccatcgacatgcagcccaaccccaacctgaatgtgtccaaggagagcctgagccctgccaagtttgactacaagctgaagaacatcttccggctgcacgagctgcctgtgtcctgtgtgtccatgcagccccacaaggacatcctggtgtcctgtggggaggaccggctgtggaaggtgctgggcctgcccaagtgcaatgtgctgctgactggatttggccacacagactggctgagtgactgctgcttccaccccagcggggacaagctggccaccagcagcggggacaccaccgtgaagctgtgggacctgtgcaagggggactgcatcctgacctttgagggccacagcagagctgtgtggagctgcacctggcacagctgtggcaactttgtggccagcagcagcctggacaagaccagcaagatctgggatgtgaacagcgagcgctgccgctgcaccctgtatggccacacagacagcgtgaacagcattgagttcttccccttcagcaacaccctgctgaccagcagcgctgacaagaccctgagcatctgggatgccaggacaggcatctgtgagcagagcctgtatggccacatgcacagcatcaatgatgccatctttgacccccggggccacatgattgccagctgtgatgcctgtggggtgaccaagctgtgggacttcaggaagctgctgcccatcgtgtccattgacatcggccccagccctggaaatgaggtgaactttgacagcagcggccgggtgctggcccaggccagcggaaatggagtcatccacctgctggacctgaagtctggagagatccacaagctgatgggccatgaaaatgaggcccacacagtggtgttcagccatgatggagagatcctcttcagcggcggcagtgatggcaccgtgaggacctggagctag

SEQ ID NO: 171350 - DNA, 756 bp, Artificial Sequence
  Description of Artificial Sequence: Synthetic coding sequence
atgggcgtgggcaccaaggcccgggccagccactggaggcggctgctgagcctgggcgccaccccagaggagcccctgctggacttcaagatcccagatgacaacttcagcatccctgagggggaggaggacctggccaaggccatccagatggcccaggagcaggccacagacacagagatcctggagaggaagacagtgctgcccagcaagcatgctgtgcctgaggtgattgaggacttcctgtgcaacttcctgatcaagatgggcatgaccaggaccctggactgcttccagagcgagtggtatgagctgatccagaagggcgtgacagagctgaggacagtgggcaatgtgcctgatgtgtacacccagatcatgctgctggagaatgaaaacaagaacctgaagaaggacctgaagcactacaagcaggccgctgacaaggcccgggaggacctgctgaagatccagaaggagcgggacttccacaggatgcaccacaagagaattgtgcaggagaagaacaagctgatcaatgacctgaagggcctgaagctgcactacgccagctatgagcccaccatccgggtgctgcacgagaagcaccacaccctgctgaaggagaagatgctgaccagcctggagcgggacaaggtggtgggccagatcagcggcctgcaggagaccctgaagaagctgcagaggggccacagctaccacggcccccagatcaagggcaagtgcaagatgtag

SEQ ID NO: 171351 - DNA, 552 bp, Artificial Sequence
  Description of Artificial Sequence: Synthetic coding sequence
atggccgcccagaggggcatgcccagcagcgctgtgcgggtgctggaggaggccctgggcatgggcctgacagctgctggagatgcccgggacacagcagatgctgtggccgctgagggcgcctactacctggagcaggtgaccatcacagaggcctctgaagatgattatgaatatgaggagatcccagatgacaacttcagcatccctgagggggaggaggacctggccaaggccatccagatggcccaggagcaggccacagacacagagatcctggagaggaagacagtgctgcccagcaagcatgctgtgcctgaggtgattgaggacttcctgtgcaacttcctgatcaagatgggcatgaccaggaccctggactgcttccagagcgagtggtatgagctgatccagaagggcgtgacagagctgaggacagtgggcaatgtgcctgatgtgtacacccagatcatgctgctggagaatgaaaacaagaacctgaagaaggacctgaagcactacaagcaggccgcagaatatgtgatcttctag

SEQ ID NO: 171352 - DNA, 768 bp, Artificial Sequence
  Description of Artificial Sequence: Synthetic coding sequence
gacagcgagttccccatcgacatgcagcccaaccccaacctgaatgtgtccaaggagagcctgagccctgccaagtttgactacaagctgaagaacatcttccggctgcacgagctgcctgtgtcctgtgtgtccatgcagccccacaaggacatcctggtgtcctgtggggaggaccggctgtggaaggtgctgggcctgcccaagtgcaatgtgctgctgactggatttggccacacagactggctgagtgactgctgcttccaccccagcgagcgctgccgctgcaccctgtatggccacacagacagcgtgaacagcattgagttcttccccttcagcaacaccctgctgaccagcagcgctgacaagaccctgagcatctgggatgccaggacaggcatctgtgagcagagcctgtatggccacatgcacagcatcaatgatgccatctttgacccccggggccacatgattgccagctgtgatgcctgtggggtgaccaagctgtgggacttcaggaagctgctgcccatcgtgtccattgacatcggccccagccctggaaatgaggtgaactttgacagcagcggccgggtgctggcccaggccagcggaaatggagtcatccacctgctggacctgaagtctggagagatccacaagctgatgggccatgaaaatgaggcccacacagtggtgttcagccatgatggagagatcctcttcagcggcggcagtgatggcaccgtgaggacctggagctag

SEQ ID NO: 171353 - DNA, 1314 bp, Artificial Sequence
  Description of Artificial Sequence: Synthetic coding sequence
atgaggaggagcagcaggcctggcagcgccagcagcagcaggaagcacacccccaacttcttcagcgagaacagctccatgagcatcaccagcgaggacagcaagggcctgcggtctgctgagcccggccctggagagcctgagggccggcgggcccggggccccagctgtggggagcccgccctgtctgctggggtgcctgggggcaccacctgggccggcagcagccagcagaagccagcccccaggagccacaactggcagacagcctgtggggccgccaccgtgcggggcggggccagcgagcccaccggcagccctgtggtgtctgaggagcccctggacctgctgcccaccctggacctgcggcaggagatgcccccacccagggtcttcaagagcttcctgagcctgctcttccagggcctgtctgtgctgctgagcctggccggagatgtgctggtgtccatgtaccgggaggtgtgcagcatccgcttcctgttcaccgctgtgtccctgctgagcctcttcctgagcgccttctggctgggcctgctgtacctggtgagccccctggagaatgagcccaaggagatgctgaccctgtctgagtaccacgagcgggtgcgcagccagggccagcagctgcagcagctgcaggccgagctggacaagctgcacaaggaggtgtccacagtgcgggccgccaacagcgagcgggtggccaagctggtgttccagaggctgaatgaagattttgtgaggaagccagactatgccctgagctctgtgggcgccagcattgacctgcagaagaccagccatgactatgctgacaggaacacagcctacttctggaaccgcttctccttctggaactatgcccggcccccaacagtcatcctggagccccacgtgtttcctggcaactgctgggcctttgaaggagaccagggccaggtggtgatccagctgcccggccgggtgcagctgagtgacatcaccctgcagcaccccccacccagcgtggagcacactggaggagccaacagcgccccccgggactttgctgtgtttggcctgcaggtgtatgatgaaacagaggtgtccctgggcaagttcacctttgatgtggagaagtctgagatccagaccttccacctgcagaatgaccccccagctgccttccccaaggtgaagatccagatcctgagcaactggggccacccccgcttcacctgcctgtacagagtgcgggcccatggagtgaggaccagcgagggcgctgagggcagcgcccagggcccccactag

SEQ ID NO: 171354 - DNA, 1377 bp, Artificial Sequence
  Description of Artificial Sequence: Synthetic coding sequence
atgagccagaggcaggtgctgcaggtgtttgagcagtaccagaaggcccggacccagtttgtgcagatggtggccgagctggccacccggccccagaacatcgagaccctgcagaatgctggggtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaaccgcttctacaagaaggctgctgcctttgtgctgcgggctgtgggcaagcacagcccccagctggcccaggccatcgtggactgtggggccctggacaccctggtgatctgcctggaggactttgatcctggggtgaaggaggccgccgcctgggccctgcgctacatcgcccggcacaatgctgagctgagccaggccgtggtggatgctggagctgtgcccctgctggtgctgtgcatccaggagcctgagatcgccctgaagagaattgctgccagcgccctgagtgacatcgccaagcacagccctgagctggcccagacagtggtggatgctggagctgtggcccacctggcccagatgatcctgaacccagatgccaagctgaagcaccagatcctgagcgccctgagccaggtgtccaagcacagcgtggacctggccgagatggtggtggaggccgagatcttccctgtggtgctgacctgcctgaaggacaaggatgaatatgtgaagaagaatgccagcaccctcatccgggagatcgccaagcacaccccagagctgagccagctggtggtgaatgctgggggcgtggccgctgtgattgactgcatcggcagctgcaagggcaacacccggctgcccggcatcatgatgctgggctacgtggccgcccacagcgagaacctggccatggccgtcatcatcagcaaaggagtgccccagctgtctgtgtgcctgtctgaggagcctgaggaccacatcaaggctgctgctgcctgggccctgggccagatcggccgccacaccccagagcacgcccgggctgtggccgtgaccaacaccctgcctgtgctgctgagcctgtacatgagcacagagagcagcgaggacctgcaggtgaagagcaagaaggccatcaagaacatcctgcagaagtgcacctacctgcctgccctggagcccttcctgtatgatgccccacccaacatcctgaagcacgtggtgggccagttcagcaaggtgctcttcccctggatcttccgctacaccagcgctgagggcggccagctgagcaccacctag

SEQ ID NO: 171355 - DNA, 813 bp, Artificial Sequence
  Description of Artificial Sequence: Synthetic coding sequence
atgagccagaggcaggtgctgcaggtgtttgagcagtaccagaaggcccggacccagtttgtgcagatggtggccgagctggccacccggccccagaacatcgagaccctgcagaatgctggggtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaatggagtgccccagctgtctgtgtgcctgtctgaggagcctgaggaccacatcaaggctgctgctgcctgggccctgggccagatcggccgccacaccccagagcacgcccgggctgtggccgtgaccaacaccctgcctgtgctgctgagcctgtacatgagcacagagagcagcgaggacctgcaggtgaagagcaagaaggccatcaagaacatcctgcagaagtgcacctacctgcctgccctggagcccttcctgtatgatgccccacccaacatcctgaagcacgtggtgggccagttcagcaaggtgctgccccatgacagcaaggcccggcggctgtttgtgaccagcggcggcctgaagaaggtgcaggagatcaaggccgagcccggcagcctgctgcaggagtacatcaacagcatcaacagctgctacccagaggagatcgtgcgctactacagccctggctacagcgacaccctgctgcagagggtggacagctaccagcccctgaacaactag

SEQ ID NO: 171356 - DNA, 1758 bp, Artificial Sequence
  Description of Artificial Sequence: Synthetic coding sequence
atgagccagaggcaggtgctgcaggtgtttgagcagtaccagaaggcccggacccagtttgtgcagatggtggccgagctggccacccggccccagaacatcgagaccctgcagaatgctggggagcccggggcccggacccctgtggccccccgggccctgagcccccggcggctgcggcctgctgccctgcctgtggagctgctgggcagccgctctgtgggcaccggggtgaggaagagcatccacagcttccagagggtgtttggaggccaggccgagcgggtgaagctgcctgatggctgcggccgctgtgccctgagcctcttccccagcagcctgcacactggagtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaaccgcttctacaagaaggctgctgcctttgtgctgcgggctgtgggcaagcacagcccccagctggcccaggccatcgtggactgtggggccctggacaccctggtgatctgcctggaggactttgatcctggggtgaaggaggccgccgcctgggccctgcgctacatcgcccggcacaatgctgagctgagccaggccgtggtggatgctggagctgtgcccctgctggtgctgtgcatccaggagcctgagatcgccctgaagagaattgctgccagcgccctgagtgacatcgccaagcacagccctgagctggcccagacagtggtggatgctggagctgtggcccacctggcccagatgatcctgaacccagatgccaagctgaagcaccagatcctgagcgccctgagccaggtgtccaagcacagcgtggacctggccgagatggtggtggaggccgagatcttccctgtggtgctgacctgcctgaaggacaaggatgaatatgtgaagaagaatgccagcaccctcatccgggagatcgccaagcacaccccagagctgagccagctggtggtgaatgctgggggcgtggccgctgtgattgactgcatcggcagctgcaagggcaacacccggctgcccggcatcatgatgctgggctacgtggccgcccacagcgagaacctggccatggccgtcatcatcagcaaaggagtgccccagctgtctgtgtgcctgtctgaggagcctgaggaccacatcaaggctgctgctgcctgggccctgggccagatcggccgccacaccccagagcacgcccgggctgtggccgtgaccaacaccctgcctgtgctgctgagcctgtacatgagcacagagagcagcgaggacctgcaggtgaagagcaagaaggccatcaagaacatcctgcagaagtgcacctacctgcctgccctggagcccttcctgtatgatgccccacccaacatcctgaagcacgtggtgggccagttcagcaaggtgctgccccatgacagcaaggcccggcggctgtttgtgaccagcggcggcctgaagaaggtgcaggagatcaaggccgagcccggcagcctgctgcaggagtacatcaacagcatcaacagctgctacccagaggagatcgtgcgctactacagccctggctacagcgacaccctgctgcagagggtggacagctaccagcccctgaacaactag

SEQ ID NO: 171357 - DNA, 1530 bp, Artificial Sequence
  Description of Artificial Sequence: Synthetic coding sequence
atgagccagaggcaggtgctgcaggtgtttgagcagtaccagaaggcccggacccagtttgtgcagatggtggccgagctggccacccggccccagaacatcgagaccctgcagaatgctggggtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaaccgcttctacaagaaggctgctgcctttgtgctgcgggctgtgggcaagcacagcccccagctggcccaggccatcgtggactgtggggccctggacaccctggtgatctgcctggaggactttgatcctggggtgaaggaggccgccgcctgggccctgcgctacatcgcccggcacaatgctgagctgagccaggccgtggtggatgctggagctgtgcccctgctggtgctgtgcatccaggagcctgagatcgccctgaagagaattgctgccagcgccctgagtgacatcgccaagcacagccctgagctggcccagacagtggtggatgctggagctgtggcccacctggcccagatgatcctgaacccagatgccaagctgaagcaccagatcctgagcgccctgagccaggtgtccaagcacagcgtggacctggccgagatggtggtggaggccgagatcttccctgtggtgctgacctgcctgaaggacaaggatgaatatgtgaagaagaatgccagcaccctcatccgggagatcgccaagcacaccccagagctgagccagctggtggtgaatgctgggggcgtggccgctgtgattgactgcatcggcagctgcaagggcaacacccggctgcccggcatcatgatgctgggctacgtggccgcccacagcgagaacctggccatggccgtcatcatcagcaaaggagtgccccagctgtctgtgtgcctgtctgaggagcctgaggaccacatcaaggctgctgctgcctgggccctgggccagatcggccgccacaccccagagcacgcccgggctgtggccgtgaccaacaccctgcctgtgctgctgagcctgtacatgagcacagagagcagcgaggacctgcaggtgaagagcaagaaggccatcaagaacatcctgcagaagtgcacctacctgcctgccctggagcccttcctgtatgatgccccacccaacatcctgaagcacgtggtgggccagttcagcaaggtgctgccccatgacagcaaggcccggcggctgtttgtgaccagcggcggcctgaagaaggtgcaggagatcaaggccgagcccggcagcctgctgcaggagtacatcaacagcatcaacagctgctacccagaggagatcgtgcgctactacagccctggctacagcgacaccctgctgcagagggtggacagctaccagcccctgaacaactag

SEQ ID NO: 171358 - DNA, 741 bp, Artificial Sequence
  Description of Artificial Sequence: Synthetic coding sequence
atgagccagaggcaggtgctgcaggtgtttgagcagtaccagaaggcccggacccagtttgtgcagatggtggccgagctggccacccggccccagaacatcgagaccctgcagaatgctggggagcccggggcccggacccctgtggccccccgggccctgagcccccggcggctgcggcctgctgccctgcctgtggagctgctgggcagccgctctgtgggcaccggggtgaggaagagcatccacagcttccagagggtgtttggaggccaggccgagcgggtgaagctgcctgatggctgcggccgctgtgccctgagcctcttccccagcagcctgcacactggagtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaaccgcttctacaagaaggctgctgcctttgtgctgcgggctgtgggcaagcacagcccccagctggcccaggccatcgtggactgtggggccctggacaccctggtgatctgcctggaggactttgatcctggggtgaaggaggccgccgcctgggccctgcgctacatcgcccggcacaatgctgagctgagccaggccgtggtggatgctggagctgtgccctag

SEQ ID NO: 171359 - DNA, 576 bp, Artificial Sequence
  Description of Artificial Sequence: Synthetic coding sequence
atgagccagaggcaggtgctgcaggtgtttgagcagtaccagaaggcccggacccagtttgtgcagatggtggccgagctggccacccggccccagaacatcgagaccctgcagaatgctggggtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaatggagtgccccagctgtctgtgtgcctgtctgaggagcctgaggaccacatcaaggctgctgctgcctgggccctgggccagatcggccgccacaccccagagcacgcccgggctgtggccgtgaccaacaccctgcctgtgctgctgagcctgtacatgagcacagagagcagcgaggacctgcaggtgaagagcaagaaggccatcaagaacatcctgcagaagtgcacctacctgcctgccctggagcccttcctgtatgatgccccacccaacatcctgaagtag

SEQ ID NO: 171360 - DNA, 1455 bp, Artificial Sequence
  Description of Artificial Sequence: Synthetic coding sequence
atgcacagcctgaccatggacctgtggatccccaacggccaggccggcgtgatgagcctgctgcggaccctgctgctggatgtggtgcccaccatccagcagacagctgccctggccctgggccgcctggccaactacaatgatgacctggccgaggccgtggtgaagtgtgacatcctgccccagctggtgtacagcctggccgagcagaaccgcttctacaagaaggccgccgcctttgtgctgcgggctgtgggcaagcacagcccccagctggcccaggccatcgtggactgtggggccctggacaccctggtgatctgcctggaggactttgaccccggggtgaaggaggccgccgcctgggccctgcgctacatcgcccggcacaatgctgagctgagccaggccgtggtggatgctggagctgtgcccctgctggtgctgtgcatccaggagcctgagatcgccctgaagagaattgctgccagcgccctgagtgacatcgccaagcacagccctgagctggcccagacagtggtggatgctggagctgtggcccacctggcccagatgatcctgaacccagatgccaagctgaagcaccagatcctgagcgccctgagccaggtgtccaagcacagcgtggacctggccgagatggtggtggaggccgagatcttccctgtggtgctgacctgcctgaaggacaaggatgaatatgtgaagaagaatgccagcaccctcatccgggagatcgccaagcacaccccagagctgagccagctggtggtgaatgctgggggcgtggccgccgtcatcgactgcatcggcagctgcaagggcaacacccggctgcccggcatcatgatgctgggctacgtggccgcccacagcgagaacctggccatggctgtgatcatcagcaagggcgtgccccagctgtctgtgtgcctgtctgaggagcctgaggaccacatcaaggctgctgctgcctgggccctgggccagatcggccgccacaccccagagcacgcccgggctgtggccgtgaccaacaccctgcctgtgctgctgagcctgtacatgagcacagagagcagcgaggacctgcaggtgaagagcaagaaggccatcaagaacatcctgcagaagtgcacctacctgcctgccctggagcccttcctgtatgatgccccacccaacatcctgaagcacgtggtgggccagttcagcaaggtgctgccccatgacagcaaggcccggcggctgtttgtgaccagcggcggcctgaagaaggtgcaggagatcaaggccgagcccggcagcctgctgcaggagtacatcaacagcatcaacagctgctacccagaggagatcgtgcgctactacagccctggctacagcgacaccctgctgcagagggtggacagctaccagcccctgaacaactag

SEQ ID NO: 171361 - DNA, 1506 bp, Artificial Sequence
  Description of Artificial Sequence: Synthetic coding sequence
atggagaccaatgaaagcacagagggcagccgcagccgcagccgcagcctggacatccagcccagcagcgagggcctgggccccaccagcgagcccttccccagcagtgatgacagccccaggtctgccctggccgccgccacagctgctgctgctgctgctgccagcgctgctgctgccacagctgccttcaccacagccaaggccgccgccctgagcaccaagaccccagccccctgcagcgagttcatggagcccagcagtgaccccagcctgctgggggagccctgtgccggccctggcttcacccacaacatcgcccacggcagcctgggctttgagcctgtgtatgtgtcctgcatcgcccaggacacctgcaccaccacagaccacagcagcaaccctggccctgtgcccggcagcagcagcggccctgtgctgggcagcagcagtggagctggccacggcagcggcagcggcagcggccctggctgcggctctgtgcccggcagcggcagcggccctggccctggcagcggccctggcagcggccctggccacggcagcggcagccaccctggccctgccagcggccctggccctgacaccggcccagattctgagctgagcccctgcatccccccaggcttcaggaacctggtggccgacagagtgcccaactacacctcctggagccagcactgcccctgggagccccagaagcagcccccctgggagttcctgcaggtgctggagcccggggcccggggcctgtggaagcccccagacatcaagggcaagctgatggtgtgctatgagaccctgccccggggccagtgcctgctgtacaactgggaggaggagcgggccaccaaccacctggaccaggtgcccagcatgcaggacggcagcgagagcttcttcttcagacatggccaccggggcctgctgaccatgcagctgaagagccccatgcccagcagcaccacccagaaggacagctaccagcccccaggaaatgtgtactggcccctgcggggcaagcgggaggccatgctggagatgctgctgcagcaccagatctgcaaggaggtgcaggccgagcaggagcccaccaggaagctgtttgaggtggagagcgtgacccaccacgactacaggatggagctggcccaggccggcaccccagcccccaccaagccccatgactaccggcaggagcagcctgagaccttctggatccagagggccccccagctgcccacctggtggcccctgcccacccaggtgcctgctgctgaggactacctgacctggaaggagtggggcttcaccggggtgcaggaggtgctgagcgccctgctgcgggccaccccaggagagtacagcgtgaacatctgtggcatgaatgagcaccctgtgtgcagcaggacctggaccaaccggctgtgccaccaggagatgggcagcaagaagacagtgacccaggaggaccggggctggtag

SEQ ID NO: 171362 - DNA, 1458 bp, Artificial Sequence
  Description of Artificial Sequence: Synthetic coding sequence
atggagaccaatgaaagcacagagggcagccgcagccgcagccgcagcctggacatccagcccagcagcgagggcctgggccccaccagcgagcccttccccagcagtgatgacagccccaggtctgccctggccgccgccacagctgctgctgctgctgctgccagcgctgctgctgccacagctgccttcaccacagccaaggccgccgccctgagcaccaagaccccagccccctgcagcgagttcatggagcccagcagtgaccccagcctgctgggggagccctgtgccggccctggcttcacccacaacatcgcccacggcagcctgggctttgagcctgtgtatgtgtcctgcatcgcccaggacacctgcaccaccacagaccacagcagcaaccctggccctgtgcccggcagcagcagcggccctgtgctgggcagcagcagtggagctggccacggcagcggcagcggcagcggccctggctgcggctctgtgcccggcagcggcagcggccctggccctggcagcggccctggcagcggccctggccacggcagcggcagccaccctggccctgccagcggccctggccctgacaccggcccagattctgagctgagcccctgcatccccccaggcttcaggaacctggtggccgacagagtgcccaactacacctcctggagccagcactgcccctgggagccccagaagcagcccccctgggagttcctgcaggtgctggagcccggggcccggggcctgtggaagcccccagacatcaagggcaagctgatggtgtgctatgagaccctgccccggggccagtgcctgctgtacaactgggaggaggagcgggccaccaaccacctggaccaggtgcccagcatgcaggacggcagcgagagcttcttcttcagacatggccaccggggcctgctgaccatgcagctgaagagccccatgcccagcagcaccacccagaaggacagctaccagcccccaggaaatgtgtactggcccctgcggggcaagcgggaggccatgctggagatgctgctgcagcaccagatctgcaaggaggtgcaggccgagcaggagcccaccaggaagctgtttgaggtggagagcgtgacccaccacgactacaggatggagctggcccaggccggcaccccagcccccaccaagccccatgactaccggcaggagcagcctgagaccttctggatccagagggccccccagctgcccggggtgagcaacatccgcaccctggacacccccttcaggaagaactgcagcttcagcacccctgtgcccctgagcctgggcaagctgctgccctatgagcctgagaactacccctaccagctgggggagatcagcagcctgccctgccctgggggccgcctgggcggcggcggcggccgcatgacccccttctag

SEQ ID NO: 171363 - DNA, 1281 bp, Artificial Sequence
  Description of Artificial Sequence: Synthetic coding sequence
atggagaccaatgaaagcacagagggcagccgcagccgcagccgcagcctggacatccagcccagcagcgagggcctgggccccaccagcgagcccttccccagcagtgatgacagccccaggtctgccctggccgccgccacagctgctgctgctgctgctgccagcgctgctgctgccacagctgccttcaccacagccaaggccgccgccctgagcaccaagaccccagccccctgcagcgagttcatggagcccagcagtgaccccagcctgctgggggagccctgtgccggccctggcttcacccacaacatcgcccacggcagcctgggctttgagcctgtgtatgtgtcctgcatcgcccaggacacctgcaccaccacagaccacagcagcaaccctggccctgtgcccggcagcagcagcggccctgtgctgggcagcagcagtggagctggccacggcagcggcagcggcagcggccctggctgcggctctgtgcccggcagcggcagcggccctggccctggcagcggccctggcagcggccctggccacggcagcggcagccaccctggccctgccagcggccctggccctgacaccggcccagattctgagctgagcccctgcatccccccaggcttcaggaacctggtggccgacagagtgcccaactacacctcctggagccagcactgcccctgggagccccagaagcagcccccctgggagttcctgcaggtgctggagcccggggcccggggcctgtggaagcccccagacatcaagggcaagctgatggtgtgctatgagaccctgccccggggccagtgcctgctgtacaactgggaggaggagcgggccaccaaccacctggaccaggtgcccagcatgcaggacggcagcgagagcttcttcttcagacatggccaccggggcctgctgaccatgcagctgaagagccccatgcccagcagcaccacccagaaggacagctaccagcccccaggaaatgtgtactggcccctgcggggcaagcgggaggccatgctggagatgctgctgcagcaccagatctgcaaggaggtgcaggccgagcaggagcccaccaggaagctgtttgaggtggagagcgtgacccaccacgactacaggatggagctggcccaggccggcaccccagcccccaccaagccccatgactaccggcaggagcagcctgagaccttctggatccagagggccccccagctgcctgtgtgtgagggggactag

SEQ ID NO: 171364 - DNA, 3966 bp, Artificial Sequence
  Description of Artificial Sequence: Synthetic coding sequence
atggagctggaggatggagtggtgtaccaggaggagcccggcggcagcggggctgtgatgtctgagcgggtgtctggcctggccggcagcatctaccgggagtttgagcggctgattggccgctatgatgaggaggtggtgaaggagctgatgcccctggtggtggccgtgctggagaacctggacagcgtgtttgcccaggaccaggagcaccaggtggagctggagctgctgagagatgacaatgagcagctgatcacccagtatgagcgggagaaggccctgaggaagcatgctgaggagaagttcatcgagtttgaggacagccaggagcaggagaagaaggacctgcagaccagggtggagagcctggagagccagacccggcagctggagctgaaggccaagaactatgctgaccagatcagccggctggaggagcgggaggccgagctgaagaaggagtacaatgccctgcaccagaggcacacagagatgatccacaactacatggagcacctggagaggaccaagctgcaccagctgagcggcagtgaccagctggagagcacagcccacagccgcatcaggaaggagcggcccatcagcctgggcatcttccccctgcctgctggagatggcctgctgaccccagatgcccagaagggcggggagaccccaggcagcgagcagtggaagttccaggagctgagccagcccaggagccacaccagcctgaaggtgagcaacagccctgagccccagaaggctgtggagcaggaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccacaggcagcgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgaggagctgagcagcgctggcagcggcctgattggagatgtggatgagggcgctgacctgctgggcatgggccgggaggtggagaacctgatcctggagaacacccagctgctggagaccaagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggctgaagatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagccgggagaacccagccatgcaggagaagaagaggagcagcatctggcagttcttcagccgcctcttcagcagcagcagcaacaccaccaagaagccagagccccctgtgaacctgaagtacaatgcccccaccagccacgtgacccccagcgtgaagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagctgtggtgtgctgtgggcgtgaacctgagcggcggcaagaccagagatggcggctctgtggtgggcgccagcgtcttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaacggggccagccctgtgatggacaagcccccagagatggaggctgaaaattctgaggtggatgaaaatgtgcccacagctgaggaggccacagaggccacagagggcaatgccggcagcgcagaagatactgtggacatcagccagacaggagtgtacacagaacatgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccaccggggcgtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccaacaagaccagcggcgtgcccggcaaccggcccggcagcgtcatccgggtgtatggagatgagaacagcgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgactggagacaaggccggccccagcgcccaggagcccggcagccagacccccctgaagtccatgctggtgatctctggaggagagggctacatcgacttcaggatgggagatgaaggaggagagagcgagctgctgggggaggacctgcccctggagcccagcgtgaccaaggccgagaggagccacctgattgtgtggcaggtgatgtatggaaatgaatag

SEQ ID NO: 171365 - DNA, 3924 bp, Artificial Sequence
  Description of Artificial Sequence: Synthetic coding sequence
atggagctggaggatggagtggtgtaccaggaggagcccggcggcagcggggctgtgatgtctgagcgggtgtctggcctggccggcagcatctaccgggagtttgagcggctgattggccgctatgatgaggaggtggtgaaggagctgatgcccctggtggtggccgtgctggagaacctggacagcgtgtttgcccaggaccaggagcaccaggtggagctggagctgctgagagatgacaatgagcagctgatcacccagtatgagcgggagaaggccctgaggaagcatgctgaggagaagttcatcgagtttgaggacagccaggagcaggagaagaaggacctgcagaccagggtggagagcctggagagccagacccggcagctggagctgaaggccaagaactatgctgaccagatcagccggctggaggagcgggaggccgagctgaagaaggagtacaatgccctgcaccagaggcacacagagatgatccacaactacatggagcacctggagaggaccaagctgcaccagctgagcggcagtgaccagctggagagcacagcccacagccgcatcaggaaggagcggcccatcagcctgggcatcttccccctgcctgctggagatggcctgctgaccccagatgcccagaagggcggggagaccccaggcagcgagcagtggaagttccaggagctgagccagcccaggagccacaccagcctgaaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccacaggcagcgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgaggagctgagcagcgctggcagcggcctgattggagatgtggatgagggcgctgacctgctgggcatgggccgggaggtggagaacctgatcctggagaacacccagctgctggagaccaagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggctgaagatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagccgggagaacccagccatgcaggagaagaagaggagcagcatctggcagttcttcagccgcctcttcagcagcagcagcaacaccaccaagaagccagagccccctgtgaacctgaagtacaatgcccccaccagccacgtgacccccagcgtgaagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagctgtggtgtgctgtgggcgtgaacctgagcggcggcaagaccagagatggcggctctgtggtgggcgccagcgtcttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaacggggccagccctgtgatggacaagcccccagagatggaggctgaaaattctgaggtggatgaaaatgtgcccacagctgaggaggccacagaggccacagagggcaatgccggcagcgcagaagatactgtggacatcagccagacaggagtgtacacagaacatgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccaccggggcgtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccaacaagaccagcggcgtgcccggcaaccggcccggcagcgtcatccgggtgtatggagatgagaacagcgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgactggagacaaggccggccccagcgcccaggagcccggcagccagacccccctgaagtccatgctggtgatctctggaggagagggctacatcgacttcaggatgggagatgaaggaggagagagcgagctgctgggggaggacctgcccctggagcccagcgtgaccaaggccgagaggagccacctgattgtgtggcaggtgatgtatggaaatgaatag

SEQ ID NO: 171366 - DNA, 1908 bp, Artificial Sequence
  Description of Artificial Sequence: Synthetic coding sequence
agcctgaaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccacaggcagcgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagaagctgtggtgtgctgtgggcgtgaacctgagcggcggcaagaccagagatggcggctctgtggtgggcgcctctgtgttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaatggagccagccctgtgatggacaagcccccagagatggaggccgagaacagcgaggtggatgaaaatgtgcccacagctgaggaggccacagaggccacagagggcaatgccggcagcgctgaggacacagtggacatcagccagacaggagtgtacacagagcacgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccacagaggagtggatggccagtgggacctgagcaactaccacctgctggacctgggccggccccaccacagcatccgctgcatgacagtggtgcatgacaaggtgtggtgtggctacagaaacaagatctacgtgctgcacagcagcctgggagatggagcccggccctgcctgaagacagacaagcaggccaagaaccggctgaagagcggcttccactag

SEQ ID NO: 171367 - DNA, 3207 bp, Artificial Sequence
  Description of Artificial Sequence: Synthetic coding sequence
agcctgaaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccacaggcagcgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgaggagctgagcagcgctggcagcggcctgattggagatgtggatgagggcgctgacctgctgggcatgggccgggaggtggagaacctgatcctggagaacacccagctgctggagaccaagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggctgaagatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagccgggagaacccagccatgcaggagaagaagaggagcagcatctggcagtttgtgcccacccgcttcagccgcctcttcagcagcagcagcaacaccaccaagaagccagagccccctgtgaacctgaagtacaatgcccccaccagccacgtgacccccagcgtgaagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagaagctgtggtgtgctgtgggcgtgaacctgagcggcggcaagaccagagatggcggctctgtggtgggcgcctctgtgttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaatggagccagccctgtgatggacaagcccccagagatggaggccgagaacagcgaggtggatgaaaatgtgcccacagctgaggaggccacagaggccacagagggcaatgccggcagcgctgaggacacagtggacatcagccagacaggagtgtacacagagcacgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccacagaggagtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccaacaagaccagcggcgtgcccggcaacagacctggcagcgtcatccgggtgtatggagatgaaaattctgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgaccggggacaaggccggccccagcgcccaggagcccggcagccagacccccctgaagtccatgctggtgatcagcggcggggagggctacatcgacttcaggatgggagatgagggcggggagagcgagctgctgggggaggacctgcccctggagcccagcgtgaccaaggccgagaggagccacctgattgtgtggcaggtgatgtatggaaatgaatag

SEQ ID NO: 171368 - DNA, 3237 bp, Artificial Sequence
  Description of Artificial Sequence: Synthetic coding sequence
tctgtgaaggtgagcaacagccctgagccccagaaggctgtggagcaggaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccacaggcagcgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgaggagctgagcagcgctggcagcggcctgattggagatgtggatgagggcgctgacctgctgggcatgggccgggaggtggagaacctgatcctggagaacacccagctgctggagaccaagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggctgaagatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagccgggagaacccagccatgcaggagaagaagaggagcagcatctggcagttcttcagccgcctcttcagcagcagcagcaacaccaccaagaagccagagccccctgtgaacctgaagtacaatgcccccaccagccacgtgacccccagcgtgaagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagaagctgtggtgtgctgtgggcgtgaacctgagcggcggcaagaccagagatggcggctctgtggtgggcgcctctgtgttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaatggagccagccctgtgatggacaagcccccagagatggaggccgagaacagcgaggtggatgaaaatgtgcccacagctgaggaggccacagaggccacagagggcaatgccggcagcgctgaggacacagtggacatcagccagacaggagtgtacacagagcacgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccacagaggagtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccaacaagaccagcggcgtgcccggcaacagacctggcagcgtcatccgggtgtatggagatgaaaattctgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgaccggggacaaggccggccccagcgcccaggagcccggcagccagacccccctgaagtccatgctggtgatcagcggcggggagggctacatcgacttcaggatgggagatgagggcggggagagcgagctgctgggggaggacctgcccctggagcccagcgtgaccaaggccgagaggagccacctgattgtgtggcaggtgatgtatggaaatgaatag

SEQ ID NO: 171369 - DNA, 3936 bp, Artificial Sequence
  Description of Artificial Sequence: Synthetic coding sequence
atggagctggaggatggagtggtgtaccaggaggagcccggcggcagcggggctgtgatgtctgagcgggtgtctggcctggccggcagcatctaccgggagtttgagcggctgattggccgctatgatgaggaggtggtgaaggagctgatgcccctggtggtggccgtgctggagaacctggacagcgtgtttgcccaggaccaggagcaccaggtggagctggagctgctgagagatgacaatgagcagctgatcacccagtatgagcgggagaaggccctgaggaagcatgctgaggagaagttcatcgagtttgaggacagccaggagcaggagaagaaggacctgcagaccagggtggagagcctggagagccagacccggcagctggagctgaaggccaagaactatgctgaccagatcagccggctggaggagcgggaggccgagctgaagaaggagtacaatgccctgcaccagaggcacacagagatgatccacaactacatggagcacctggagaggaccaagctgcaccagctgagcggcagtgaccagctggagagcacagcccacagccgcatcaggaaggagcggcccatcagcctgggcatcttccccctgcctgctggagatggcctgctgaccccagatgcccagaagggcggggagaccccaggcagcgagcagtggaagttccaggagctgagccagcccaggagccacaccagcctgaaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccacaggcagcgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgaggagctgagcagcgctggcagcggcctgattggagatgtggatgagggcgctgacctgctgggcatgggccgggaggtggagaacctgatcctggagaacacccagctgctggagaccaagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggctgaagatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagccgggagaacccagccatgcaggagaagaagaggagcagcatctggcagtttgtgcccacccgcttcagccgcctcttcagcagcagcagcaacaccaccaagaagccagagccccctgtgaacctgaagtacaatgcccccaccagccacgtgacccccagcgtgaagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagctgtggtgtgctgtgggcgtgaacctgagcggcggcaagaccagagatggcggctctgtggtgggcgccagcgtcttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaacggggccagccctgtgatggacaagcccccagagatggaggctgaaaattctgaggtggatgaaaatgtgcccacagctgaggaggccacagaggccacagagggcaatgccggcagcgcagaagatactgtggacatcagccagacaggagtgtacacagaacatgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccaccggggcgtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccaacaagaccagcggcgtgcccggcaaccggcccggcagcgtcatccgggtgtatggagatgagaacagcgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgactggagacaaggccggccccagcgcccaggagcccggcagccagacccccctgaagtccatgctggtgatctctggaggagagggctacatcgacttcaggatgggagatgaaggaggagagagcgagctgctgggggaggacctgcccctggagcccagcgtgaccaaggccgagaggagccacctgattgtgtggcaggtgatgtatggaaatgaatag

SEQ ID NO: 171370 - DNA, 3534 bp, Artificial Sequence
  Description of Artificial Sequence: Synthetic coding sequence
atgagccctggctgcatgctgctgtttgtgtttggatttgtgggcggcgctgtggtgatcaacagcgccatcctggtgtccctgtctgtgctgctgctggtgcacttcagcatcagcactggagtgcctgccctgacccagaacctgccccgcatcctgaggaaggagcggcccatcagcctgggcatcttccccctgcctgctggagatggcctgctgaccccagatgcccagaagggcggggagaccccaggcagcgagcagtggaagttccaggagctgagccagcccaggagccacaccagcctgaaggatgagctgagtgatgtgtcccagggcggcagcaaggccaccaccccagccagcacagccaacagtgatgtggccaccatccccacagacacccccctgaaggaggagaatgaaggatttgtgaaggtgacagatgcccccaacaagtctgagatcagcaagcacatcgaggtgcaggtggcccaggagaccagaaatgtgtccactggatctgcagaaaatgaggagaagtctgaggtgcaggccatcatcgagagcaccccagagctggacatggacaaggacctgagcggctacaagggcagcagcacccccaccaagggcatcgagaacaaggcctttgacaggaacacagagagcctgtttgaggagctgagcagcgctggcagcggcctgattggagatgtggatgaaggagctgacctgctgggcatgggccgggaggtggagaacctgatcctggagaacacccagctgctggagaccaagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggccgaggatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagcagagaaaatcctgccatgcaggagaagaagaggagcagcatctggcagttcttcagccgcctcttcagcagcagcagcaacaccaccaagaagccagagccccctgtgaacctgaagtacaatgcccccaccagccacgtgaccccatctgtgaagaagaggagcagcaccctgagccagctgcccggggacaagagcaaggcctttgacttcctgtctgaggagacagaggccagcctggccagccggcgggagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagctgtggtgtgctgtgggcgtgaacctgagcggcggcaagaccagagatggcggctctgtggtgggcgcctctgtgttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaatggagccagccctgtgatggacaagcccccagagatggaggccgagaacagcgaggtggatgaaaatgtgcccacagctgaggaggccacagaggccacagagggcaatgccggcagcgctgaggacacagtggacatcagccagacaggagtgtacacagagcacgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccacagaggagtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccgtcatcctgcaccagggccgcctgctgggcctgcgggccaacaagaccagcggcgtgcccggcaaccggcccggcagcgtcatccgggtgtatggagatgagaacagcgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgactggagacaaggccggccccagcgcccaggagcccggcagccagacccccctgaagtccatgctggtgatctctggaggagagggctacatcgacttcaggatgggagatgaaggaggagagagcgagctgctgggggaggacctgcccctggagcccagcgtgaccaaggccgagaggagccacctgattgtgtggcaggtgatgtatggaaatgaatag

SEQ ID NO: 171371 - DNA, 2760 bp, Artificial Sequence
  Description of Artificial Sequence: Synthetic coding sequence
atggtgatgcgctggggcgagagaaatgatgtgattgcctgggagctgctgcaggatggagtggagaatgccctgaacatcgtgaagaatgacctgattgccaaggtggatgagctgacctgtgagaaggatgtgctgcagggcgagctggaggccgtgaagcaggccaagctgaagctggaggagaagaaccgggagctggaggaggagctgaggaaggcccgggcagaggctgaagatgcccggcagaaggccaaggatgatgatgacagcgacatccccacagcccagaggaagcgcttcaccagggtggagatggcccgggtgctgatggagaggaaccagtacaaggagcggctgatggagctgcaggaggccgtgcgctggacagagatgatccgggccagccgggagaacccagccatgcaggagaagaagaggagcagcatctggcagttcttcagccgcctcttcagcagcagcagcaacaccaccaagaagccagagccccctgtgaacctgaagtacaatgcccccaccagccacgtgacccccagcgtgaagaagaggagcagcaccctgagccagctgcccggggacaagagcaaggcctttgacttcctgtctgaggagacagaggccagcctggccagcagaagagagcagaagcgggagcagtaccggcaggtgaaggcccacgtgcagaaggaggatggccgggtgcaggccttcggctggagcctgccccagaagtacaagcaggtgaccaacggccagggcgagaacaagatgaagaacctgcctgtgcctgtgtacctgcggcccctggatgagaaggacacctccatgaagctgtggtgtgctgtgggcgtgaacctgagcggcggcaagaccagagatggcggctctgtggtgggcgccagcgtcttctacaaggatgtggccggcctggacacagagggcagcaagcagaggtctgccagccagagcagcctggacaagctggaccaggagctgaaggagcagcagaaggagctgaagaaccaggaggagctgagcagcctggtgtggatctgcaccagcacccacagcgccaccaaggtgctgatcattgatgctgtgcagcccggcaacatcctggacagcttcaccgtgtgcaacagccacgtgctgtgcatcgcctctgtgcctggggcccgggagacagactacccagctggggaggacctgtctgagagcggccaggtggacaaggccagcctgtgtggctccatgaccagcaacagcagcgctgagacagacagcctgctgggcggcatcaccgtggtgggctgcagcgctgagggcgtgactggagctgccaccagccccagcaccaacggggccagccctgtgatggacaagcccccagagatggaggctgaaaattctgaggtggatgaaaatgtgcccacagctgaggaggccacagaggccacagagggcaatgccggcagcgcagaagatactgtggacatcagccagacaggagtgtacacagaacatgtgttcacagaccccctgggcgtgcagatccctgaggacctgagccctgtgtaccagagcagcaatgacagtgatgcctacaaggaccagatctctgtgctgcccaatgagcaggacctggtgcgggaggaggcccagaagatgagcagcctgctgcccaccatgtggctgggcgcccagaatggctgcctgtatgtgcacagctctgtggcccagtggaggaagtgcctgcacagcatcaagctgaaggacagcatcctgagcatcgtgcacgtgaagggcatcgtgctggtggccctggctgatggcaccctggccatcttccaccggggcgtggatggccagtgggacctgagcaactaccacctgctggacctgggccggccccaccacagcatccgctgcatgacagtggtgcatgacaaggtgtggtgtggctacagaaacaagatctacgtggtgcagcccaaggccatgaagattgagaagagctttgatgcccaccccaggaaggagagccaggtgcggcagctggcctgggtgggagatggagtgtgggtgtccatccggctggacagcaccctgcggctgtaccacgcccacacctaccagcacctgcaggatgtggacatcgagccctacgtgtccaagatgctgggcaccgggaagctgggcttctcctttgtgcgcatcacagccctgatggtgtcctgcaaccggctgtgggtgggcactggaaatggagtcatcatcagcatccccctgacagagaccaacaagaccagcggcgtgcccggcaaccggcccggcagcgtcatccgggtgtatggagatgagaacagcgacaaggtgaccccaggcaccttcatcccctactgcagcatggcccacgcccagctgtgcttccacggccacagagatgctgtgaagttctttgtggccgtgcccggccaggtgatcagcccccagagcagcagcagcggcacagacctgactggagacaaggccggccccagcgcccaggagcccggcagccagacccccctgaagtccatgctggtgatctctggaggagagggctacatcgacttcaggatgggagatgaaggaggagagagcgagctgctgggggaggacctgcccctggagcccagcgtgaccaaggccgagaggagccacctgattgtgtggcaggtgatgtatggaaatgaatag

SEQ ID NO: 171372 - DNA, 825 bp, Artificial Sequence
  Description of Artificial Sequence: Synthetic coding sequence
atggagctggaggatggagtggtgtaccaggaggagcccggcggcagcggggctgtgatgtctgagcgggtgtctggcctggccggcagcatctaccgggagtttgagcggctgattggccgctatgatgaggaggtggtgaaggagctgatgcccctggtggtggccgtgctggagaacctggacagcgtgtttgcccaggaccaggagcaccaggtggagctggagctgctgagagatgacaatgagcagctgatcacccagtatgagcgggagaaggccctgaggaagcatgctgaggagaagttcatcgagtttgaggacagccaggagcaggagaagaaggacctgcagaccagggtggagagcctggagagccagacccggcagctggagctgaaggccaagaactatgctgaccagagcgccatgagccctggctgcatgctgctgtttgtgtttggatttgtgggcggcgctgtggtgatcaacagcgccatcctggtgtccctgtctgtgctgctgctggtgcacttcagcatcagcactggagtgcctgccctgacccagaacctgccccgcatcctgaggaaggagcggcccatcagcctgggcatcttccccctgcctgctggagatggcctgctgaccccagatgcccagaagggcggggagaccccaggcagcgagcagtggaagttccaggagctgagccagcccaggagccacaccagcctgaaggtgagcaacagccctgagccccagaaggctgtggagcaggaggtgaggatggtgctgctgaacatcctgcagaaggtgtactag

SEQ ID NO: 171373 - DNA, 1053 bp, Artificial Sequence
  Description of Artificial Sequence: Synthetic coding sequence
atgaagcccctggtgctgctggtggccctgctgctgtggcccagctctgtgcctgcctaccccagcatcaccgtgaccccagatgaggagcagaacctgaaccactacatccaggtgctggagaacctggtgcgctctgtgcccagcggggagcccggccgggagaagaagagcaacagccccaagcacgtgtacagcatcgccagcaagggcagcaagttcaaggagctggtgacccatggagatgccagcacagaaaatgatgtgctgaccaaccccatcagcgaggagaccaccaccttccccactggaggcttcaccccagagatcggcaagaagaagcacacagagagcacccccttctggagcatcaagcccaacaacgtgtccatcgtgctgcatgctgaggagccctacattgaaaatgaggagcctgagcctgagcctgagcctgctgccaagcagacagaggcccccaggatgctgcctgtggtgacagagagcagcaccagcccctacgtgaccagctacaagagccctgtgaccaccctggacaagagcacaggcatcggcatcagcacagaaagtgaagatgtgccccagctgtctggagaaacagccatcgagaagccagaggagtttgggaagcaccctgagagctggaacaatgatgacatcctgaagaagatcctggacatcaacagccaggtgcagcaggccctgctgagtgacaccagcaacccagcctaccgggaggacatcgaggccagcaaggaccacctgaagaggagcctggccctggccgctgctgctgagcacaagctgaagaccatgtacaagagccagctgctgcctgtgggccgcaccagcaacaagattgatgacatcgagaccgtcatcaacatgctgtgcaacagccgcagcaagctgtatgagtacctggacatcaagtgtgtgcccccagagatgagggagaaggccgccaccgtcttcaacaccctgaagaacatgtgccgcagcagaagagtgacagccctgctgaaggtgtactag

SEQ ID NO: 171374 - DNA, 711 bp, Artificial Sequence
  Description of Artificial Sequence: Synthetic coding sequence
atggccagctctgtggatgaggaggccctgcaccagctgtacctgtgggtggacaacatccccctgagccggcccaagaggaacctgagccgggacttcagtgatggagtgctggtggccgaggtgatcaagttctacttccccaagatggtggagatgcacaactacgtgcctgccaacagcctgcagcagaagctgagcaactggggccacctgaacaggaaggtgctgaagaggctgaacttctctgtgcctgatgatgtgatgaggaagatcgcccagtgtgcccctggggtggtggagctggtgctgatccccctgcggcagaggctggaggagcggcagaggaggaggaagcagggcgccggcagcctgcaggagctggccccccaggacggcagcggctacatggatgtgggcgtgtcccagaaggcccggggggagggcgtgcctgacccccagggcggcggccagctgtcctgggaccggcccccagccccccggcccccagcctacaacagagccctgcagggcgaccccagctttgtgctgcagattgctgagaaggagcaggagctgctggccagccaggagaccgtgcaggtgctgcagatgaaggtgcggcggctggagcacctgctgcagctgaagaatgtgagaattgaggacctgagccggcggctgcagcaggccgagaggaagcagaggtag

SEQ ID NO: 171375 - DNA, 351 bp, Artificial Sequence
  Description of Artificial Sequence: Synthetic coding sequence
atgtgtgaccagaccaagcacagcaagtgctgcccagccaagggcaaccagtgctgccccccccagcagaaccagtgctgccagagcaagggcaaccagtgctgcccccccaagcagaaccagtgctgccagcccaagggcagccagtgctgcccccccaagcacaaccactgctgccagcccaagccaccctgctgcatccaggcccgctgctgcggcctggagaccaagccagaggtgagccccctgaacatggagagcgagcccaacagcccccagacccaggacaagggctgccagacccagcagcagccccacagcccccagaatgaaagccggcccagcaagtag

SEQ ID NO: 171376 - DNA, 294 bp, Artificial Sequence; identical to SEQ ID NO: 171218
  Description of Artificial Sequence: Synthetic coding sequence

SEQ ID NO: 171377 - DNA, 2019 bp, Artificial Sequence
  Description of Artificial Sequence: Synthetic coding sequence
atgaggagcatccgcagctttgccaatgatgacagacatgtgatggtgaagcacagcaccatctaccccagccctgaggagctggaggccgtgcagaacatggtgtccacagtggagtgtgccctgaagcacgtgtctgactggctggatgagaccaacaagggcaccaagacagaaggagaaacagaggtgaagaaggatgaagctggggagaactacagcaaggaccagggcggccgcaccctgtgtggggtgatgagaattggcctggtggccaagggcctgctgatcaaggatgacatggacctggagctggtgctgatgtgcaaggacaagcccacagagaccctgctgaacacagtgaaggacaacctgcccatccagatccagaagctgacagaggagaagtaccaggtggagcagtgtgtgaatgaggccagcatcatcatccggaacaccaaggagcccaccctgaccctgaaggtgatcctgaccagccccctcatcagagatgagctggagaagaaggatggagaaaatgtgtccatgaaggaccccccagacctgctggaccggcagaagtgcctgaatgccctggccagcctgcggcatgccaagtggttccaggcccgggccaacggcctgaagagctgtgtgattgtgctgcgcatcctgcgggacctgtgcaacagagtgcccacctgggcccccctgaagggctggcccctggagctgatctgtgagaagagcatcggcacctgcaaccggcccctgggcgctggggaggccctgcggcgggtgatggagtgcctggccagcggcatcctgctgcccggcggccctggcctgcatgacccctgtgagcgggaccccacagatgccctgagctacatgaccatccagcagaaggaggacatcacccacagcgcccagcacgccctgcggctgagcgccttcggccagatctacaaggtgctggagatggaccccctgcccagcagcaagcccttccagaagtacagctggagcgtgacagacaaggagggcgccggcagcagcgccctgaagaggccctttgaagatggcctgggagatgacaaggaccccaacaagaagatgaagaggaacctgaggaagatcctggacagcaaggccatcgacctgatgaatgccctgatgaggctgaaccagatccggcccggcctgcagtacaagctgctgagccagagcggccctgtgcacgcccctgtgttcaccatgtctgtggatgtggatggcaccacctatgaggccagcggccccagcaagaagacagccaagctgcacgtggccgtgaaggtgctgcaggccatgggctaccccactggatttgatgctgacatcgagtgcatgagcagtgatgagaagagtgacaatgaaagcaagaatgagaccgtgagcagcaacagcagcaacaacacaggcaacagcaccacagagaccagcagcaccctggaggtgaggacccagggccccatcctgacagccagcggcaagaaccctgtgatggagctgaatgagaagaggcggggcctgaagtatgagctgatcagcgagactggaggcagccatgacaagagatttgtgatggaggtggaggtggatggccagaagttcagaggagctggccccaacaagaaggtggccaaggccagcgctgccctggccgccctggagaagctgttcagcggccccaatgctgccaacaacaagaagaagaagatcatcccccaggccaagggcgtggtgaacacagctgtgtctgctgctgtgcaggccgtgcggggccggggccggggcaccctgaccaggggggcctttgtgggcgccacagctgcccctggctacatcgcccctggctacggcaccccctacggctacagcacagctgccccagcctacggcctgcccaagaggatggtgctgctgcctgtgatgaagttccccacctaccctgtgccccactacagcttcttctag

SEQ ID NO: 171378 - DNA, 1977 bp, Artificial Sequence
  Description of Artificial Sequence: Synthetic coding sequence
atggtgaagcacagcaccatctaccccagccctgaggagctggaggccgtgcagaacatggtgtccacagtggagtgtgccctgaagcacgtgtctgactggctggatgagaccaacaagggcaccaagacagaaggagaaacagaggtgaagaaggatgaagctggggagaactacagcaaggaccagggcggccgcaccctgtgtggggtgatgagaattggcctggtggccaagggcctgctgatcaaggatgacatggacctggagctggtgctgatgtgcaaggacaagcccacagagaccctgctgaacacagtgaaggacaacctgcccatccagatccagaagctgacagaggagaagtaccaggtggagcagtgtgtgaatgaggccagcatcatcatccggaacaccaaggagcccaccctgaccctgaaggtgatcctgaccagccccctcatcagagatgagctggagaagaaggatggagaaaatgtgtccatgaaggaccccccagacctgctggaccggcagaagtgcctgaatgccctggccagcctgcggcatgccaagtggttccaggcccgggccaacggcctgaagagctgtgtgattgtgctgcgcatcctgcgggacctgtgcaacagagtgcccacctgggcccccctgaagggctggcccctggagctgatctgtgagaagagcatcggcacctgcaaccggcccctgggcgctggggaggccctgcggcgggtgatggagtgcctggccagcggcatcctgctgcccggcggccctggcctgcatgacccctgtgagcgggaccccacagatgccctgagctacatgaccatccagcagaaggaggacatcacccacagcgcccagcacgccctgcggctgagcgccttcggccagatctacaaggtgctggagatggaccccctgcccagcagcaagcccttccagaagtacagctggagcgtgacagacaaggagggcgccggcagcagcgccctgaagaggccctttgaagatggcctgggagatgacaaggaccccaacaagaagatgaagaggaacctgaggaagatcctggacagcaaggccatcgacctgatgaatgccctgatgaggctgaaccagatccggcccggcctgcagtacaagctgctgagccagagcggccctgtgcacgcccctgtgttcaccatgtctgtggatgtggatggcaccacctatgaggccagcggccccagcaagaagacagccaagctgcacgtggccgtgaaggtgctgcaggccatgggctaccccactggatttgatgctgacatcgagtgcatgagcagtgatgagaagagtgacaatgaaagcaagaatgagaccgtgagcagcaacagcagcaacaacacaggcaacagcaccacagagaccagcagcaccctggaggtgaggacccagggccccatcctgacagccagcggcaagaaccctgtgatggagctgaatgagaagaggcggggcctgaagtatgagctgatcagcgagactggaggcagccatgacaagagatttgtgatggaggtggaggtggatggccagaagttcagaggagctggccccaacaagaaggtggccaaggccagcgctgccctggccgccctggagaagctgttcagcggccccaatgctgccaacaacaagaagaagaagatcatcccccaggccaagggcgtggtgaacacagctgtgtctgctgctgtgcaggccgtgcggggccggggccggggcaccctgaccaggggggcctttgtgggcgccacagctgcccctggctacatcgcccctggctacggcaccccctacggctacagcacagctgccccagcctacggcctgcccaagaggatggtgctgctgcctgtgatgaagttccccacctaccctgtgccccactacagcttcttctag

SEQ ID NO: 171379 - DNA, 285 bp, Artificial Sequence
  Description of Artificial Sequence: Synthetic coding sequence
atgaggagcatccgcagctttgccaatgatgacagacatgtgatggtgaagcacagcaccatctaccccagccctgaggagctggaggccgtgcagaacatggtgtccacagtggagtgtgccctgaagcacgtgtctgactggctggatgagaccaacaagggcaccaagacagaaggagaaacagaggtgaagaaggatgaagctggggagaactacagcaagtggagcgacatcgtgtggtgcaatgaagactggccaggctgcaagaggctggccgactag

SEQ ID NO: 171380 - DNA, 2019 bp, Artificial Sequence; identical to SEQ ID NO: 171377
  Description of Artificial Sequence: Synthetic coding sequence

SEQ ID NO: 171381 - DNA, 225 bp, Artificial Sequence
  Description of Artificial Sequence: Synthetic coding sequence
atgaggagcatccgcagctttgccaatgatgacagacatgtgatggtgaagcacagcaccatctaccccagccctgaggagctggaggccgtgcagaacatggtgtccacagtggagtgtgccctgaagcacgtgtctgactggctggatgagaccaacaagggcaccaagacagaaggagaaacagaggtgaagaaggatgaagctggggagaactacagctag

SEQ ID NO: 171382 - DNA, 1776 bp, Artificial Sequence
  Description of Artificial Sequence: Synthetic coding sequence
atgagcctgctgaccaactatgagggcctgcggcaccagatcgagcggctggtgcgggagaatgaggagctgaagaagctggtgcggctcatcagagaaaatcatgagctgaagagcgccatcaagacccaggccggcggcctgggcatcagcggcttcaccagcggcctgggggaggccacagctggcctgagcagccggcagaacaacggggtcttcctgccccccagccctgctgtggccaatgaaagagtgctggaggaggtgggcatcatggccctggcccccctggccgagatgctgaccagcctgcagcccagcgccaccccaggcagcctgatgagccccctgaccggcaccctgagcaccctgctgagcggccctgcccccaccagccagagcagccccctgaccagcttcctgaccagccccatcgccggccccctgaccggcaccctggccagcagcctgggcctgcccagcacaggcaccctgacccccagcagcctggtggccggccctgtggccatgagccagagcagccccctcatcgcccctgtgatgggcaccgtggccgtgtccctgagcagccccctgctgagcagcacagccaccccacctggggtgtcccagaacctgctggccaaccccatgagcaacctggtgctgcctgaggccccccggctgcggctggccgagcccctgcggggcggccccaccggcccccagagccctgcctgtgtggtgcccacagccaccaccaaggtgcccctgagcacagagcccccccagagcacccaggaccctgagcccctgtccatggcctttgctggggcccccctgcagaccagcacccccatcggggccatgggcaccccagcccccaagacagccttctccttcaacaccagtgacacccaggcccagcccagcgctgcccaggagcaggtggtgcctgcctctgtgcccaccagccccaccaccagccccaccgtgacagtgctggccagcgccccagccctggccccccaggtggccaccagctacacccccagcagcaccacccacatcgcccagggcgccccccacccccccagcaggatgcacaacagccccacccagaacctgcctgtgccccactgccccccccacaatgcccacagcccccccaggaccagcagcagccctgcctctgtgaatgacagccggggccccaggaccacagagcccagcaccaagtccatgatggaggtggagaggaagctggcccacaggaagaccagcaagtttcctgagaacccccgggagagcaagcagctggcctgggagcggctggtgggggagatcgccttccagctggaccggcgcatcctgagcagcatcttccctgagcgggtgcggctgtatggcttcaccgtgagcaacatccctgagaagatcatccaggccagcctgaaccccagcgaccacaagctggatgagaagctgtgccagaggctgacccagcgctacgtgtctgtgatgaaccggctgcagagcctgggctacaacggccgggtgcacccagccctgacagagcagctggtgaatgcctacggcatcctgcgggagaggcctgagctggccgccagcgagggcggcccctacacagtggacttcctgcagagggtggtggtggagaccgtgcaccctggcatgctggctgatgccctgctgctgctgagctgcctgagccagctggcccatgatgatggcaagcccatgttcatctggtag

SEQ ID NO: 171383 - DNA, 1326 bp, Artificial Sequence
  Description of Artificial Sequence: Synthetic coding sequence
atgagcctgctgaccaactatgagggcctgcggcaccagatcgagcggctggtgcgggagaatgaggagctgaagaagctggtgcggctcatcagagaaaatcatgagctgaagagcgccatcaagacccaggccggcggcctgggcatcagcggcttcaccagcggcctgggggaggccacagctggcctgagcagccggcagaacaacggggtcttcctgccccccagccctgctgtggccaatgaaagagtgctggaggaggtgggcatcatggccctggcccccctggccgagatgctgaccagcctgcagcccagcgccaccccaggcagcctgatgagccccctgaccggcaccctgagcaccctgctgagcggccctgcccccaccagccagagcagccccctgaccagcttcctgaccagccccatcgccggccccctgaccggcaccctggccagcagcctgggcctgcccagcacaggcaccctgacccccagcagcctggtggccggccctgtggccatgagccagagcagccccctcatcgcccctgtgatgggcaccgtggccgtgtccctgagcagccccctgctgagcagcacagccaccccacctggggtgtcccagaacctgctggccaaccccatgagcaacctggtgctgcctgaggccccccggctgcggctggccgagcccctgcggggcggccccaccggcccccagagccctgcctgtgtggtgcccacagccaccaccaaggtgcccctgagcacagagcccccccagagcacccaggaccctgagcccctgtccatggcctttgctggggcccccctgcagaccagcacccccatcggggccatgggcaccccagcccccaagacagccttctccttcaacaccagtgacacccaggcccagcccagcgctgcccaggagcaggtggtgcctgcctctgtgcccaccagccccaccaccagccccaccgtgacagtgctggccagcgccccagccctggccccccaggtggccaccagctacacccccagcagcaccacccacatcgcccagggcgccccccacccccccagcaggatgcacaacagccccacccagaacctgcctgtgccccactgccccccccacaatgcccacagcccccccaggaccagcagcagccctgcctctgtgaatgacagccggggccccaggaccacagagcccagcaccaagtccatgatggaggtggagaggaagctggcccacaggaagaccagcaagtttcctgagaacccccggggcttccctgagccccagtag

SEQ ID NO: 171384 - DNA, 573 bp, Artificial Sequence
  Description of Artificial Sequence: Synthetic coding sequence
atgagcagcagcgccctgacctgtggcagcaccctggagaagagcggggacacctgggagatgaaggccctggacagcagccggctggtgccctggccaccccggggcctgggcagcagcacccagcaccccaacaagccccactgtgccctggccagctgccagggccctggggtgctgcctggagctgccagcgccctgcctgagctgaccttccagggagatgtgtgccagagcgagacctgccagcgctacctgcaggccgccatcagcctggacattgctgtgtcccagatcaacctgctgggccggcccagcagccccccagccctgctgatccagcagggcagctgtgagcaggtgatccacaacagcaccccccagttcctgggcatggaggatggagacaatgaaagaaccaccggctggctgtggaggctgtgtgaagatattgatgctgagcccagcagcacaggctgcagccgcagcaaccagctgaccttcacagagggctgctttgtgcgcagcctgagcacagtgtacagcaacacccacatccacacccacctgtag

SEQ ID NO: 171385 - DNA, 1791 bp, Artificial Sequence
  Description of Artificial Sequence: Synthetic coding sequence
atgggcttcatcatccacatccagcaggtgaagaagcagaggaagaagctggaccagggcctcatcctgaagaaggagaagtacaggaaggagaagaagtgtgccagcctgagctttgaggtgtccagtgatggcggcacagagcccagcgccctggtggatgacaatggcagcgaggaggacttctcctatgaggacctgtgccaggccagcccccgctacctgcagcctggaggagagcagctggccatcaatgaactcatcagtgatggaaatgtggtgtgtgccgaggccctgtgggaccacgtgaccatggatgaccaggagctgggcttcaaggctggagatgtgatccaggtgctggaggccagcaacaaggactggtggtggggccgctctgaggacaaggaggcctggttccctgccagctttgtgcggctgcgggtgaaccaggaggagctgtctgagaacagcagcagcaccccatctgaggagcaggatgaggaggccagccagagccgccaccgccactgtgagaacaagcagcagatgaggaccaacgtcatccgggagatcatggacacagagcgggtgtacatcaagcacctgcgggacatctgtgagggctacatccggcagtgcaggaagcacacaggcatgttcaccgtggcccagctggccaccatcttcggcaacatcgaggacatctacaagttccagaggaagttcctgaaggacctggagaagcagtacaacaaggaggagccccacctgtctgaaattggcagctgcttcctgcagaaccaggagggctttgccatctacagcgagtactgcaacaaccaccctggggcctgcctggagctggccaacctgatgaagcagggcaagtaccgccacttctttgaggcctgccgcctgctgcagcagatgattgacatcgccattgatggcttcctgctgacccctgtgcagaagatctgcaagtaccccctgcagctggccgagctgctgaagtacaccacccaggagcacggggactacagcaacatcaaggccgcctatgaggccatgaagaatgtggcctgcctgatcaatgaaaggaagaggaagctggagagcattgacaagatcgcccgctggcaggtgtccatcgtgggctgggagggcctggacatcctggacaggagcagcgagctgatccacagcggggagctgaccaagatcaccaagcagggcaagagccagcagaggaccttcttcctgtttgaccaccagctggtgtcctgcaagaaggacctgctgcggcgggacatgctgtactacaagggccgcctggacatggatgagatggagctggtggacctgggagatggccgggacaaggactgcaacctgtctgtgaagaatgccttcaagctggtgtccaggaccacagatgaggtgtacctgttctgtgccaagaagcaggaggacaaggcccgctggctgcaggcctgtgctgatgagaggagaagagtgcaggaggacaaggagatgggcatggagatcagcgagaaccagaagaagctggccatgctgaatgcccagaaggccggccacggcaagagcaagggctacaaccgctgccctgtggccccaccccaccagggcctgcaccccatccaccagaggcacatcaccatgcccacctctgtgccccagcagcaggtgtttggcctggccgagcccaagaggaagagcagcctcttctggcacaccttcaaccggctgacccccttcaggaagtag

SEQ ID NO: 171386 - DNA, 1959 bp, Artificial Sequence
  Description of Artificial Sequence: Synthetic coding sequence
atgaccagcgccagccctgaggaccagaatgcccctgtgggctgccccaagggggccaggagaagaagacccatcagcgtcatcggcggcgtgtccctgtatggcaccaaccagacagaggagctggacaacctgctgacccagcctgccagcaggcctcccatgcctgcccaccaggtgcccccctacaaggctgtgtctgcccgcttccggcccttcaccttcagccagagcacccccatcggcctggacagagtgggcagaagacggcagatgagggccagcaatgtgtccagtgatggcggcacagagcccagcgccctggtggatgacaatggcagcgaggaggacttctcctatgaggacctgtgccaggccagcccccgctacctgcagcctggaggagagcagctggccatcaatgaactcatcagtgatggaaatgtggtgtgtgccgaggccctgtgggaccacgtgaccatggatgaccaggagctgggcttcaaggctggagatgtgatccaggtgctggaggccagcaacaaggactggtggtggggccgctctgaggacaaggaggcctggttccctgccagctttgtgcggctgcgggtgaaccaggaggagctgtctgagaacagcagcagcaccccatctgaggagcaggatgaggaggccagccagagccgccaccgccactgtgagaacaagcagcagatgaggaccaacgtcatccgggagatcatggacacagagcgggtgtacatcaagcacctgcgggacatctgtgagggctacatccggcagtgcaggaagcacacaggcatgttcaccgtggcccagctggccaccatcttcggcaacatcgaggacatctacaagttccagaggaagttcctgaaggacctggagaagcagtacaacaaggaggagccccacctgtctgaaattggcagctgcttcctgcagaaccaggagggctttgccatctacagcgagtactgcaacaaccaccctggggcctgcctggagctggccaacctgatgaagcagggcaagtaccgccacttctttgaggcctgccgcctgctgcagcagatgattgacatcgccattgatggcttcctgctgacccctgtgcagaagatctgcaagtaccccctgcagctggccgagctgctgaagtacaccacccaggagcacggggactacagcaacatcaaggccgcctatgaggccatgaagaatgtggcctgcctgatcaatgaaaggaagaggaagctggagagcattgacaagatcgcccgctggcaggtgtccatcgtgggctgggagggcctggacatcctggacaggagcagcgagctgatccacagcggggagctgaccaagatcaccaagcagggcaagagccagcagaggaccttcttcctgtttgaccaccagctggtgtcctgcaagaaggacctgctgcggcgggacatgctgtactacaagggccgcctggacatggatgagatggagctggtggacctgggagatggccgggacaaggactgcaacctgtctgtgaagaatgccttcaagctggtgtccaggaccacagatgaggtgtacctgttctgtgccaagaagcaggaggacaaggcccgctggctgcaggcctgtgctgatgagaggagaagagtgcaggaggacaaggagatgggcatggagatcagcgagaaccagaagaagctggccatgctgaatgcccagaaggccggccacggcaagagcaagggctacaaccgctgccctgtggccccaccccaccagggcctgcaccccatccaccagaggcacatcaccatgcccacctctgtgccccagcagcaggtgtttggcctggccgagcccaagaggaagagcagcctcttctggcacaccttcaaccggctgacccccttcaggaagtag

SEQ ID NO: 171387 - DNA, 3834 bp, Artificial Sequence
  Description of Artificial Sequence: Synthetic coding sequence
atgacccaggccgctgtgcggccctgggccccctgcctggagaacatgaccacagccccaaatggcctgggccctggccctgctgccccctgtgccggcagtgacctgaaggatgccaagatggtgaccagcctggcctgtggaaatggagtgtgtggctgcagccctggaggagacacagacacccaggaggccaagctgagccctgccaagctggtgcggctcttcagcaccagcaggaagaggactggagcccaccctgagcggccccacagcatggtgctggtgggcaacagcagcacctggaacaccctggccagcttcaggaagatgggcagcttcaagaagctgaagagctctgtgctgaagggcatccagagccgggagggcagcaatgcctgcagcaagggggaggccagcgagcacggcctgggcaagagcatccccaacggggctgtgcctggggcccaggccagccggggcagccccctggcccctggccctgcctgtggggccctgcggcctgctgagtggggcaccctggatggcagtgacctggaggacacagatgatgccttccagaggagcacccacaggagccgcagcctgcggcgggcctacggcctgggccgcatctgcctgctggatgccccccagaaccacgccacccccaccatcgccaccggccaggtgcctgctgtgtgtgagatcctggtgcgggaccctgagaacaacagcatgggctaccgccgcagcaagagcacagacaacctggccttcctgaagaagagcagcttcaagaggaagagcaccagcaacctggccgacctgaggacagcccatgatgcccgggtgccccagaggaccctgagcagcagcagcacagacagccagaagctgggcagcggccgcaccaagcgctggaggagccccatccgggccaaggactttgacagagtcttcaagctggtgtccaatgtgacagaggccgcctggaggcgggagagccccaggtctggggcccccagccctggagaggccagcctgcggctgcaggcccacagccggctgcatgatgactacagcagaagagtgagccgcagcacagagcaggacagccggcggggcggcgctgtgatgcacggcaccacagccacctgcaccgtggcccctggctttggaagtgccaccagcaagggcccccacctggatgctgacacagctgtgttccccctggagaccaagagctcctgggccgtggagagtgacagcagctgcacctgcagcagcctgcccagccccatcgtgcaggatgtgctgagcaaggacagctgtgaccccaatgccggcagccagctgacctttgatcctgagcagccccccacccccctgcggcccaccacccccaagccccagagcccccagagcccccagagccctggggccggcagcgccagctgccacagcaaccacagcgccctgagcgccaacagcgaggagagcgagggccgggcagaggagcccgcccagcgggagcccggccctgtgtccctgcaggaccccctggaggccacccatggagatgagggcagcaaggacctgctggtgaacatcggcgtggccgccggccctgaggagaaggagaaggaggaggtggtgcctgatggcccctggaggaggagcagcagccaggatgaggagaggacagaggcccagaggacccccaagaggcgctggggcagcggcagaagaccccggccccggcccttcagtgactatggccagctggccagccgcagcctgagcatcccagaagattctgtggccgctgacccccagaaggaggacagagtggatgaggacccccaggcctccatgaccagcgccagccctgaggaccagaatgcccctgtgggctgccccaagggggccaggagaagaagacccatctctgtgattggaggagtgtccctgtatggcaccaaccagacagaggagctggacaacctgctgacccagcctgccagccggccccccatgcctgcccaccaggtgcccccctacaaggctgtgtctgcccgcttccggcccttcaccttcagccagagcacccccatcggcctggacagagtgggcagaagacggcagatgagggccagcaatgtgtccagtgatggcggcacagagcccagcgccctggtggatgacaatggaagtgaggaggacttctcctatgaggacctgtgccaggccagcccccgctacctgcagcccggcggggagcagctggccatcaatgagctgatcagtgatggaaatgtggtgtgtgccgaggccctgtgggaccacgtgaccatggatgaccaggagctgggcttcaaggctggagatgtgatccaggtgctggaggccagcaacaaggactggtggtggggccgctctgaggacaaggaggcctggttccctgccagctttgtgcggctgcgggtgaaccaggaggagctgtctgagaacagcagcagcacccccagcgaggagcaggatgaggaggccagccagagccgccaccgccactgtgagaacaagcagcagatgaggaccaacgtcatccgggagatcatggacacagagcgggtgtacatcaagcacctgcgggacatctgtgagggctacatccggcagtgcaggaagcacacaggcatgttcaccgtggcccagctggccaccatctttggaaatattgaggacatctacaagttccagaggaagttcctgaaggacctggagaagcagtacaacaaggaggagccccacctgtctgagatcggcagctgcttcctgcagaaccaggagggctttgccatctacagcgagtactgcaacaaccaccctggggcctgcctggagctggccaacctgatgaagcagggcaagtaccgccacttctttgaggcctgccgcctgctgcagcagatgattgatattgccattgatggcttcctgctgacccctgtgcagaagatctgcaagtaccccctgcagctggccgagctgctgaagtacaccacccaggagcacggggactacagcaacatcaaggccgcctatgaggccatgaagaatgtggcctgcctgatcaatgaaaggaagaggaagctggagagcattgacaagatcgcccgctggcaggtgtccatcgtgggctgggagggcctggacatcctggacaggagcagcgagctgatccacagcggggagctgaccaagatcaccaagcagggcaagagccagcagaggaccttcttcctgtttgaccaccagctggtgtcctgcaagaaggacctgctgcggcgggacatgctgtactacaagggccgcctggacatggatgagatggagctggtggacctgggagatggccgggacaaggactgcaacctgtctgtgaagaatgccttcaagctggtgtccaggaccacagatgaggtgtacctgttctgtgccaagaagcaggaggacaaggcccgctggctgcaggcctgtgctgatgaaagaagaagagtgcaggaggacaaggagatgggcatggagatcagcgagaaccagaagaagctggccatgctgaatgcccagaaggccggccacggcaagagcaagggctacaaccgctgccctgtggccccaccccaccagggcctgcaccccatccaccagaggcacatcaccatgcccacctctgtgccccagcagcaggtgtttggcctggccgagcccaagaggaagagcagcctcttctggcacaccttcaaccggctgacccccttcaggaagtag

SEQ ID NO: 171388 - DNA, 3948 bp, Artificial Sequence
  Description of Artificial Sequence: Synthetic coding sequence
tgacctgtggccacccaggagccagatgtgcagggccgctgtgagtgccaggacggcatccctggagatgagggcctggagctgcggtctgctgacagcgctgtgcctgtggccatgacccaggccgctgtgcggccctgggccccctgcctggagaacatgaccacagccccaaatggcctgggccctggccctgctgccccctgtgccggcagtgacctgaaggatgccaagatggtgaccagcctggcctgtggaaatggagtgtgtggctgcagccctggaggagacacagacacccaggaggccaagctgagccctgccaagctggtgcggctcttcagcaccagcaggaagaggactggagcccaccctgagcggccccacagcatggtgctggtgggcaacagcagcacctggaacaccctggccagcttcaggaagatgggcagcttcaagaagctgaagagctctgtgctgaagggcatccagagccgggagggcagcaatgcctgcagcaagggggaggccagcgagcacggcctgggcaagagcatccccaacggggctgtgcctggggcccaggccagccggggcagccccctggcccctggccctgcctgtggggccctgcggcctgctgagtggggcaccctggatggcagtgacctggaggacacagatgatgccttccagaggagcacccacaggagccgcagcctgcggcgggcctacggcctgggccgcatctgcctgctggatgccccccagaaccacgccacccccaccatcgccaccggccaggtgcctgctgtgtgtgagatcctggtgcgggaccctgagaacaacagcatgggctaccgccgcagcaagagcacagacaacctggccttcctgaagaagagcagcttcaagaggaagagcaccagcaacctggccgacctgaggacagcccatgatgcccgggtgccccagaggaccctgagcagcagcagcacagacagccagaagctgggcagcggccgcaccaagcgctggaggagccccatccgggccaaggactttgacagagtcttcaagctggtgtccaatgtgacagaggccgcctggaggcgggagagccccaggtctggggcccccagccctggagaggccagcctgcggctgcaggcccacagccggctgcatgatgactacagcagaagagtgagccgcagcacagagcaggacagccggcggggcggcgctgtgatgcacggcaccacagccacctgcaccgtggcccctggctttggaagtgccaccagcaagggcccccacctggatgctgacacagctgtgttccccctggagaccaagagctcctgggccgtggagagtgacagcagctgcacctgcagcagcctgcccagccccatcgtgcaggatgtgctgagcaaggacagctgtgaccccaatgccggcagccagctgacctttgatcctgagcagccccccacccccctgcggcccaccacccccaagccccagagcccccagagcccccagagccctggggccggcagcgccagctgccacagcaaccacagcgccctgagcgccaacagcgaggagagcgagggccgggcagaggagcccgcccagcgggagcccggccctgtgtccctgcaggaccccctggaggccacccatggagatgagggcagcaaggacctgctggtgaacatcggcgtggccgccggccctgaggagaaggagaaggaggaggtggtgcctgatggcccctggaggaggagcagcagccaggatgaggagaggacagaggcccagaggacccccaagaggcgctggggcagcggcagaagaccccggccccggcccttcagtgactatggccagctggccagccgcagcctgagcatcccagaagattctgtggccgctgacccccagaaggaggacagagtggatgaggacccccaggcctccatgaccagcgccagccctgaggaccagaatgcccctgtgggctgccccaagggggccaggagaagaagacccatctctgtgattggaggagtgtccctgtatggcaccaaccagacagaggagctggacaacctgctgacccagcctgccagccggccccccatgcctgcccaccaggtgcccccctacaaggctgtgtctgcccgcttccggcccttcaccttcagccagagcacccccatcggcctggacagagtgggcagaagacggcagatgagggccagcaatgtgtccagtgatggcggcacagagcccagcgccctggtggatgacaatggaagtgaggaggacttctcctatgaggacctgtgccaggccagcccccgctacctgcagcccggcggggagcagctggccatcaatgagctgatcagtgatggaaatgtggtgtgtgccgaggccctgtgggaccacgtgaccatggatgaccaggagctgggcttcaaggctggagatgtgatccaggtgctggaggccagcaacaaggactggtggtggggccgctctgaggacaaggaggcctggttccctgccagctttgtgcggctgcgggtgaaccaggaggagctgtctgagaacagcagcagcacccccagcgaggagcaggatgaggaggccagccagagccgccaccgccactgtgagaacaagcagcagatgaggaccaacgtcatccgggagatcatggacacagagcgggtgtacatcaagcacctgcgggacatctgtgagggctacatccggcagtgcaggaagcacacaggcatgttcaccgtggcccagctggccaccatctttggaaatattgaggacatctacaagttccagaggaagttcctgaaggacctggagaagcagtacaacaaggaggagccccacctgtctgagatcggcagctgcttcctgcagaaccaggagggctttgccatctacagcgagtactgcaacaaccaccctggggcctgcctggagctggccaacctgatgaagcagggcaagtaccgccacttctttgaggcctgccgcctgctgcagcagatgattgatattgccattgatggcttcctgctgacccctgtgcagaagatctgcaagtaccccctgcagctggccgagctgctgaagtacaccacccaggagcacggggactacagcaacatcaaggccgcctatgaggccatgaagaatgtggcctgcctgatcaatgaaaggaagaggaagctggagagcattgacaagatcgcccgctggcaggtgtccatcgtgggctgggagggcctggacatcctggacaggagcagcgagctgatccacagcggggagctgaccaagatcaccaagcagggcaagagccagcagaggaccttcttcctgtttgaccaccagctggtgtcctgcaagaaggacctgctgcggcgggacatgctgtactacaagggccgcctggacatggatgagatggagctggtggacctgggagatggccgggacaaggactgcaacctgtctgtgaagaatgccttcaagctggtgtccaggaccacagatgaggtgtacctgttctgtgccaagaagcaggaggacaaggcccgctggctgcaggcctgtgctgatgaaagaagaagagtgcaggaggacaaggagatgggcatggagatcagcgagaaccagaagaagctggccatgctgaatgcccagaaggccggccacggcaagagcaagggctacaaccgctgccctgtggccccaccccaccagggcctgcaccccatccaccagaggcacatcaccatgcccacctctgtgccccagcagcaggtgtttggcctggccgagcccaagaggaagagcagcctcttctggcacaccttcaaccggctgacccccttcaggaagtag

SEQ ID NO: 171389 - DNA, 1851 bp, Artificial Sequence
  Description of Artificial Sequence: Synthetic coding sequence
atgcctgcccaccaggtgcccccctacaaggctgtgtctgcccgcttccggcccttcaccttcagccagagcacccccatcggcctggacagagtgggcagaagacggcagatgagggccagcaatgtgtccagtgatggcggcacagagcccagcgccctggtggatgacaatggcagcgaggaggacttctcctatgaggacctgtgccaggccagcccccgctacctgcagcctggaggagagcagctggccatcaatgaactcatcagtgatggaaatgtggtgtgtgccgaggccctgtgggaccacgtgaccatggatgaccaggagctgggcttcaaggctggagatgtgatccaggtgctggaggccagcaacaaggactggtggtggggccgctctgaggacaaggaggcctggttccctgccagctttgtgcggctgcgggtgaaccaggaggagctgtctgagaacagcagcagcaccccatctgaggagcaggatgaggaggccagccagagccgccaccgccactgtgagaacaagcagcagatgaggaccaacgtcatccgggagatcatggacacagagcgggtgtacatcaagcacctgcgggacatctgtgagggctacatccggcagtgcaggaagcacacaggcatgttcaccgtggcccagctggccaccatcttcggcaacatcgaggacatctacaagttccagaggaagttcctgaaggacctggagaagcagtacaacaaggaggagccccacctgtctgaaattggcagctgcttcctgcagaaccaggagggctttgccatctacagcgagtactgcaacaaccaccctggggcctgcctggagctggccaacctgatgaagcagggcaagtaccgccacttctttgaggcctgccgcctgctgcagcagatgattgacatcgccattgatggcttcctgctgacccctgtgcagaagatctgcaagtaccccctgcagctggccgagctgctgaagtacaccacccaggagcacggggactacagcaacatcaaggccgcctatgaggccatgaagaatgtggcctgcctgatcaatgaaaggaagaggaagctggagagcattgacaagatcgcccgctggcaggtgtccatcgtgggctgggagggcctggacatcctggacaggagcagcgagctgatccacagcggggagctgaccaagatcaccaagcagggcaagagccagcagaggaccttcttcctgtttgaccaccagctggtgtcctgcaagaaggacctgctgcggcgggacatgctgtactacaagggccgcctggacatggatgagatggagctggtggacctgggagatggccgggacaaggactgcaacctgtctgtgaagaatgccttcaagctggtgtccaggaccacagatgaggtgtacctgttctgtgccaagaagcaggaggacaaggcccgctggctgcaggcctgtgctgatgagaggagaagagtgcaggaggacaaggagatgggcatggagatcagcgagaaccagaagaagctggccatgctgaatgcccagaaggccggccacggcaagagcaaggtgcggctgcagcaggtgccctgtggccccacagcccctggccctgccccccaccccccagccccccaccactacgcccacaagaggcccccagctgctggcctgtggccaggcggcacccaggaggaggtgctggccctgctggcccacctgcagcaggcccaccccctgcctgagatgaagacaggaggctgtgcctccatggagctgggcgtgaagagaagaaattag

SEQ ID NO: 171390 - DNA, 1710 bp, Artificial Sequence
  Description of Artificial Sequence: Synthetic coding sequence
atggatgctggcagcagccgcagcctggagaatgctgtgaaccgcatctaccatgaccagctggtgcccaagatcaacaccagcaagaagatgagcaccctggcccacccccccaacatcctggagatgagccaggagatcaagaagaactgtggcggcaagcaggtggagatcaccctggagaggaccaagatgaccaagggcatcaaggagaagcagagcaatgacctggagaaggccgccttcaagaggaaggccgagggggaggagaagcccaccaggaagaagcaggccaagatcacagagctggacaaccagctgatcaccatgcccctgccccacatccccctgaagaacatcatggatgtggagatgaagctggtgtacattgatgagatgggcgtgcgctatgaatttgtggagagcttcatgagcacaggcagccagcccacctgccaggccgctgagatcgtggaccccctgtctgtgcacaacttctccttcctgccccagattgacaagtggctgcaggtggccctgaaggatgccagcagctgctaccggcagaagaagtatgccctggccgccggccagttcagaacagccctggagctgtgcagcaaaggagctgtgctgggggagccctttgatgccccagcagaagatattgcctctgtggccagcttcatcgagaccaagctggtgacctgctacctgaggatgaggaagccagacctggccctgaaccacgcccacaggagcatcgtgctgaacccagcctacttcaggaaccacctgcggcaggccaccgtcttccgctgcctggagcgctacagcgaggccgcccggagcgccatgattgctgactacatgttctggctgggcggcggccgggaggagagcatcagcaagctgatcaagctgtactggcaggccatgattgaggaggccatcaccagggctgagagcttctctgtgatgtacaccccatttgccaccaagatccgggctgacaagattgagaaggtgaaggatgccttcaccaagacccacccagcctatgcagagtacatgtacacagacctgcaggccctgcacatgctgccccagacagtggactggagcagcttccccccccagcagtacctgctgaccctgggcttcaagaacaaggatgatggcaagttcctggagaagatcagcagcaggaagctgcccatcttcacagagcacaagaccccatttggcctgacccgggaggacacagtgcggcagatggagaccatgggcaagaggatcctgcccatcctggacttcatccgcagcacccagctgaatggcagcttccctgccagcagtggagtgatggagaagctgcagtatgccagcctgctgagccagctgcagagggtgaaggagcagagccaggtgatcaaccaggccatggccgagctggccaccatcccctacctgcaggacatcagccagcaggaggccgagctgctgcagagcctgatggctgatgccatggacaccctggagggcagaagaaacaacaatgaaagagtgtggaacatgatccagaaggtgggccagatcgaggacttcctgtaccagctggaggacagcttcctgaagaccaagaagctgaggacagcccggcggcagaagaccaagatgaagaggctgcagacagtgcagcagaggtag

SEQ ID NO: 171391 - DNA, 1086 bp, Artificial Sequence
  Description of Artificial Sequence: Synthetic coding sequence
atggccaccctggcccggctgcaggcccggagcagcacagtgggcaaccagtactacttcagaaattctgtggtggaccccttcaggaagaaggaaaatgatgctgctgtgaagatccagagctggttccggggctgccaggtgcgggcctacatccgccacctgaaccgcatcgtgaccatcatccagaagtggtggaggagcttcctgggcaggaagcagtaccagctgactgtgcaggtggcctactacaccatgatgatgaacctgtacaatgccatggctgtgcgcatccagaggcgctggaggggctacagagtgaggaagtacctgttcaactactactacctgaaggagtacctgaaggtggtgtctgagaccaatgatgccatcaggaaggccctggaggagtttgctgagatgaaggagcgggaggagaagaaggccaacctggagcgggaggagaagaagagggactaccaggccaggaagatgcactacctgctgagcaccaagcagatccctggcatctacaacagccccttcaggaaggagccagacccctgggagctgcagctgcagaaggccaagcccctgacccaccggcggcccaaggtgaagcagaaggacagcaccagcctgacagactggctggcctgcaccagcgcccgctccttccccaggtctgagatcctgccccccatcaacaggaagcagtgccagggccccttccgggacatcacagaggtgctggagcagcgctaccggcccctggagcccaccctgcgggtggccgagcccattgatgagctgaagctggcccgggaggagctgcggcgggaggagtggctgcagaatgtgaatgacaacatgttcctgcccttcagcagctaccacaagaatgagaagtacatccccagcatgcacctgagcagcaaatatggccccatctcctacaaggagcagttccgctctgagaaccccaagaagtggatctgtgacaaggacttccagacagtgctgcccagctttgagctgttcagcaaatatggcaagctgtacagcaaggccggccagatcgtgtag

SEQ ID NO: 171392 - DNA, 1617 bp, Artificial Sequence
  Description of Artificial Sequence: Synthetic coding sequence
atggccgagaacctgaagaggctggtgtccaatgagaccctgcggaccctgcaggagaagctggacttctggctgaaggagtacaacaccaacacctgtgaccagaacctgaaccactgcctggagctgattgagcaggtggccaaggtgcagggccagctgtttggcatcctgacagctgctgcccaggagggcggcagaaatgatggagtggagaccatcaagagccggctgctgccctggctggaggccagcttcaccgctgccagcctgggcaagtctgtggacagcaaggtgcccagcctgcaggacacctttgaccgggagcggcacaaggaccccagcccccgggaccgggacatgcagcagctggacagcaacctgaacagcaccaggagccagtgcaaccaggtgcaggatgacctggtggagacagagaagaacctggaggagagcaagaacagaagtgccatcagcctgctggccgctgaggaggagatcaaccagctgaagaagcagctgaagagcctgcaggcccaggaggatgcccggcacaggaacacagaccagaggagcagcgagaacagaagaagtgagccctggagcctggaggagaggaagcgggagcagtggaacagcctgaagcagaatgctgaccagcaggacacagaggccatgtctgactacaagaagcagctgaggaacctgaaggaggagattgctgtgctgtctgctgagaagagcgccctgcagggccgcagcagccgcagccgcagccccagccctgcccccaggagccgcagctgcagccgcagccgcagcgccagccccagcacagctgtgaaggtgcggcggcccagccccaacagaagcaagctgagcaatgtggccaggaaggccgccctgctgagccgcttcagtgacagctacagccaggcccggctggatgcccagtgcctgctgcggcgctgcatcgacaaggccgagaccgtgcagaggatcatctacatcgccaccgtggaggccttccacgtggccaagatggccttccgccacttcaagatccacgtgaggaagagcctgacccccagctatgtgggcagcaatgactttgaaaatgctgtgctggactatgtgatctgccacctggacctgtatgacagccagagctctgtgaatgatgtgatccgggccatgaatgtgaaccccaagatctccttcccccctgtggtggacttctgcctgctgagtgacttcatccaggagatctgctgcatcgcctttgccatgcaggccctggagccccccctggacatcgcctatggagcagatggagaggtgttcaatgactgcaagtaccgccgctcctatgacagcgacttcaccgcccccctggtgctgtaccacgtgtggccagccctgatggagaatgactgtgtgatcatgaagggggaggccgtgaccaggagaggagccttctggaacagcgtgcgctctgtgagccgctgccgcagccgcagcctgagccccatctgccccaggagccagatcggcctgaacaccatgagccgcagccgcagccccagccccatccgctgtggcctgccccgcttctag

SEQ ID NO: 171393 - DNA, 504 bp, Artificial Sequence
  Description of Artificial Sequence: Synthetic coding sequence
atgatcatcaccacctggatcgtgtacatcctggccaggaagggcgtgggcctgcccttcctgcccatcaccagcagtgacattgatgtggtggagagcgaggccgtgtctgtgctgcaccactggctgaagaagacagaggaggaggccagccggggcatcaaggagaagctgagcatcaaccaccccagccagggcgtgcgggagaagatgagcacagacagcccccccacccacggccaggacatccacgtgaccagagatgtggtgaagcaccacctgagcaagagtgacctgctggccaaccagagccaggaggtgctggaggagaggacccgcatccagttcatccgctggagccacacccgcatcttccaggtgcccagcgagatgacagaggacatcatgagggaccgcatcgagcaggtgcggcgcagcatcagccggctgacagatgtgtctgcccaggacttctccatgaggcccagcagcagtgactgctag

SEQ ID NO: 171394 - DNA, 504 bp, Artificial Sequence; identical to SEQ ID NO: 171393
  Description of Artificial Sequence: Synthetic coding sequence

SEQ ID NO: 171395 - DNA, 1563 bp, Artificial Sequence
  Description of Artificial Sequence: Synthetic coding sequence
atgggcaagcccagctccatggacaccaagttcaaggatgacctcttcagaaaatatgtgcagttccacgagagcaaggtggacaccaccaccagccggcagaggcctggcagtgatgagtgcctgcgggtggccgccagcaccctgctgagcctgcacaaggtggaccccttctaccgcttccgcctcatccagttctatgaggtggtggagagcagcctgcggagcctgagcagcagcagcctgcgggccctgcacggggccttctccatgctggagaccgtgggcatcaacctcttcctgtacccctggaagaaggagttccgcagcatcaagacctacacaggcccctttgtgtactacgtgaagagcaccctgctggaggaggacatccgggccatcctgagctgcatgggctacaccccagagctgggcacagcctacaagctgcgggagctggtggagaccctgcaggtgaagatggtgtcctttgagctgttcctggccaaggtggagtgtgagcagatgctggagatccacagccaggtgaaggacaagggctacagcgagctggacatcgtgtctgagaggaagagcagcgcagaagatgtgcggggctgcagtgatgccctgcggaggagagctgagggccgggagcacctgacagcctccatgagccgggtggccctgcagaagagcgccagcgagcgggccgccaaggactactacaagccccgggtgaccaagcccagccgctctgtggatgcctatgacagctactgggagagcaggaagccacccctgaaggccagcctgagcctgaggaaggagcctgtggccacagatgtgggagatgacctgaaggatgagatcatccggcccagccccagcctgctgaccatggccagcagcccccacggcagcccagatgtgctgcccccagccagccccagcaatggacctgccctgctgcggggcacctacttcagcacccaggatgatgtggacctgtacacagattctgagccccgggccacctaccgccggcaggatgccctgcggccagatgtgtggctgctgagaaatgatgcccacagcctgtaccacaagaggagccccccagccaaggagagcgccctgagcaagtgccagagctgtggcctgagctgcagcagcagcctgtgccagagatgtgacagcctgctgacctgccccccagccagcaagcccagcgccttccccagcaaggccagcacccatgacagcctggcccatggagccagcctgcgggagaagtacccaggccagacccagggcctggaccggctgccccacctgcacagcaagagcaagcccagcaccacccccaccagccgctgtggcttctgcaacagacctggggccaccaacacctgcacccagtgcagcaaggtgtcctgtgatgcctgcctgagcgcctaccactatgacccctgctacaagaagtctgagctgcacaagttcatgcccaacaaccagctgaactacaagagcacccagctgagccacctggtgtacagatag

SEQ ID NO: 171396 - DNA, 1563 bp, Artificial Sequence; identical to SEQ ID NO: 171395
  Description of Artificial Sequence: Synthetic coding sequence

SEQ ID NO: 171397 - DNA, 1152 bp, Artificial Sequence
  Description of Artificial Sequence: Synthetic coding sequence
atgggctacaccccagagctgggcacagcctacaagctgcgggagctggtggagaccctgcaggtgaagatggtgtcctttgagctgttcctggccaaggtggagtgtgagcagatgctggagatccacagccaggtgaaggacaagggctacagcgagctggacatcgtgtctgagaggaagagcagcgcagaagatgtgcggggctgcagtgatgccctgcggcggcgggcagagggccgggagcacctgacagcctccatgagccgggtggccctgcagaagagcgccagcgagagagctgccaaggactactacaagccccgggtgaccaagcccagccgctctgtggatgcctatgacagctactgggagagcaggaagccacccctgaaggccagcctgagcctgaggaaggagcctgtggccacagatgtgggagatgacctgaaggatgagatcatccggcccagccccagcctgctgaccatggccagcagcccccacggcagcccagatgtgctgcccccagccagccccagcaatggacctgccctgctgcggggcacctacttcagcacccaggatgatgtggacctgtacacagacagcgagccccgggccacctaccgccggcaggatgccctgcggccagatgtgtggctgctgagaaatgatgcccacagcctgtaccacaagaggagccccccagccaaggagagcgccctgagcaagtgccagagctgtggcctgagctgcagcagcagcctgtgccagagatgtgacagcctgctgacctgccccccagccagcaagcccagcgccttccccagcaaggccagcacccatgacagcctggcccacggggccagcctgcgggagaagtacccaggccagacccagggcctggaccggctgccccacctgcacagcaagagcaagcccagcaccacccccaccagccgctgtggcttctgcaacagacctggggccaccaacacctgcacccagtgcagcaaggtgtcctgtgatgcctgcctgagcgcctaccactatgacccctgctacaagaagtctgagctgcacaagttcatgcccaacaaccagctgaactacaagagcacccagctgagccacctggtgtacagatag

SEQ ID NO: 171398 - DNA, 2409 bp, Artificial Sequence
  Description of Artificial Sequence: Synthetic coding sequence
atgctgggcgcccgggcctggctgggccgggtgctgctgctgcccagggctggagctggcctggccgccagccgccgctgccctggggtgtggcccaggacctggccccacaggagccccagccggggcagcagcagccgggacaaggacagaagtgccaccgtgagcagctctgtgcccatgcctgctgggggcaagggcagccaccccagcagcaccccccagagggtgcccaacagactcatccacgagaagagcccctacctgctgcagcacgcctacaaccctgtggactggtacccctggggccaggaggcctttgacaaggccaggaaagaaaacaagcccatcttcctgtctgtgggctacagcacctgccactggtgccacatgatggaggaggagagcttccagaatgaggagatcggccgcctgctgtctgaggactttgtgtctgtgaaggtggaccgggaggagaggccagatgtggacaaggtgtacatgacctttgtgcaggccaccagcagcggcggcggctggcccatgaatgtgtggctgacccccaacctgcagccctttgtgggcggcacctacttccccccagaagatggcctgaccagggtgggcttcagaacagtgctgctgcgcatccgggagcagtggaagcagaacaagaacaccctgctggagaacagccagagggtgaccacagccctgctggcccggtctgagatctctgtgggggaccggcagctgcccccatctgctgccaccgtgaacaaccgctgcttccagcagctggatgagggctatgatgaggagtatggaggctttgctgaggcccccaagttccccacccctgtgatcctgtccttcctgttctcctactggctgagccaccggctgacccaggacggcagccgggcccagcagatggccctgcacaccctgaagatgatggccaacggcggcatccgggaccacgtgggccagggcttccaccgctacagcacagaccggcagtggcacgtgccccactttgagaagatgctgtatgaccaggcccagctggccgtggcctacagccaggccttccagctgtctggagatgagttctacagtgatgtggccaagggcatcctgcagtatgtggcccggagcctgagccacaggtctgggggcttctacagcgcagaagatgctgacagccccccagagcggggccagaggcccaaggagggcgcctactacgtgtggacagtgaaggaggtgcagcagctgctgcctgagcctgtgctgggcgccacagagcccctgaccagcggccagctgctgatgaagcactacggcctgacagaggccggcaacatcagccccagccaggaccccaagggggagctgcagggccagaatgtgctgactgtgcgctacagcctggagctgacagctgcccgcttcggcctggatgtggaggccgtgaggaccctgctgaacagcggcctggagaagctgttccaggccaggaagcaccggcccaagccccacctggacagcaagatgctggccgcctggaatggcctgatggtgtctggctatgctgtgactggagctgtgctgggccaggacaggctcatcaactatgccaccaacggggccaagttcctgaagaggcacatgtttgatgtggccagcggccgcctgatgaggacctgctacacaggccctgggggcaccgtggagcacagcaaccccccctgctggggcttcctggaggactatgcctttgtggtgcggggcctgctggacctgtatgaggccagccaggagagcgcctggctggagtgggccctgcggctgcaggacacccaggacaagctgttctgggacagccagggcggcggctacttctgcagcgaggccgagctgggcgccggcctgcccctgcggctgaaggatgaccaggatggagctgagcccagcgccaacagcgtgtctgcccacaacctgctgcggctgcacggcttcaccggccacaaggactggatggacaagtgtgtgtgcctgctgacagccttcagcgagaggatgagaagagtgcctgtggccctgcctgagatggtgcgggccctgagcgcccagcagcagaccctgaagcagatcgtcatctgtggggaccggcaggccaaggacaccaaggccctggtgcagtgtgtgcacagcgtgtacatccccaacaaggtgctgatcctggctgatggagaccccagcagcttcctgagccggcagctgcccttcctgagcaccctgcggcggctggaggaccaggccacagcctacgtgtgtgagaaccaggcctgcagcgtgcccatcacagacccctgtgagctgaggaagctgctgcacccctag

SEQ ID NO: 171399 - DNA, 2361 bp, Artificial Sequence
  Description of Artificial Sequence: Synthetic coding sequence
atgctgggcgcccgggcctggctgggccgggtgctgctgctgcccagggctggagctggcctggccgccagcagaagaggcagcagcagccgggacaaggacagaagtgccaccgtgagcagctctgtgcccatgcctgctgggggcaagggcagccaccccagcagcaccccccagagggtgcccaacagactcatccacgagaagagcccctacctgctgcagcacgcctacaaccctgtggactggtacccctggggccaggaggcctttgacaaggccaggaaagaaaacaagcccatcttcctgtctgtgggctacagcacctgccactggtgccacatgatggaggaggagagcttccagaatgaggagatcggccgcctgctgtctgaggactttgtgtctgtgaaggtggaccgggaggagaggccagatgtggacaaggtgtacatgacctttgtgcaggccaccagcagcggcggcggctggcccatgaatgtgtggctgacccccaacctgcagccctttgtgggcggcacctacttccccccagaagatggcctgaccagggtgggcttcagaacagtgctgctgcgcatccgggagcagtggaagcagaacaagaacaccctgctggagaacagccagagggtgaccacagccctgctggcccggtctgagatctctgtgggggaccggcagctgcccccatctgctgccaccgtgaacaaccgctgcttccagcagctggatgagggctatgatgaggagtatggaggctttgctgaggcccccaagttccccacccctgtgatcctgtccttcctgttctcctactggctgagccaccggctgacccaggacggcagccgggcccagcagatggccctgcacaccctgaagatgatggccaacggcggcatccgggaccacgtgggccagggcttccaccgctacagcacagaccggcagtggcacgtgccccactttgagaagatgctgtatgaccaggcccagctggccgtggcctacagccaggccttccagctgtctggagatgagttctacagtgatgtggccaagggcatcctgcagtatgtggcccggagcctgagccacaggtctgggggcttctacagcgcagaagatgctgacagccccccagagcggggccagaggcccaaggagggcgcctactacgtgtggacagtgaaggaggtgcagcagctgctgcctgagcctgtgctgggcgccacagagcccctgaccagcggccagctgctgatgaagcactacggcctgacagaggccggcaacatcagccccagccaggaccccaagggggagctgcagggccagaatgtgctgactgtgcgctacagcctggagctgacagctgcccgcttcggcctggatgtggaggccgtgaggaccctgctgaacagcggcctggagaagctgttccaggccaggaagcaccggcccaagccccacctggacagcaagatgctggccgcctggaatggcctgatggtgtctggctatgctgtgactggagctgtgctgggccaggacaggctcatcaactatgccaccaacggggccaagttcctgaagaggcacatgtttgatgtggccagcggccgcctgatgaggacctgctacacaggccctgggggcaccgtggagcacagcaaccccccctgctggggcttcctggaggactatgcctttgtggtgcggggcctgctggacctgtatgaggccagccaggagagcgcctggctggagtgggccctgcggctgcaggacacccaggacaagctgttctgggacagccagggcggcggctacttctgcagcgaggccgagctgggcgccggcctgcccctgcggctgaaggatgaccaggatggagctgagcccagcgccaacagcgtgtctgcccacaacctgctgcggctgcacggcttcaccggccacaaggactggatggacaagtgtgtgtgcctgctgacagccttcagcgagaggatgagaagagtgcctgtggccctgcctgagatggtgcgggccctgagcgcccagcagcagaccctgaagcagatcgtcatctgtggggaccggcaggccaaggacaccaaggccctggtgcagtgtgtgcacagcgtgtacatccccaacaaggtgctgatcctggctgatggagaccccagcagcttcctgagccggcagctgcccttcctgagcaccctgcggcggctggaggaccaggccacagcctacgtgtgtgagaaccaggcctgcagcgtgcccatcacagacccctgtgagctgaggaagctgctgcacccctag

SEQ ID NO: 171400 - DNA, 2229 bp, Artificial Sequence
  Description of Artificial Sequence: Synthetic coding sequence
atgcctgctgggggcaagggcagccaccccagcagcaccccccagagggtgcccaacagactcatccacgagaagagcccctacctgctgcagcacgcctacaaccctgtggactggtacccctggggccaggaggcctttgacaaggccaggaaagaaaacaagcccatcttcctgtctgtgggctacagcacctgccactggtgccacatgatggaggaggagagcttccagaatgaggagatcggccgcctgctgtctgaggactttgtgtctgtgaaggtggaccgggaggagaggccagatgtggacaaggtgtacatgacctttgtgcaggccaccagcagcggcggcggctggcccatgaatgtgtggctgacccccaacctgcagccctttgtgggcggcacctacttccccccagaagatggcctgaccagggtgggcttcagaacagtgctgctgcgcatccgggagcagtggaagcagaacaagaacaccctgctggagaacagccagagggtgaccacagccctgctggcccggtctgagatctctgtgggggaccggcagctgcccccatctgctgccaccgtgaacaaccgctgcttccagcagctggatgagggctatgatgaggagtatggaggctttgctgaggcccccaagttccccacccctgtgatcctgtccttcctgttctcctactggctgagccaccggctgacccaggacggcagccgggcccagcagatggccctgcacaccctgaagatgatggccaacggcggcatccgggaccacgtgggccagggcttccaccgctacagcacagaccggcagtggcacgtgccccactttgagaagatgctgtatgaccaggcccagctggccgtggcctacagccaggccttccagctgtctggagatgagttctacagtgatgtggccaagggcatcctgcagtatgtggcccggagcctgagccacaggtctgggggcttctacagcgcagaagatgctgacagccccccagagcggggccagaggcccaaggagggcgcctactacgtgtggacagtgaaggaggtgcagcagctgctgcctgagcctgtgctgggcgccacagagcccctgaccagcggccagctgctgatgaagcactacggcctgacagaggccggcaacatcagccccagccaggaccccaagggggagctgcagggccagaatgtgctgactgtgcgctacagcctggagctgacagctgcccgcttcggcctggatgtggaggccgtgaggaccctgctgaacagcggcctggagaagctgttccaggccaggaagcaccggcccaagccccacctggacagcaagatgctggccgcctggaatggcctgatggtgtctggctatgctgtgactggagctgtgctgggccaggacaggctcatcaactatgccaccaacggggccaagttcctgaagaggcacatgtttgatgtggccagcggccgcctgatgaggacctgctacacaggccctgggggcaccgtggagcacagcaaccccccctgctggggcttcctggaggactatgcctttgtggtgcggggcctgctggacctgtatgaggccagccaggagagcgcctggctggagtgggccctgcggctgcaggacacccaggacaagctgttctgggacagccagggcggcggctacttctgcagcgaggccgagctgggcgccggcctgcccctgcggctgaaggatgaccaggatggagctgagcccagcgccaacagcgtgtctgcccacaacctgctgcggctgcacggcttcaccggccacaaggactggatggacaagtgtgtgtgcctgctgacagccttcagcgagaggatgagaagagtgcctgtggccctgcctgagatggtgcgggccctgagcgcccagcagcagaccctgaagcagatcgtcatctgtggggaccggcaggccaaggacaccaaggccctggtgcagtgtgtgcacagcgtgtacatccccaacaaggtgctgatcctggctgatggagaccccagcagcttcctgagccggcagctgcccttcctgagcaccctgcggcggctggaggaccaggccacagcctacgtgtgtgagaaccaggcctgcagcgtgcccatcacagacccctgtgagctgaggaagctgctgcacccctag

SEQ ID NO: 171401 - DNA, 228 bp, Artificial Sequence
  Description of Artificial Sequence: Synthetic coding sequence
ggccagggccaccagggccctggccagtgtgtgcacagcgtgtacatccccaacaaggtgctgatcctggctgatggagaccccagcagcttcctgagccggcagctgcccttcctgagcaccctgcggcggctggaggaccaggccacagcctacgtgtgtgagaaccaggcctgcagcgtgcccatcacagacccctgtgagctgaggaagctgctgcacccctag

SEQ ID NO: 171402 - DNA, 132 bp, Artificial Sequence
  Description of Artificial Sequence: Synthetic coding sequence
atgctgggcgcccgggcctggctgggccgggtgctgctgctgcccagggctggagctggcctggccgccagcagaagaagtgcctgcagccccaccagccggctgaacagcctgcggagcctcatcccctag

SEQ ID NO: 171403 - DNA, 918 bp, Artificial Sequence
  Description of Artificial Sequence: Synthetic coding sequence
atggctgctgctggccaggagaagggctacctgacccagacagctgctgccctggacaagagccccagcctgagcccccagctggccgcccccatccggggccggcccaagaagtgcctggtgtacccccacgcccccaagagcagccggctgagccgctctgtgctgcgctggctgcagggcctggacctgtccttcttccccaggaacatcaacagagacttcagcaatggcttcctgattgctgagatcttctgcatctactacccctgggagctggagctgagcagctttgaaaatggcaccagcctgaaggtgaagctggacaactgggcccagctggagaagttcctggccaggaagaagttcaagctgcccaaggagctgattcatggcaccatccactgcaaggccggcgtgcctgagatcctgattgaggaggtgtacaccctgctgacccaccgggagatcaagagcatccaggatgactttgtgaacttcacagactacagctaccagatgaggctgcccctggtgagccgcagcacagtgtccaagagcatcaaggacaacatccggctgtctgagctgctgagcaaccccaacatgctgaccaatgagctgaaggccgagttcctgatcctgctgcacatgctgcagaggaagctgggcaggaagctgaaccctgagtggtttgatgtgaagcccaccgtgggggaggtgaccctgaaccacctgcctgcccaggccagcggccgccgctacaacctgaaggtgaagaggggccgggtggtgcctgtgctgcccaacatcggcagcggcggcagcagccaccgggagatccacgtgaagcaggccggccagcacagctactacagcgccatgaagcccatccggaacatggacaagaagccctag

SEQ ID NO: 171404 - DNA, 2682 bp, Artificial Sequence
  Description of Artificial Sequence: Synthetic coding sequence
atgagcagcaagaagaacaggaagaggctgaaccagagcgcagaaaatggcagcagcctgcccagcgctgccagcagctgtgccgaggcccgggcccccagcgctggcagtgactttgctgccaccagcggcaccctgactgtgaccaacctgctggagaaggtggatgacaagatccccaagaccttccagaacagcctcatccacctgggcctgaacaccatgaagagcgccaacatctgcatcggccggcctgtgctgctgaccagcctgaatggcaagcaggaggtgtacacagcctggcccatggccggcttccctgggggcaaggtgggcctgtctgagatggcccagaagaatgtgggcgtgcggcctggagatgccatccaggtgcagcccctggtgggcgctgtgctgcaggccgaggagatggatgtggccctgagtgacaaggacatggagatcaatgaggaggagctgaccggctgcatcctgaggaagctggatggcaagatcgtgctgcccggcaacttcctgtactgcaccttctacggccggccctacaagctgcaggtgctgcgggtgaagggagcagatggcatgatcctgggcggcccccagagcgacagcgacacagatgcccagaggatggcctttgagcagagctccatggagaccagcagcctggagctgagcctgcagctgagccagctggacctggaggacacccagatccccaccagccgcagcaccccctacaagcccattgatgaccgcatcaccaacaaggccagtgatgtgctgctggatgtgacccagagccctggagatggcagcggcctgatgctggaggaggtgacaggcctgaagtgcaactttgaaagtgcccgggagggcaatgagcagctgacagaggaggagcggctgctgaagttcagcatcggggccaagtgcaacacagacaccttctacttcatcagcagcaccaccagggtgaacttcacagaaattgacaagaacagcaaggagcaggacaaccagttcaaggtgacctatgacatgattggaggcctgagcagccagctgaaggccatccgggagatcatcgagctgcccctgaagcagcctgagctgttcaagagctatggcatcccagccccccggggcgtgctgctgtatggccccccaggcaccgggaagaccatgattgcccgggctgtggccaatgaggtgggcgcctacgtgtctgtcatcaatggacctgagatcatcagcaagttctacggggagacagaggccaagctgcggcagatctttgctgaggccaccctgcggcaccccagcatcatcttcattgatgagctggatgccctgtgccccaagcgggagggcgcccagaatgaggtggagaagagggtggtggccagcctgctgaccctgatggatggcatcggcagcgaggtgtctgagggccaggtgctggtgctgggcgccaccaaccggccccacgccctggatgctgccctgcggcggcccggccgctttgacaaggagattgaaattggagtgcccaatgcccaggaccggctggacatcctgcagaagctgctgcggcgggtgccccacctgctgacagaagctgagctgctgcagctggccaacagcgcccacggctacgtgggcgctgacctgaaggtgctgtgcaatgaagctggcctgtgtgccctgcggcgcatcctgaagaagcagcccaacctgcctgatgtgaaggtggccggcctggtgaagatcaccctgaaggacttcctgcaggccatgaatgacatccggcccagcgccatgagagaaattgccattgatgtgcccaacgtgtcctggagcgacattggaggcctggagagcatcaagctgaagctggagcaggccgtggagtggcccctgaagcaccctgagagcttcatccgcatgggcatccagccccccaagggcgtgctgctgtatggccccccaggctgcagcaagaccatgattgccaaggccctggccaatgaaagtggcctgaacttcctggccatcaagggccctgagctgatgaacaagtatgtgggggagagcgagagagctgtgcgggagaccttcaggaaggcccgggctgtggcccccagcatcatcttctttgatgagctggatgccctggccgtggagcggggcagcagcctgggcgctggaaatgtggccgacagagtgctggcccagctgctgacagagatggatggcatcgagcagctgaaggatgtgaccatcctggccgccaccaacagaccagacagaattgacaaggccctgatgaggcctggaagaattgaccgcatcatctacgtgcccctgcctgatgctgccacccggcgggagatcttcaagctgcagttccacagcatgcctgtgtccaatgaggtggacctggatgagctgatcctgcagacagatgcctacagcggggctgagatcgtggccgtgtgccgggaggccgccctgctggccctggaggaggacatccaggccaacctgatcatgaagaggcacttcacccaggccctgagcacagtgaccccccgcatccctgagagcctgcggcgcttctatgaggactaccaggagaagagcggcctgcacaccctgtag

SEQ ID NO: 171405 - DNA, 750 bp, Artificial Sequence
  Description of Artificial Sequence: Synthetic coding sequence
atgcagctggacaagttcatctaccacctggcccctgtggagaagagccacggccgcctgcagaacagaaccagccgcagccagaagaagaagagcaagagccctgagaggagcaagtactgcatcaatgccaagaactatgagcagcccaccatcagcagcaagagccacagccccagcccctacaccaagaggaggatgtgtgagctgtctgaggacacccggcggcggctggcccacctgaacctgggcccctatgagttcaagaaggagacagacaagcccccatttgtgatcagacatgtggacccccccagccccagggctgacaccctgctgggcagcagcggccgggactgtgaaagagatggctggagccgggtgcacaatgaccacagccacctgggctgctgccggcccaaggactacaaggtgatccgcaccccccacggccgggactttgatgacagcctggagaagtgtgaggagtacctgagccccaggagctgcagcaagcccaggcacagcgcccggaccctgctggtgcacagcgcccccagcaccatgcccaagcacagccccagccctgtgctgaacagagccagcctgcgggagcgcttccacagcgactggtgcagccccagcaactgtgatgagatccatgacagagatgagcgggacctggagaaggatgatgagctggagctgaagaggagcctgctgtgccgggacagcgcctatgacagctag

SEQ ID NO: 171406 - DNA, 1419 bp, Artificial Sequence
  Description of Artificial Sequence: Synthetic coding sequence
atgcccaaggtgaaggccctgcagtgtgccctggccctggagatcagctctgtgacctgccctggggtggtgctgaaggacaaggaggacatctacctgagcatctgtgtgtttggccagtacaagaagacccagtgtgtgcctgccaccttccccctggtgttcaatgccaggatggtgtttgagaaggtgtttcctgatgctgtggaccctggagatgtggtgacccagctggagtatgacacagctgtgtttgagctgatccagctggtgccccctgtgggggagaccctgagcacctatgatgagaacacccgggacttcatgtttcctggccccaaccagatgagcggccaccacgacagcaaccggcaggtgaccatgaggcgcatcagcggcctgcggggaaatgccccccggctggagttcagcaccaccagcgtcatcacagaatgtctcatcagcagcaggaagtgccacacccaggacaagttcatctaccacctggcccctgtggagaagagccacggccgcctgcagaacagaaccagccgcagccagaagaagaagagcaagagccctgagaggagcaagtactgcatcaatgccaagaactatgagcagcccaccatcagcagcaagagccacagccccagcccctacaccaagaggaggatgtgtgagctgtctgaggacacccggcggcggctggcccacctgaacctgggcccctatgagttcaagaaggagacagacaagccacccttcgtcatccgccacgtggacccccccagccccagggctgacaccctgctgggcagcagcggccgggactgtgaaagagatggctggagccgggtgcacaatgaccacagccacctgggctgctgccggcccaaggactacaaggtgatccgcacccctcatggccgggactttgatgacagcctggagaagtgtgaggagtacctgagccccaggagctgcagcaagcccaggcacagcgcccggaccctgctggtgcacagcgcccccagcaccatgcccaagcacagccccagccctgtgctgaacagagccagcctgcgggagcgcttccacagcgactggtgcagccccagcaactgtgatgagatccatgacagagatgagcgggacctggagaaggatgatgagctggagctgaagaggagcctgctgtgccgggacagcgcctatgacagcgaccctgagtacagcagctgccagcagccccggggcaccttccacctggatgatggagagtactggagcaacagagctgccagctacaagggcaagagccaccggcccatctttgaaaattccatggacaagatgtacagaaacctgtacaagaaggcctgcagcagcgccagccacacccaggagagcttctag

SEQ ID NO: 171407 - DNA, 1467 bp, Artificial Sequence
  Description of Artificial Sequence: Synthetic coding sequence
atgcccaaggtgaaggccctgcagtgtgccctggccctggagatcagctctgtgacctgccctggggtggtgctgaaggacaaggaggacatctacctgagcatctgtgtgtttggccagtacaagaagacccagtgtgtgcctgccaccttccccctggtgttcaatgccaggatggtgtttgagaaggtgtttcctgatgctgtggaccctggagatgtggtgacccagctggagtatgacacagctgtgtttgagctgatccagctggtgccccctgtgggggagaccctgagcacctatgatgagaacacccgggacttcatgtttcctggccccaaccagatgagcggccaccacgacagcaaccggcaggtgaccatgaggcgcatcagcggcctgcggggaaatgccccccggctggagttcagcaccaccagcgtcatcacagaatgtctcatcagcagcaggaagtgccacacccaggacaagttcatctaccacctggcccctgtggagaagagccacggccgcctgcagaacagaaccagccgcagccagaagaagaagagcaagagccctgagaggagcaagtactgcatcaatgccaagaactatgagcagcccaccatcagcagcaagagccacagccccagcccctacaccaagaggaggatgtgtgagctgtctgaggacacccggcggcggctggcccacctgaacctgggcccctatgagttcaagaaggagacagacaagccacccttcgtcatccgccacgtggacccccccagccccagggctgacaccctgctgggcagcagcggccgggactgtgaaagagatggctggagccgggtgcacaatgaccacagccacctgggctgctgccggcccaaggactacaaggtgatccgcacccctcatggccgggactttgatgacagcctggagaagtgtgaggagtacctgagccccaggagctgcagcaagcccaggcacagcgcccggaccctgctggtgcacagcgcccccagcaccatgcccaagcacagccccagccctgtgctgaacagagccagcctgcgggagcgcttccacagcgactggtgcagccccagcaactgtgatgagatccatgacagagtgaagaatgtgctgaagagccaccaggcccaccagaggcacctgtatgatgagcgggacctggagaaggatgatgagctggagctgaagaggagcctgctgtgccgggacagcgcctatgacagcgaccctgagtacagcagctgccagcagccccggggcaccttccacctggatgatggagagtactggagcaacagagctgccagctacaagggcaagagccaccggcccatctttgaaaattccatggacaagatgtacagaaacctgtacaagaaggcctgcagcagcgccagccacacccaggagagcttctag

SEQ ID NO: 171408 - DNA, 1251 bp, Artificial Sequence
  Description of Artificial Sequence: Synthetic coding sequence
atggtgtttgagaaggtgtttcctgatgctgtggaccctggagatgtggtgacccagctggagctgggggagaccctgagcacctatgatgagaacacccgggacttcatgtttcctggccccaaccagatgagcggccaccacgacagcaaccggcaggtgaccatgaggcgcatcagcggcctgcggggaaatgccccccggctggagttcagcaccaccagcgtcatcacagaatgtctcatcagcagcaggaagtgccacacccaggacaagttcatctaccacctggcccctgtggagaagagccacggccgcctgcagaacagaaccagccgcagccagaagaagaagagcaagagccctgagaggagcaagtactgcatcaatgccaagaactatgagcagcccaccatcagcagcaagagccacagccccagcccctacaccaagaggaggatgtgtgagctgtctgaggacacccggcggcggctggcccacctgaacctgggcccctatgagttcaagaaggagacagacaagccacccttcgtcatccgccacgtggacccccccagccccagggctgacaccctgctgggcagcagcggccgggactgtgaaagagatggctggagccgggtgcacaatgaccacagccacctgggctgctgccggcccaaggactacaaggtgatccgcacccctcatggccgggactttgatgacagcctggagaagtgtgaggagtacctgagccccaggagctgcagcaagcccaggcacagcgcccggaccctgctggtgcacagcgcccccagcaccatgcccaagcacagccccagccctgtgctgaacagagccagcctgcgggagcgcttccacagcgactggtgcagccccagcaactgtgatgagatccatgacagagtgaagaatgtgctgaagagccaccaggcccaccagaggcacctgtatgatgagcgggacctggagaaggatgatgagctggagctgaagaggagcctgctgtgccgggacagcgcctatgacagcgaccctgagtacagcagctgccagcagccccggggcaccttccacctggatgatggagagtactggagcaacagagctgccagctacaagggcaagagccaccggcccatctttgaaaattccatggacaagatgtacagaaacctgtacaagaaggcctgcagcagcgccagccacacccaggagagcttctag

SEQ ID NO: 171409 - DNA, 1377 bp, Artificial Sequence
  Description of Artificial Sequence: Synthetic coding sequence
atggatggcagcagaagagtgcgggccacctctgtgctgcccaggtatggccccccctgcctcttcaagggccacctgagcaccaagagcaatgccttctgcacagacagcagcagcctgcggctgagcaccctgcagctggtgaagaaccacatggctgtgcactacaacaagatcctgagcgccaaggctgctgtggactgcagcgtgcctgtgtctgtgtccaccagcatcaagtatgctgaccagcagaggcgggagaagctgaagaaggagctggcccagtgtgagaaggagttcaagctgaccaagacagccatgagggccaactacaagaacaacagcaagagcctcttcaacaccctgcagaagcccagcggggagccccagattgaagatgacatgctgaaggaggagatgaatggcttcagcagctttgcccggagcctggtgcccagcagcgagcggctgcacctgagcctgcacaagagcagcaaggtgatcaccaacggccctgagaagaacagcagcagcagccccagctctgtggactatgctgccagcggccccaggaagctgagcagcggggccctgtatggaagaagacccaggagcaccttccccaacagccaccgcttccagctggtgatcagcaaggcccccagcggggacctgctggacaagcacagcgagctgttcagcaacaagcagctgcccttcacccccaggaccctgaagacagaggccaagagcttcctgagccagtaccgctactacaccccagccaagaggaagaaggacttcacagaccagagaattgaagctgagacccagacagagctgtccttcaagtctgagctgggcacagctgagaccaagaacatgacagacagcgagatgaacatcaagcaggccagcaactgtgtgacctatgatgccaaggagaagatcgcccccctgcccctggagggccatgacagcacctgggatgagatcaaggatgatgccctgcagcacagcagcccccgggccatgtgccagtacagcctgaagccacccagcaccaggaagatctacagtgatgaggaggagctgctgtacctgtccttcattgaagatgtgacagatgagatcctgaagctgggcctcttcagcaaccgcttcctggagcggctgtttgagcggcacatcaagcagaacaagcacctggaggaggagaagatgaggcacctgctgcacgtgctgaaggtggacctgggctgcaccagtgaagaaaattccttcagctctgtgaagggggacaacaaccacgacatggagctgagcaccctgaagatcatggagatgagcattgaggactgccccctggatgtgtag

SEQ ID NO: 171410 - DNA, 1704 bp, Artificial Sequence
  Description of Artificial Sequence: Synthetic coding sequence
atggatggcagcagaagagtgcgggccacctctgtgctgcccaggtatggccccccctgcctcttcaagggccacctgagcaccaagagcaatgctgctgtggactgcagcgtgcctgtgtctgtgtccaccagcatcaagtatgctgaccagcagaggcgggagaagctgaagaaggagctggcccagtgtgagaaggagttcaagctgaccaagacagccatgagggccaactacaagaacaacagcaagagcctcttcaacaccctgcagaagcccagcggggagccccagattgaagatgacatgctgaaggaggagatgaatggcttcagcagctttgcccggagcctggtgcccagcagcgagcggctgcacctgagcctgcacaagagcagcaaggtgatcaccaacggccctgagaagaacagcagcagcagccccagctctgtggactatgctgccagcggccccaggaagctgagcagcggggccctgtatggaagaagacccaggagcaccttccccaacagccaccgcttccagctggtgatcagcaaggcccccagcggggacctgctggacaagcacagcgagctgttcagcaacaagcagctgcccttcacccccaggaccctgaagacagaggccaagagcttcctgagccagtaccgctactacaccccagccaagaggaagaaggacttcacagaccagagaattgaagctgagacccagacagagctgtccttcaagtctgagctgggcacagctgagaccaagaacatgacagacagcgagatgaacatcaagcaggccagcaactgtgtgacctatgatgccaaggagaagatcgcccccctgcccctggagggccatgacagcacctgggatgagatcaaggatgatgccctgcagcacagcagcccccgggccatgtgccagtacagcctgaagccacccagcaccaggaagatctacagtgatgaggaggagctgctgtacctgtccttcattgaagatgtgacagatgagatcctgaagctgggcctcttcagcaaccgcttcctggagcggctgtttgagcggcacatcaagcagaacaagcacctggaggaggagaagatgaggcacctgctgcacgtgctgaaggtggacctgggctgcaccagtgaagaaaattctgtgaagcagaatgatgtggacatgctgaatgtgtttgattttgagaaggccggcaacagcgagcccaatgagctgaagaatgaaagtgaggtgaccatccagcaggagcggcagcagtaccagaaggccctggacatgctgctgagcgcccccaaggatgaaaatgagatcttccccagccccacagagttcttcatgcccatctacaagagcaagcacagcgagggcgtcatcatccagcaggtgaatgatgagaccaacctggagaccagcaccctggatgagaaccaccccagcatcagtgacagcctgacagaccgggagacctctgtgaatgtgattgaaggagacagcgaccctgagaaggtggagatcagcaatggcctgtgtggcctgaacaccagccccagccagagcgtgcagttcagctctgtgaagggggacaacaaccacgacatggagctgagcaccctgaagatcatggagatgagcattgaggactgccccctggatgtgtag

SEQ ID NO: 171411 - DNA, 1800 bp, Artificial Sequence
  Description of Artificial Sequence: Synthetic coding sequence
atggatggcagcagaagagtgcgggccacctctgtgctgcccaggtatggccccccctgcctcttcaagggccacctgagcaccaagagcaatgccttctgcacagacagcagcagcctgcggctgagcaccctgcagctggtgaagaaccacatggctgtgcactacaacaagatcctgagcgccaaggctgctgtggactgcagcgtgcctgtgtctgtgtccaccagcatcaagtatgctgaccagcagaggcgggagaagctgaagaaggagctggcccagtgtgagaaggagttcaagctgaccaagacagccatgagggccaactacaagaacaacagcaagagcctcttcaacaccctgcagaagcccagcggggagccccagattgaagatgacatgctgaaggaggagatgaatggcttcagcagctttgcccggagcctggtgcccagcagcgagcggctgcacctgagcctgcacaagagcagcaaggtgatcaccaacggccctgagaagaacagcagcagcagccccagctctgtggactatgctgccagcggccccaggaagctgagcagcggggccctgtatggaagaagacccaggagcaccttccccaacagccaccgcttccagctggtgatcagcaaggcccccagcggggacctgctggacaagcacagcgagctgttcagcaacaagcagctgcccttcacccccaggaccctgaagacagaggccaagagcttcctgagccagtaccgctactacaccccagccaagaggaagaaggacttcacagaccagagaattgaagctgagacccagacagagctgtccttcaagtctgagctgggcacagctgagaccaagaacatgacagacagcgagatgaacatcaagcaggccagcaactgtgtgacctatgatgccaaggagaagatcgcccccctgcccctggagggccatgacagcacctgggatgagatcaaggatgatgccctgcagcacagcagcccccgggccatgtgccagtacagcctgaagccacccagcaccaggaagatctacagtgatgaggaggagctgctgtacctgtccttcattgaagatgtgacagatgagatcctgaagctgggcctcttcagcaaccgcttcctggagcggctgtttgagcggcacatcaagcagaacaagcacctggaggaggagaagatgaggcacctgctgcacgtgctgaaggtggacctgggctgcaccagtgaagaaaattctgtgaagcagaatgatgtggacatgctgaatgtgtttgattttgagaaggccggcaacagcgagcccaatgagctgaagaatgaaagtgaggtgaccatccagcaggagcggcagcagtaccagaaggccctggacatgctgctgagcgcccccaaggatgaaaatgagatcttccccagccccacagagttcttcatgcccatctacaagagcaagcacagcgagggcgtcatcatccagcaggtgaatgatgagaccaacctggagaccagcaccctggatgagaaccaccccagcatcagtgacagcctgacagaccgggagacctctgtgaatgtgattgaaggagacagcgaccctgagaaggtggagatcagcaatggcctgtgtggcctgaacaccagccccagccagagcgtgcagttcagctctgtgaagggggacaacaaccacgacatggagctgagcaccctgaagatcatggagatgagcattgaggactgccccctggatgtgtag

SEQ ID NO: 171412 - DNA, 1704 bp, Artificial Sequence; identical to SEQ ID NO: 171410
  Description of Artificial Sequence: Synthetic coding sequence

SEQ ID NO: 171413 - DNA, 318 bp, Artificial Sequence
  Description of Artificial Sequence: Synthetic coding sequence
atggccccagctggcatgtctggggcccaggacaacagctgcctgtaccaggagatcgcccccagcttccagaggctgccctgccccaggaccagcagccgccacttcagcgaggccatgacctgcccctgtggctggaggcccttcaagggcggccctgggggcctgaagggccctgtgtggccagccaaggaggagaacagctgcagccacggccgcatccagagggtgcagaggcggcgggtgcccagcgccagccccctcatccagaagatcaacagaagatctgtgctcttccacccctactgctggagctag

SEQ ID NO: 171414 - DNA, 1638 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagaagatcaatgctgtgcgggccatcgtgcccaacaagagcaacaatgagatcatcctggtgctgcagcactttgacaactgtgtggacaagacagtgcaggccttcatggagggcagcgccagcgaggtgctgaaggagtggacagtgacaggcaagaagaagaacaagaagaagaagaacaagcccaagccagctgctgagcccagcaatggcatcccagacagcagcaagtctgtgtccatccaggaggagcagagcgcccccagcagcgagaagggcggcatgaatggctaccacgtgaatggagccatcaatgacacagaatctgtggacagcctgtctgagggcctggagaccctgagcattgatgcccgggagctggaggaccctgagagcgccatgctggacaccctggacagaacaggctccatgctgcagaatggagtgtctgactttgagaccaagagcctgaccatgcacagcatccacaacagccagcagcccagaaatgctgccaagagcctgagccggcccaccacagagacccagttcagcaacatgggcatggaggatgtgcccctggccaccagcaagaagctgagcagcaacatcgagaagtctgtgaaggacctgcagcgctgcaccgtgtccctggcccgctacagagtggtggtgaaggaggagatggatgccagcatcaagaagatgaagcaggcctttgctgagctggagagctgcctgatggaccgggaggtggccctgctggccgagatggacaaggtgaaggccgaggccatggagatcctgctgagccggcagaagaaggccgagctgctgaagaagatgacccacgtggccgtgcagatgtctgagcagcagctggtggagctgcgggctgacatcaagcactttgtgtctgagaggaaatatgatgaggacctgggccgggtggcccgcttcacctgtgatgtggagaccctgaagaagagcattgacagctttggccaggtgagccaccccaagaacagctacagcaccaggagccgctgcagctctgtgacctctgtgtccctgagcagccccagtgatgccagcgctgccagcagcagcacctgtgccagcccccccagcctgaccagcgccaacaagaagaactttgcccctggagagaccccagctgccatcgccaacagcagcggccagccctaccagcccctgcgggaggtgctgcccggcaacagaagaggaggccagggctaccggccccagggccagaagagcaatgaccccatgaaccagggcagacatgacagcatgggccgctacagaaacagctcctggtacagcagcggcagccgctaccagagcgcccccagccaggcccctggcaacaccatcgagcggggccagacccacagcgctggcaccaatggaactggagtgtccatggagcccagcccccccacccccagcttcaagaagggcctgccccagaggaagcccaggaccagccagacagaggccgtgaacagctag

SEQ ID NO: 171415 - DNA, 1638 bp, Artificial Sequence
  Description of Artificial Sequence: Synthetic coding sequence
gtgtccaagaagaagaagaagaaggacagcagcggcttcatctttgacctgcagagcaacacagtgctggcccagggcggggcctttgagaacatgaaggagaagatcaatgctgtgcgggccatcgtgcccaacaagagcaacaatgagatcatcctggtgctgcagcactttgacaactgtgtggacaagacagtgcaggccttcatggagggcagcgccagcgaggtgctgaaggagtggacagtgacaggcaagaagaagaacaagaagaagaagaacaagcccaagccagctgctgagcccagcaatggcatcccagacagcagcaagtctgtgtccatccaggaggagcagagcgcccccagcagcgagaagggcggcatgaatggctaccacgtgaatggagccatcaatgacacagaatctgtggacagcctgtctgagggcctggagaccctgagcattgatgcccgggagctggaggaccctgagagcgccatgctggacaccctggacagaacaggctccatgctgcagaatggagtgtctgactttgagaccaagagcctgaccatgcacagcatccacaacagccagcagcccagaaatgctgccaagagcctgagccggcccaccacagagacccagttcagcaacatgggcatggaggatgtgcccctggccaccagcaagaagctgagcagcaacatcgagaagtctgtgaaggacctgcagcgctgcaccgtgtccctggcccgctacagagtggtggtgaaggaggagatggatgccagcatcaagaagatgaagcaggcctttgctgagctggagagctgcctgatggaccgggaggtggccctgctggccgagatggacaaggtgaaggccgaggccatggagatcctgctgagccggcagaagaaggccgagctgctgaagaagatgacccacgtggccgtgcagatgtctgagcagcagctggtggagctgcgggctgacatcaagcactttgtgtctgagaggaaatatgatgaggacctgggccgggtggcccgcttcacctgtgatgtggagaccctgaagaagagcattgacagctttggccaggtgagccaccccaagaacagctacagcaccaggagccgctgcagctctgtgacctctgtgtccctgagcagccccagtgatgccagcgctgccagcagcagcacctgtgccagcccccccagcctgaccagcgccaacaagaagaactttgcccctggagagaccccagctgccatcgccaacagcagcggccagccctaccagcccctgcgggaggtgctgcccggcaacagaagaggaggccagggctaccggccccagggccagaagagcaatgaccccatgaaccagggcagacatgacagcatgggccgctacagaaacagctcctggtacagcagcggcagccgctaccagagcgcccccagccaggcccctggcaacaccatcgagcggggccagacccacagcgctggcaccaatggaactggagtgtccatggagcccagcccccccacccccagcttcaagaagggcctgccccagaggaagcccaggaccagccagacagaggccgtgaacagctag

SEQ ID NO: 171416 - DNA, 27 bp, Artificial Sequence
  Description of Artificial Sequence: Synthetic coding sequence
atgagcaggaagcagaaccagaagtag

SEQ ID NO: 171417 - DNA, 27 bp, Artificial Sequence
  Description of Artificial Sequence: Synthetic coding sequence
atgagcaggaagcagaaccagaagtag

SEQ ID NO: 171418 - DNA, 204 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagaagatcaatgctgtgcgggccatcgtgcccaacaagagcaacaatgagatcatcctggtgctgcagcactttgacaactgtgtggacaagacagtgcagtag

SEQ ID NO: 171419 - DNA, 102 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaagtag

SEQ ID NO: 171420 - DNA, 18 bp, Artificial Sequence
  Description of Artificial Sequence: Synthetic coding sequence
atgagcaggaagcagtag

SEQ ID NO: 171421 - DNA, 111 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagaaggtgtag

SEQ ID NO: 171422 - DNA, 201 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagaagatcaatgctgtgcgggccatcgtgcccaacaagagcaacaatgagatcatcctggtgctgcagcactttgacaactgtgtggacaagacagtgtag

SEQ ID NO: 171423 - DNA, 105 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagtag

SEQ ID NO: 171424 - DNA, 297 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagaagatcaatgctgtgcgggccatcgtgcccaacaagagcaacaatgagatcatcctggtgctgcagcactttgacaactgtgtggacaagacagtgcaggccttcatggagggcagcgccagcgaggtgctgaaggagtggacagtgacaggcaagaagaagaacaagaagaagaagaacaagcccaagccctag

SEQ ID NO: 171425 - DNA, 225 bp, Artificial Sequence
  Description of Artificial Sequence: Synthetic coding sequence
atgagcaggaagcagaaccagaaggacagcagcggcttcatctttgacctgcagagcaacacagtgctggcccagggcggggcctttgagaacatgaaggagaagatcaatgctgtgcgggccatcgtgcccaacaagagcaacaatgagatcatcctggtgctgcagcactttgacaactgtgtggacaagacagtgcaggccttcatggagggcagcgcctag

SEQ ID NO: 171426 - DNA, 33 bp, Artificial Sequence
  Description of Artificial Sequence: Synthetic coding sequence
atgagcaggaagcagaaccagaaggacagctag

SEQ ID NO: 171427 - DNA, 1638 bp, Artificial Sequence; identical to SEQ ID NO: 171414
  Description of Artificial Sequence: Synthetic coding sequence

SEQ ID NO: 171428 - DNA, 1638 bp, Artificial Sequence; identical to SEQ ID NO: 171414
  Description of Artificial Sequence: Synthetic coding sequence

SEQ ID NO: 171429 - DNA, 1677 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacagagggcaaccggctgctgcagcagaagctgagcctggatggcaaccccaagcccatccacggcaccacagagaggagtgatggcctgcagtggagcgctgagcagccctgcaaccccagcaagcccaaggccaagaccagccctgtgaagagcaacaccccagctgcccacctggagatcaagccagatgagctggccaagaagaggggccccaacatcgagaagtctgtgaaggacctgcagcgctgcaccgtgtccctgacccgctacagagtgatgatcaaggaggaggtggacagctctgtgaagaagatcaaggccgcctttgctgagctgcacaactgcatcatcgacaaggaggtgtccctgatggccgagatggacaaggtgaaggaggaggccatggagatcctgacagcccggcagaagaaggccgaggagctgaagaggctgacagacctggccagccagatggccgagatgcagctggccgagctgcgggcagagatcaagcactttgtgtctgagaggaaatatgatgaggagctgggcaaggccgcccgcttcagctgtgacatcgagcagctgaaggcccagatcatgctgtgtggggagatcacccaccccaagaacaactacagcagcaggaccccctgcagcagcctgctgcccctgctgaatgcccacgccgccaccagcggcaagcagagcaacttcagcaggaagagcagcacccacaacaagcccagcgagggcaaggccgccaaccccaagatggtgagcagcctgcccagcacagctgaccccagccaccagaccatgcctgccaacaagcagaatggcagcagcaaccagaggcggcgcttcaacccccagtaccacaacaaccggctgaatggacctgccaagagccagggcagcggaaatgaagctgagcccctgggcaagggcaacagcagacatgagcaccggcggcagccccacaacggcttccggcccaagaacaagggcggggccaagaaccaggaggccagcctgggcatgaagaccccagaggccccagcccacagcgagaagccccggcggcggcagcacgccgctgacaccagcgaggcccggcccttccggggctctgtgggccgggtgtcccagtgcaacctgtgccccacccgcatcgaggtgtccacagatgctgctgtgctgtctgtgcctgctgtgaccctggtggcctag

SEQ ID NO: 171430 - DNA, 1470 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacaggccccaacatcgagaagtctgtgaaggacctgcagcgctgcaccgtgtccctgacccgctacagagtgatgatcaaggaggaggtggacagctctgtgaagaagatcaaggccgcctttgctgagctgcacaactgcatcatcgacaaggaggtgtccctgatggccgagatggacaaggtgaaggaggaggccatggagatcctgacagcccggcagaagaaggccgaggagctgaagaggctgacagacctggccagccagatggccgagatgcagctggccgagctgcgggcagagatcaagcactttgtgtctgagaggaaatatgatgaggagctgggcaaggccgcccgcttcagctgtgacatcgagcagctgaaggcccagatcatgctgtgtggggagatcacccaccccaagaacaactacagcagcaggaccccctgcagcagcctgctgcccctgctgaatgcccatgctgccaccagcggcaagcagagcaacttcagcaggaagagcagcacccacaacaagcccagcgagggcaaggccgccaaccccaagatggtgagcagcctgcccagcacagctgaccccagccaccagaccatgcctgccaacaagcagaatggcagcagcaaccagaggcggcgcttcaacccccagtaccacaacaaccggctgaatggacctgccaagagccagggcagcggaaatgaggccgagcccctgggcaaaggaaacagcagacatgagcaccggcggcagccccacaacggcttccggcccaagaacaagggcggggccaagaaccaggaggccagcctgggcatgaagaccccagaggccccagcccacagcgagaagccccggcggcggcagcacgccgctgacaccagcgaggcccggcccttccggggctctgtgggccgggtgtcccagtgcaacctgtgccccaccagaattgaggtgtccacagatgctgctgtgctgtctgtgcctgctgtgaccctggtggcctag

SEQ ID NO: 171431 - DNA, 1677 bp, Artificial Sequence; identical to SEQ ID NO: 171429
  Description of Artificial Sequence: Synthetic coding sequence

SEQ ID NO: 171432 - DNA, 1701 bp, Artificial Sequence
  Description of Artificial Sequence: Synthetic coding sequence
atggcctacagcaccaggagcaagatggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacagagggcaaccggctgctgcagcagaagctgagcctggatggcaaccccaagcccatccacggcaccacagagaggagtgatggcctgcagtggagcgctgagcagccctgcaaccccagcaagcccaaggccaagaccagccctgtgaagagcaacaccccagctgcccacctggagatcaagccagatgagctggccaagaagaggggccccaacatcgagaagtctgtgaaggacctgcagcgctgcaccgtgtccctgacccgctacagagtgatgatcaaggaggaggtggacagctctgtgaagaagatcaaggccgcctttgctgagctgcacaactgcatcatcgacaaggaggtgtccctgatggccgagatggacaaggtgaaggaggaggccatggagatcctgacagcccggcagaagaaggccgaggagctgaagaggctgacagacctggccagccagatggccgagatgcagctggccgagctgcgggcagagatcaagcactttgtgtctgagaggaaatatgatgaggagctgggcaaggccgcccgcttcagctgtgacatcgagcagctgaaggcccagatcatgctgtgtggggagatcacccaccccaagaacaactacagcagcaggaccccctgcagcagcctgctgcccctgctgaatgcccacgccgccaccagcggcaagcagagcaacttcagcaggaagagcagcacccacaacaagcccagcgagggcaaggccgccaaccccaagatggtgagcagcctgcccagcacagctgaccccagccaccagaccatgcctgccaacaagcagaatggcagcagcaaccagaggcggcgcttcaacccccagtaccacaacaaccggctgaatggacctgccaagagccagggcagcggaaatgaagctgagcccctgggcaagggcaacagcagacatgagcaccggcggcagccccacaacggcttccggcccaagaacaagggcggggccaagaaccaggaggccagcctgggcatgaagaccccagaggccccagcccacagcgagaagccccggcggcggcagcacgccgctgacaccagcgaggcccggcccttccggggctctgtgggccgggtgtcccagtgcaacctgtgccccacccgcatcgaggtgtccacagatgctgctgtgctgtctgtgcctgctgtgaccctggtggcctag

SEQ ID NO: 171433 - DNA, 801 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacaggccccaacatcgagaagtctgtgaaggacctgcagcgctgcaccgtgtccctgacccgctacagagtgatgatcaaggaggaggtggacagctctgtgaagaagatcaaggccgcctttgctgagctgcacaactgcatcatcgacaaggaggtgtccctgatggccgagatggacaaggtgaaggaggaggccatggagatcctgacagcccggcagaagaaggccgaggagctgaagaggctgacagacctggccagccagatggccgagatgcagctggccgagctgcgggcagagatcaagcactttgtgtctgagaggaaatatgatgaggagctgggcaaggccgcctag

SEQ ID NO: 171434 - DNA, 1677 bp, Artificial Sequence; identical to SEQ ID NO: 171429
  Description of Artificial Sequence: Synthetic coding sequence

SEQ ID NO: 171435 - DNA, 1767 bp, Artificial Sequence
  Description of Artificial Sequence: Synthetic coding sequence
atggaccccttctgccacagcagcagcgagacccggctgctgagcggcaccctgctgtggatcccccgggcctacagcaccaggagcaagatggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacagagggcaaccggctgctgcagcagaagctgagcctggatggcaaccccaagcccatccacggcaccacagagaggagtgatggcctgcagtggagcgctgagcagccctgcaaccccagcaagcccaaggccaagaccagccctgtgaagagcaacaccccagctgcccacctggagatcaagccagatgagctggccaagaagaggggccccaacatcgagaagtctgtgaaggacctgcagcgctgcaccgtgtccctgacccgctacagagtgatgatcaaggaggaggtggacagctctgtgaagaagatcaaggccgcctttgctgagctgcacaactgcatcatcgacaaggaggtgtccctgatggccgagatggacaaggtgaaggaggaggccatggagatcctgacagcccggcagaagaaggccgaggagctgaagaggctgacagacctggccagccagatggccgagatgcagctggccgagctgcgggcagagatcaagcactttgtgtctgagaggaaatatgatgaggagctgggcaaggccgcccgcttcagctgtgacatcgagcagctgaaggcccagatcatgctgtgtggggagatcacccaccccaagaacaactacagcagcaggaccccctgcagcagcctgctgcccctgctgaatgcccacgccgccaccagcggcaagcagagcaacttcagcaggaagagcagcacccacaacaagcccagcgagggcaaggccgccaaccccaagatggtgagcagcctgcccagcacagctgaccccagccaccagaccatgcctgccaacaagcagaatggcagcagcaaccagaggcggcgcttcaacccccagtaccacaacaaccggctgaatggacctgccaagagccagggcagcggaaatgaagctgagcccctgggcaagggcaacagcagacatgagcaccggcggcagccccacaacggcttccggcccaagaacaagggcggggccaagaaccaggaggccagcctgggcatgaagaccccagaggccccagcccacagcgagaagccccggcggcggcagcacgccgctgacaccagcgaggcccggcccttccggggctctgtgggccgggtgtcccagtgcaacctgtgccccacccgcatcgaggtgtccacagatgctgctgtgctgtctgtgcctgctgtgaccctggtggcctag

SEQ ID NO: 171436 - DNA, 1677 bp, Artificial Sequence; identical to SEQ ID NO: 171429
  Description of Artificial Sequence: Synthetic coding sequence

SEQ ID NO: 171437 - DNA, 465 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacagagggcaaccggctgctgtag

SEQ ID NO: 171438 - DNA, 423 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagccctag

SEQ ID NO: 171439 - DNA, 42 bp, Artificial Sequence
  Description of Artificial Sequence: Synthetic coding sequence
atggccgagctgaacacccacgtgaatgtgaaggagaagtag

SEQ ID NO: 171440 - DNA, 285 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggctag

SEQ ID NO: 171441 - DNA, 348 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagctag

SEQ ID NO: 171442 - DNA, 72 bp, Artificial Sequence
  Description of Artificial Sequence: Synthetic coding sequence
atggccgagctgaacacccacgtgaatgtgaaggagaagatctatgctgtgcgctctgtggtgcccaactag

SEQ ID NO: 171443 - DNA, 522 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacaggccccaacatcgagaagtctgtgaaggacctgcagcgctgcaccgtgtccctgacccgctacagagtgatgatctag

SEQ ID NO: 171444 - DNA, 1677 bp, Artificial Sequence; identical to SEQ ID NO: 171429
  Description of Artificial Sequence: Synthetic coding sequence

SEQ ID NO: 171445 - DNA, 567 bp, Artificial Sequence
  Description of Artificial Sequence: Synthetic coding sequence
atggccgagctgaacacccacgtgaatgtgaaggagaagatctatgctgtgcgctctgtggtgcccaacaagagcaacaatgaaattgtgctggtgctgcagcagtttgacttcaacgtggacaaggctgtgcaggcctttgtggatggcagcgccatccaggtgctgaaggagtggaacatgaccgggaagaagaagaacaacaagaggaagaggagcaagagcaagcagcaccagggcaacaaggatgccaaggacaaggtggagaggcctgaggccggccccctgcagccccagcccccccagatccagaatggccccatgaatggctgtgagaaggacagcagcagcacagacagcgccaatgagaagccagccctgatcccccgggagaagaagatcagcatcctggaggagcccagcaaggccctgcggggcgtgacagagggcaaccggctgctgcagcagaagctgagcctggatggcaaccccaagcccatccacggcaccacagagaggagtgatggcctgcagtggagcgctgagcagccctgcaaccccagctag

SEQ ID NO: 171446 - DNA, 909 bp, Artificial Sequence
  Description of Artificial Sequence: Synthetic coding sequence
atggagcccggcccagatggccctgctgccagcggccctgctgccatccgggagggctggttccgggagacctgcagcctgtggccaggccaggccctgagcctgcaggtggagcagctgctgcaccaccggcgcagccgctaccaggacatcctggtgttccgcagcaagacctatggaaatgtgctggtgctggatggagtcatccagtgcacagaaagagatgagttctcctaccaggagatgattgccaacctgcccctgtgcagccaccccaaccccaggaaggtgctgatcatcggcggcggagatggcggcgtgctgcgggaggtggtgaagcaccccagcgtggagagcgtggtgcagtgtgaaattgatgaagatgtgatccaggtgtccaagaagttcctgcccggcatggccatcggctacagcagcagcaagctgaccctgcacgtgggagatggctttgagttcatgaagcagaaccaggatgcctttgatgtgatcatcacagacagcagtgaccccatgggccctgctgagagcctcttcaaggagagctactaccagctgatgaagacagccctgaaggaggatggagtgctgtgctgccagggcgagtgccagtggctgcacctggacctgatcaaggagatgaggcagttctgccagagcctcttccctgtggtggcctatgcctactgcaccatccccacctaccccagcggccagatcggcttcatgctgtgcagcaagaaccccagcaccaacttccaggagcctgtgcagcccctgacccagcagcaggtggcccagatgcagctgaagtactacaacagtgatgtgcaccgggccgcctttgtgctgcctgagtttgccaggaaggccctgaatgatgtgtcctag

SEQ ID NO: 171447 - DNA, 600 bp, Artificial Sequence
  Description of Artificial Sequence: Synthetic coding sequence
gaggagcccccaccacccaccgtgcaggtgcagggccctggcccccagcgggaggagaagcagaagaccaagatggccaagtttgtgatccggcctgccacagctgctgactgcagcgacatcctgcggctcatcaaggagctggccaagtatgagtacatggaggagcaggtgatcctgacagagaaggacctgctggaggatggctttggagagcaccccttctaccactgcctggtggccgaggtgcccaaggagcactggaccccagagggcaaccccagccccttccctgaggcccgggagaccaagtgctactacttcacctatgacccctggattggcaagctgctgtacctggaggacttctttgtgatgtctgactaccggggcctgtggcaccgcatcagaaattctgaggagagcaagccaggctgcaatgaggtgtccctggccgcctgcacctcctgggccgagtggaatgagcccagcatcaacttctacaagagaagaggagccagtgacctgagcagcgaggagggctggaggctcttcaagattgacaaggagtacctgctgaagatggccacagaggagtag

SEQ ID NO: 171448 - DNA, 453 bp, Artificial Sequence
  Description of Artificial Sequence: Synthetic coding sequence
atggccaagtttgtgatccggcctgccacagctgctgactgcagcgacatcctgcggctcatcaaggagctggccaagtatgagtacatggaggagcaggtgatcctgacagagaagggcaacagcacagtggccggccggggcacctctgtgcgctgcctgagccccagcccccggcccctgccccccctgctgcccctgctggccgacctgctggaggatggctttggagagcaccccttctaccactgcctggtggccgaggtgcccaaggagcactggaccccagagggcaaccccagccccttccctgaggcccgggagaccaagtgctacgtgcgcagctctgtgggctgtgtggagcccctgaccacccaggccgaggtgacagagaacctggacaggaagaacagccagcaggtgttcaagctgctgaggaagaagaagaactag

SEQ ID NO: 171449 - DNA, 363 bp, Artificial Sequence
  Description of Artificial Sequence: Synthetic coding sequence
atggccaagtttgtgatccggcctgccacagctgctgactgcagcgacatcctgcggctcatcaaggagctggccaagtatgagtacatggaggagcaggtgatcctgacagagaaggacctgctggaggatggctttggagagcaccccttctaccactgcctggtggccgaggtgcccaaggagcactggaccccagagggcaaccccagccccttccctgaggcccgggagaccaagtgctacgtgcgcagctctgtgggctgtgtggagcccctgaccacccaggccgaggtgacagagaacctggacaggaagaacagccagcaggtgttcaagctgctgaggaagaagaagaactag

SEQ ID NO: 171450 - DNA, 432 bp, Artificial Sequence
  Description of Artificial Sequence: Synthetic coding sequence
atggccaagtttgtgatccggcctgccacagctgctgactgcagcgacatcctgcggctcatcaaggagctggccaagtatgagtacatggaggagcaggtgatcctgacagagaagggccacagcatcgtgggctttgccatgtactacttcacctatgacccctggattggcaagctgctgtacctggaggacttctttgtgatgtctgactaccggggctttggaattggcagcgagatcctgaagaacctgagccaggtggccatgcgctgccgctgcagctccatgcacttcctggtggccgagtggaatgagcccagcatcaacttctacaagagaagaggagccagtgacctgagcagcgaggagggctggaggctcttcaagattgacaaggagtacctgctgaagatggccacagaggagtag

SEQ ID NO: 171451 - DNA, 516 bp, Artificial Sequence
  Description of Artificial Sequence: Synthetic coding sequence
atggccaagtttgtgatccggcctgccacagctgctgactgcagcgacatcctgcggctcatcaaggagctggccaagtatgagtacatggaggagcaggtgatcctgacagagaaggacctgctggaggatggctttggagagcaccccttctaccactgcctggtggccgaggtgcccaaggagcactggaccccagagggccacagcatcgtgggctttgccatgtactacttcacctatgacccctggattggcaagctgctgtacctggaggacttctttgtgatgtctgactaccggggctttggaattggcagcgagatcctgaagaacctgagccaggtggccatgcgctgccgctgcagctccatgcacttcctggtggccgagtggaatgagcccagcatcaacttctacaagagaagaggagccagtgacctgagcagcgaggagggctggaggctcttcaagattgacaaggagtacctgctgaagatggccacagaggagtag

SEQ ID NO: 171452 - DNA, 513 bp, Artificial Sequence
  Description of Artificial Sequence: Synthetic coding sequence
atggcctctgtgcgcatccgggaggccaaggagggggactgtggggacatcctgcggctcatccgggagctggccgagtttgagaagctgagtgaccaggtgaagatcagcgaggaggccctgcgggcagatggctttggagacaaccccttctaccactgcctggtggccgagatcctgcctgcccctgggaagctgctgggcccctgtgtggtgggctacggcatctactacttcatctacagcacctggaagggccgcaccatctacctggaggacatctacgtgatgcctgagtaccggggccagggcatcggcagcaagatcatcaagaaggtggccgaggtggccctggacaagggctgcagccagttccggctggccgtgctggactggaaccagagggccatggacctgtacaaggccctgggcgcccaggacctgacagaagctgagggctggcacttcttctgcttccagggcgaggccaccaggaagctggccggcaagtag

SEQ ID NO: 171453 - DNA, 750 bp, Artificial Sequence
  Description of Artificial Sequence: Synthetic coding sequence
atgcctggccagagaattgccagcctggcctacagcctgctgccctacggggccggcatcccagcccccctgacccggccccggctgcccaggaggcctccccggctgcccccacccaggagcctgcggctcttccgcatccaggtgcggcggcccttcaagggcagcagctgccgcctgcggggccctggcaccctggtgcctgacagcggggaccctgatggcttccgggctgacccccggggccagggcggccgcctgtggagatacccagaggccgacagcggggaggactgcaggcctgagctggccgagtttgagaagctgagtgaccaggtgaagatcagcgaggaggccctgcgggcagatggctttggagacaaccccttctaccactgcctggtggccgagatcctgcctgcccctgggaagctgctgggcccctgtgtggtgggctacggcatctactacttcatctacagcacctggaagggccgcaccatctacctggaggacatctacgtgatgcctgagtaccggggccagggcatcggcagcaagatcatcaagaaggtggccgaggtggccctggacaagggctgcagccagttccggctggccgtgctggactggaaccagagggccatggacctgtacaaggccctgggcgcccaggacctgacagaggccgagggctggcacttcttctgcttccagggcgaggccaccaggaagctggccggcaagtag

SEQ ID NO: 171454 - DNA, 942 bp, Artificial Sequence
  Description of Artificial Sequence: Synthetic coding sequence
atggctgctgcccggcacagcaccctggacttcatgctgggcgccaaggcagatggagagaccatcctgaagggcctgcagagcatcttccaggagcagggcatggccgagagcgtgcacacctggcaggaccacggctacctggccacctacaccaacaagaatggccgcctgccccccatcgtgcggggcggggccatcgaccgctactggcccacagcagatggccgcctggtggagtatgacattgatgaggtggtgtatgatgaggacagcccctaccagaacatcaagatcctgcacagcaagcagtttggaaacatcctgatcctgtctggagatgtgaacctggccgagagtgacctggcctacacccgggccatcatgggcagcggcaaggaggactacacaggcaaggatgtgctgatcctgggcggcggagatggcggcatcctgtgtgaaattgtgaagctgaagcccaagatggtgaccatggtggagattgaccagatggtgattgatggctgcaagaagtacatgaggaagacctgtggagatgtgctggacaacctgaagggggactgctaccaggtgctgattgaggactgcatccctgtgctgaagagatatgccaaggagggccgggagtttgattatgtgatcaatgacctgacagctgtgcccatcagcaccagccctgaggaggacagcacctgggagttcctgcggctcatcctggacctgtccatgaaggtgctgaagcaggacggcaagtacttcacccagggcaactgtgtgaacctgacagaggccctgagcctgtatgaggagcagctgggccgcctgtactgccctgtggagttcagcaaggagatcgtgtgtgtgcccagctacctggagctgtgggtgttctacacagtgtggaagaaggccaagccctag

SEQ ID NO: 171455 - DNA, 1101 bp, Artificial Sequence
  Description of Artificial Sequence: Synthetic coding sequence
atggctgctgcccggcacagcaccctggacttcatgctgggcgccaaggcagatggagagaccatcctgaagggcctgcagagcatcttccaggagcagggcatggccgagagcgtgcacacctggcaggaccacggctacctggccacctacaccaacaagaatggcagctttgccaacctgcgcatctacccccacggcctggtgctgctggacctgcagagctatgatggagatgcccagggcaaggaggagattgacagcatcctgaacaaggtggaggagaggatgaaggagctgagccaggacagcacaggccgggtgaagaggctgccccccatcgtgcggggcggggccatcgaccgctactggcccacagcagatggccgcctggtggagtatgacattgatgaggtggtgtatgatgaggacagcccctaccagaacatcaagatcctgcacagcaagcagtttggaaacatcctgatcctgtctggagatgtgaacctggccgagagtgacctggcctacacccgggccatcatgggcagcggcaaggaggactacaccgggaaggatgtgctgatcctgggcggcggagatggcggcatcctgtgtgagatcgtgaagctgaagcccaagatggtgaccatggtggagattgaccagatggtgattgatggctgcaagaagtacatgaggaagacctgtggagatgtgctggacaacctgaagggggactgctaccaggtgctgattgaggactgcatccctgtgctgaagagatatgccaaggagggccgggagtttgattatgtgatcaatgacctgacagctgtgcccatcagcaccagccctgaggaggacagcacctgggagttcctgcggctcatcctggacctgtccatgaaggtgctgaagcaggacggcaagtacttcacccagggcaactgtgtgaacctgacagaggccctgagcctgtatgaggagcagctgggccgcctgtactgccctgtggagttcagcaaggagatcgtgtgtgtgcccagctacctggagctgtgggtgttctacacagtgtggaagaaggccaagccctag

SEQ ID NO: 171456 - DNA, 828 bp, Artificial Sequence
  Description of Artificial Sequence: Synthetic coding sequence
atgaaggagctgagccaggacagcacaggccgggtgaagaggctgccccccatcgtgcggggcggggccatcgaccgctactggcccacagcagatggccgcctggtggagtatgacattgatgaggtggtgtatgatgaggacagcccctaccagaacatcaagatcctgcacagcaagcagtttggaaacatcctgatcctgtctggagatgtgaacctggccgagagtgacctggcctacacccgggccatcatgggcagcggcaaggaggactacaccgggaaggatgtgctgatcctgggcggcggagatggcggcatcctgtgtgagatcgtgaagctgaagcccaagatggtgaccatggtggagattgaccagatggtgattgatggctgcaagaagtacatgaggaagacctgtggagatgtgctggacaacctgaagggggactgctaccaggtgctgattgaggactgcatccctgtgctgaagagatatgccaaggagggccgggagtttgattatgtgatcaatgacctgacagctgtgcccatcagcaccagccctgaggaggacagcacctgggagttcctgcggctcatcctggacctgtccatgaaggtgctgaagcaggacggcaagtacttcacccagggcaactgtgtgaacctgacagaggccctgagcctgtatgaggagcagctgggccgcctgtactgccctgtggagttcagcaaggagatcgtgtgtgtgcccagctacctggagctgttcctgctgcagttctggagggtgcgcagcagcaaatgtgccctggagggctag

SEQ ID NO: 171457 - DNA, 936 bp, Artificial Sequence
  Description of Artificial Sequence: Synthetic coding sequence
tgaggaggccgggcagaggccgccctgctgctggcccccaggtctgtgcctgctgctgcccggggcctgcagggccagagccgggtgcctgctggccgggccgccctgcccggccctggccggcccccagccctgccccggggcctggccgcctttgccctgcccctgggggagagccctggctgccgggcccgggctgaccccccctgggatgagggctgccgggactgtggcggggcccggcgggaccccagaggagagcccggcctgggcgcctgtgccgagcggggctgcccccgggacctcttcctgttcctgcaggccgcagatggagagaccatcctgaagggcctgcagagcatcttccaggagcagggcatggccgagagcgtgcacacctggcaggaccacggctacctggccacctacaccaacaagaatggcagctttgccaacctgcgcatctacccccacggcctggtgctgctggacctgcagagctatgatggagatgcccagggcaaggaggagattgacagcatcctgaacaaggtggaggagaggatgaaggagctgagccaggacagcacaggccgggtgaagaggctgccccccatcgtgcggggcggggccatcgaccgctactggcccacagcagatggccgcctggtggagtatgacattgatgaggtggtgtatgatgaggacagcccctaccagaacatcaagatcctgcacagcaagcagtttggaaacatcctgatcctgtctggagatgtgaacctggccgagagtgacctggcctacacccgggccatcatgggcagcggcaaggaggactacaccgggaaggatgtgctgatcctgggcggcggagatggcggcatcctgtgtgagatcgtgaagctgaagcccaagatggtgaccatggtgtag

SEQ ID NO: 171458 - DNA, 3801 bp, Artificial Sequence
  Description of Artificial Sequence: Synthetic coding sequence
cgggaggccaccccacccctgcggggcctgcctgccccacccaggcatgcccccttccctgctggccgctttgagccccccaggaccaagcagggcggccggggcagccacaccccctgggtgtatgtgatcaatgacctgggcatcgaggagaacctgaagaatgatggcaagcccaagtgccagacaggaggcaagagcaagaggaccatccagggcacccacaagaccaccaagcagcagagcacagctgtggactgcaagatcaccagcagcaccaccggggacaagcactttgacaagagccccaccaagaccaggcaccccaggaagattgacctgcgggcccgctactgggccttcctgtttgacaacctgcggcgggctgtggatgagatctacgtgacctgtgagagtgaccagagcgtggtggagtgcaaggaggtgctgatgatgctggacaactacgtgcgggacttcaaggccctgattgactggatccagctgcaggagaagctggagaagacagatgcccagagccggcccaccagcctggcctgggaggtgaagaagatgagccctggaagacatgtgatccccagccccagcacagaccgcatcaacgtgaccagcaatgcccggcgcagcctgaactttggaggcagcactggaacagtgcctgccccccggctggcccccaccggggtgtcctgggccgacaaggtgaaggcccaccacacaggcagcacagccagcagcgagatcaccccagcccagagctgcccccccatgacagtgcagaaggccagcaggaagaatgaaaggaaggatgctgagggctgggagaccgtgcagaggggccggcccatccgcagccgcagcacagctgtgatgcccaaggtgtccctggccacagaggccaccaggagcaaggatgacagcgacaaggaaaatgtgtgcctgctgcctgatgagagcatccagaagggccagtttgtgggagatggcaccagcaacaccatcgagagccaccccaaggacagcctgcacagctgtgaccaccccctggccgagaagacccagttcaccgtgtccaccctggatgatgtgaagaacagcggcagcatccgggacaactacgtgaggaccagcgagatctctgctgtgcacatcgacacagaatgtgtgtctgtgatgctgcaggccggcaccccacccctgcaggtgaatgaggagaagtttcctgctgagaaggccagaattgaaaatgagatggaccccagcgacatcagcaatgtgtctgctgccaacctgtccatggccgaggtgctggccaagaaggaggagctggccgaccggctggagaaggccaatgaggaggccatcgccagcgccatcgccgaggaggagcagctgacccgggagattgaggccgaggagaacaatgacatcaacatcgagacagacaatgacagcgacttcagcgcctccatgggcagcggctctgtgtccttctgtggcatgtccatggactggaatgatgtgctggccgactatgaggcccgggagagctggaggcagaacacctcctggggagacatcgtggaggaggagcccgcccggcccccaggccacggcatccacatgcatgagaagctgagcagccccagcaggaagaggaccatcgccgagagcaagaagaagcatgaggagaagcagatgaaggcccagcagctgcgggagaagctgcgggaggagaagaccctgaagctgcagaagctgctggagcgggagaaggatgtgaggaagtggaaggaggagctgctggaccagaggaggaggatgatggaggagaagctgctgcatgctgagttcaagcgggaggtgcagctgcaggccatcgtgaagaaggcccaggaggaggaggccaaggtgaatgagatcgccttcatcaacaccctggaggcccagaacaagagacatgatgtgctgagcaagctgaaggagtatgagcagaggctgaatgagctgcaggaggagcggcagaggcggcaggaggagaagcaggccagagatgaggccgtgcaggagaggaagagggccctggaggccgagcggcaggcccgggtggaggagctgctgatgaagaggaaggagcaggaggcccgcatcgagcagcagaggcaggagaaggagaaggcccgggaggatgctgcccgggagcgggcccgggaccgggaggagcggctggccgccctgacagctgcccagcaggaggccatggaggagctgcagaagaagatccagctgaagcatgatgagagcatcagaagacacatggagcagatcgagcagaggaaggagaaggctgctgagctgagcagcggcagacatgccaacacagattatgcccccaagctgaccccctatgaaaggaagaagcagtgcagcctgtgcaatgtgctgatcagcagcgaggtgtacctgttcagccacgtgaagggcaggaagcaccagcaggccgtgcgggagaacaccagcatccagggccgggagctgagtgatgaggaggtggagcacctgagcctgaagaagtacatcatcgacatcgtggtggagagcacagccccagctgaggccctgaaggatggagaggagcggcagaagaacaagaagaaggccaagaagatcaaggccaggatgaacttccgggccaaggagtatgagagcctgatggagaccaagaacagcggcagtgacagcccctacaaggccaagctgcagaggctggccaaggacctgctgaagcaggtgcaggtgcaggacagcggctcctgggccaacaacaaggtgtctgccctggacaggaccctgggggagatcacccgcatcctggagaaggaaaatgtggccgaccagatcgccttccaggccgccggcggcctgacagccctggagcacatcctgcaggccgtggtgcctgccaccaacgtgaacacagtgctgcgcatcccccccaagagcctgtgcaatgccatcaacgtgtacaacctgacctgcaacaactgcagcgagaactgcagtgatgtgctcttcagcaacaagatcaccttcctgatggacctgctgatccaccagctgactgtgtatgtgcctgatgagaacaacaccatcctgggcaggaacaccaacaagcaggtgtttgagggcctgaccaccggcctgctgaaggtgtctgctgtggtgctgggctgcctgattgccaacagaccagatggcaactgccagcctgccacccccaagatccccacccaggagatgaagaacaagcccagccagggcgaccccttcaacaacagagtgcaggacctgatctcctatgtggtgaacatgggcctgattgacaagctgtgtgcctgcttcctgtctgtgcagggccctgtggatgagaaccccaagatggccatcttcctgcagcacgccgccggcctgctgcacgccatgtgcaccctgtgctttgctgtgacaggccgcagctacagcatctttgacaacaaccggcaggaccccaccggcctgacagctgccctgcaggccacagacctggccggcgtgctgcacatgctgtactgtgtgctcttccacggcaccatcctggaccccagcacagccagccccaaggagaactacacccagaacaccatccaggtggccatccagagcctgcgcttcttcaacagctttgctgccctgcacctgcctgccttccaggtgcccagcatcggcctgtaccgctgctag

SEQ ID NO: 171459 - DNA, 4203 bp, Artificial Sequence
  Description of Artificial Sequence: Synthetic coding sequence
atgatggccagcttccagaggagcaacagccatgacaaggtgagaagaattgtggccgaggagggccgcacagccaggaacctgattgcctggagcgtgcccctggagagcaaggatgatgatggcaagcccaagtgccagacaggaggcaagagcaagaggaccatccagggcacccacaagaccaccaagcagagcacagctgtggactgcaagatcaccagcagcaccaccggggacaagcactttgacaagagccccaccaagaccaggcaccccaggaagattgacctgcgggcccgctactgggccttcctgtttgacaacctgcggcgggctgtggatgagatctacgtgacctgtgagagtgaccagagcgtggtggagtgcaaggaggtgctgatgatgctggacaactacgtgcgggacttcaaggccctgattgactggatccagctgcaggagaagctggagaagacagatgcccagagccggcccaccagcctggcctgggaggtgaagaagatgagccctggaagacatgtgatccccagccccagcacagaccgcatcaacgtgaccagcaatgcccggcgcagcctgaactttggaggcagcactggaacagtgcctgccccccggctggcccccaccggggtgtcctgggccgacaaggtgaaggcccaccacacaggcagcacagccagcagcgagatcaccccagcccagagctgcccccccatgacagtgcagaaggccagcaggaagaatgaaaggaaggatgctgagggctgggagaccgtgcagaggggccggcccatccgcagccgcagcacagctgtgatgcccaaggtgtccctggccacagaggccaccaggagcaaggatgacagcgacaaggaaaatgtgtgcctgctgcctgatgagagcatccagaagggccagtttgtgggagatggcaccagcaacaccatcgagagccaccccaaggacagcctgcacagctgtgaccaccccctggccgagaagacccagttcaccgtgtccaccctggatgatgtgaagaacagcggcagcatccgggacaactacgtgaggaccagcgagatctctgctgtgcacatcgacacagaatgtgtgtctgtgatgctgcaggccggcaccccacccctgcaggtgaatgaggagaagtttcctgctgagaaggccagaattgaaaatgagatggaccccagcgacatcagcaacagcatggccgaggtgctggccaagaaggaggagctggccgaccggctggagaaggccaatgaggaggccatcgccagcgccatcgccgaggaggagcagctgacccgggagattgaggccgaggagaacaatgacatcaacatcgagacagacaatgacagcgacttcagcgcctccatgggcagcggctctgtgtccttctgtggcatgtccatggactggaatgatgtgctggccgactatgaggcccgggagagctggaggcagaacacctcctggggagacatcgtggaggaggagcccgcccggcccccaggccacggcatccacatgcatgagaagctgagcagccccagcaggaagaggaccatcgccgagagcaagaagaagcatgaggagaagcagatgaaggcccagcagctgcgggagaagctgcgggaggagaagaccctgaagctgcagaagctgctggagcgggagaaggatgtgaggaagtggaaggaggagctgctggaccagaggaggaggatgatggaggagaagctgctgcatgctgagttcaagcgggaggtgcagctgcaggccatcgtgaagaaggcccaggaggaggaggccaaggtgaatgagatcgccttcatcaacaccctggaggcccagaacaagagacatgatgtgctgagcaagctgaaggagtatgagcagaggctgaatgagctgcaggaggagcggcagaggcggcaggaggagaagcaggccagagatgaggccgtgcaggagaggaagagggccctggaggccgagcggcaggcccgggtggaggagctgctgatgaagaggaaggagcaggaggcccgcatcgagcagcagaggcaggagaaggagaaggcccgggaggatgctgcccgggagcgggcccgggaccgggaggagcggctggccgccctgacagctgcccagcaggaggccatggaggagctgcagaagaagatccagctgaagcatgatgagagcatcagaagacacatggagcagatcgagcagaggaaggagaaggctgctgagctgagcagcggcagacatgccaacacagattatgcccccaagctgaccccctatgaaaggaagaagcagtgcagcctgtgcaatgtgctgatcagcagcgaggtgtacctgttcagccacgtgaagggcaggaagcaccagcaggccgtgcgggagaacaccagcatccagggccgggagctgagtgatgaggaggtggagcacctgagcctgaagaagtacatcatcgacatcgtggtggagagcacagccccagctgaggccctgaaggatggagaggagcggcagaagaacaagaagaaggccaagaagatcaaggccaggatgaacttccgggccaaggagtatgagagcctgatggagaccaagaacagcggcagtgacagcccctacaaggccaagctgcagaggctggccaaggacctgctgaagcaggtgcaggtgcaggacagcggctcctgggccaacaacaaggtgtctgccctggacaggaccctgggggagatcacccgcatcctggagaaggaaaatgtggccgaccagatcgccttccaggccgccggcggcctgacagccctggagcacatcctgcaggccgtggtgcctgccaccaacgtgaacacagtgctgcgcatcccccccaagagcctgtgcaatgccatcaacgtgtacaacctgacctgcaacaactgcagcgagaactgcagtgatgtgctcttcagcaacaagatcaccttcctgatggacctgctgatccaccagctgactgtgtatgtgcctgatgagaacaacaccatcctgggcaggaacaccaacaagcaggtgtttgagggcctgaccaccggcctgctgaaggtgtctgctgtggtgctgggctgcctgattgccaacagaccagatggcaactgccagcctgccacccccaagatccccacccaggagatgaagaacaagcccagccagggcgaccccttcaacaacagagtgcaggacctgatctcctatgtggtgaacatgggcctgattgacaagctgtgtgcctgcttcctgtctgtgcagggccctgtggatgagaaccccaagatggccatcttcctgcagcacgccgccggcctgctgcacgccatgtgcaccctgtgctttgctgtgacaggccgcagctacagcatctttgacaacaaccggcaggaccccaccggcctgacagctgccctgcaggccacagacctggccggcgtgctgcacatgctgtactgtgtgctcttccacggcaccatcctggaccccagcacagccagccccaaggagaactacacccagaacaccatccaggtggccatccagagcctgcgcttcttcaacagctttgctgccctgcacctgcctgccttccagagcatcgtgggcgctgagggcctgagcctggccttccgccacatggccagcagcctgctgggccactgcagccaggtgtcctgtgagagcctgctgcacgaggtgattgtgtgtgtgggctacttcaccgtgaaccacccagacaaccaggtgattgtgcagagcggccgccaccccaccgtgctgcagaagctgtgccagctgcccttccagtacttcagtgaccccaggctcatcaaggtgctcttccccagcctgattgctgcctgctacaacaaccaccagaacaagatcatcctggagcaggagatgagctgtgtgctgctggccaccttcatccaggacctggcccagaccccaggccaggccgagaaccagccctaccagcccaagggcaagtgcctgggcagccaggactacctggagctggccaaccgcttcccccagcaggcctgggaggaggcccggcagttcttcctgaagaaggagaagaagtag

SEQ ID NO: 171460 - DNA, 3465 bp, Artificial Sequence
  Description of Artificial Sequence: Synthetic coding sequence
atgaagaccaagtacatcttctgcaacatcacagagaggaaggatgctgagggctgggagaccgtgcagaggggccggcccatccgcagccgcagcacagctgtgatgcccaaggtgtccctggccacagaggccaccaggagcaaggatgacagcgacaaggaaaatgtgtgcctgctgcctgatgagagcatccagaagggccagtttgtgggagatggcaccagcaacaccatcgagagccaccccaaggacagcctgcacagctgtgaccaccccctggccgagaagacccagttcaccgtgtccaccctggatgatgtgaagaacagcggcagcatccgggacaactacgtgaggaccagcgagatctctgctgtgcacatcgacacagaatgtgtgtctgtgatgctgcaggccggcaccccacccctgcaggtgaatgaggagaagtttcctgctgagaaggccagaattgaaaatgagatggaccccagcgacatcagcaacagcatggccgaggtgctggccaagaaggaggagctggccgaccggctggagaaggccaatgaggaggccatcgccagcgccatcgccgaggaggagcagctgacccgggagattgaggccgaggagaacaatgacatcaacatcgagacagacaatgacagcgacttcagcgcctccatgggcagcggctctgtgtccttctgtggcatgtccatggactggaatgatgtgctggccgactatgaggcccgggagagctggaggcagaacacctcctggggagacatcgtggaggaggagcccgcccggcccccaggccacggcatccacatgcatgagaagctgagcagccccagcaggaagaggaccatcgccgagagcaagaagaagcatgaggagaagcagatgaaggcccagcagctgcgggagaagctgcgggaggagaagaccctgaagctgcagaagctgctggagcgggagaaggatgtgaggaagtggaaggaggagctgctggaccagaggaggaggatgatggaggagaagctgctgcatgctgagttcaagcgggaggtgcagctgcaggccatcgtgaagaaggcccaggaggaggaggccaaggtgaatgagatcgccttcatcaacaccctggaggcccagaacaagagacatgatgtgctgagcaagctgaaggagtatgagcagaggctgaatgagctgcaggaggagcggcagaggcggcaggaggagaagcaggccagagatgaggccgtgcaggagaggaagagggccctggaggccgagcggcaggcccgggtggaggagctgctgatgaagaggaaggagcaggaggcccgcatcgagcagcagaggcaggagaaggagaaggcccgggaggatgctgcccgggagcgggcccgggaccgggaggagcggctggccgccctgacagctgcccagcaggaggccatggaggagctgcagaagaagatccagctgaagcatgatgagagcatcagaagacacatggagcagatcgagcagaggaaggagaaggctgctgagctgagcagcggcagacatgccaacacagattatgcccccaagctgaccccctatgaaaggaagaagcagtgcagcctgtgcaatgtgctgatcagcagcgaggtgtacctgttcagccacgtgaagggcaggaagcaccagcaggccgtgcgggagaacaccagcatccagggccgggagctgagtgatgaggaggtggagcacctgagcctgaagaagtacatcatcgacatcgtggtggagagcacagccccagctgaggccctgaaggatggagaggagcggcagaagaacaagaagaaggccaagaagatcaaggccaggatgaacttccgggccaaggagtatgagagcctgatggagaccaagaacagcggcagtgacagcccctacaaggccaagctgcagaggctggccaaggacctgctgaagcaggtgcaggtgcaggacagcggctcctgggccaacaacaaggtgtctgccctggacaggaccctgggggagatcacccgcatcctggagaaggaaaatgtggccgaccagatcgccttccaggccgccggcggcctgacagccctggagcacatcctgcaggccgtggtgcctgccaccaacgtgaacacagtgctgcgcatcccccccaagagcctgtgcaatgccatcaacgtgtacaacctgacctgcaacaactgcagcgagaactgcagtgatgtgctcttcagcaacaagatcaccttcctgatggacctgctgatccaccagctgactgtgtatgtgcctgatgagaacaacaccatcctgggcaggaacaccaacaagcaggtgtttgagggcctgaccaccggcctgctgaaggtgtctgctgtggtgctgggctgcctgattgccaacagaccagatggcaactgccagcctgccacccccaagatccccacccaggagatgaagaacaagcccagccagggcgaccccttcaacaacagagtgcaggacctgatctcctatgtggtgaacatgggcctgattgacaagctgtgtgcctgcttcctgtctgtgcagggccctgtggatgagaaccccaagatggccatcttcctgcagcacgccgccggcctgctgcacgccatgtgcaccctgtgctttgctgtgacaggccgcagctacagcatctttgacaacaaccggcaggaccccaccggcctgacagctgccctgcaggccacagacctggccggcgtgctgcacatgctgtactgtgtgctcttccacggcaccatcctggaccccagcacagccagccccaaggagaactacacccagaacaccatccaggtggccatccagagcctgcgcttcttcaacagctttgctgccctgcacctgcctgccttccagagcatcgtgggcgctgagggcctgagcctggccttccgccacatggccagcagcctgctgggccactgcagccaggtgtcctgtgagagcctgctgcacgaggtgattgtgtgtgtgggctacttcaccgtgaaccacccagacaaccaggtgattgtgcagagcggccgccaccccaccgtgctgcagaagctgtgccagctgcccttccagtacttcagtgaccccaggctcatcaaggtgctcttccccagcctgattgctgcctgctacaacaaccaccagaacaagatcatcctggagcaggagatgagctgtgtgctgctggccaccttcatccaggacctggcccagaccccaggccaggccgagaaccagccctaccagcccaagggcaagtgcctgggcagccaggactacctggagctggccaaccgcttcccccagcaggcctgggaggaggcccggcagttcttcctgaagaaggagaagaagtag

SEQ ID NO: 171461 - DNA, 4203 bp, Artificial Sequence; identical to SEQ ID NO: 171459
  Description of Artificial Sequence: Synthetic coding sequence

SEQ ID NO: 171462 - DNA, 1233 bp, Artificial Sequence
  Description of Artificial Sequence: Synthetic coding sequence
atgcacaggaagcacctgcaggagatcccagacctgagcagcaatgtggccaccagcttcacctggggctgggacagcagcaagaccagcgagctgctgagcggcatgggcgtgtctgccctggagaaggaggagccagacagcgagaacatcccccaggagctgctgagcaacctgggccaccctgagagcccccccaggaagaggctgaagagcaaaggaagtgacaaggactttgtgattgtgagaagacccaagctgaaccgggagaacttccctggggtgtcctgggacagcctgcctgatgagctgctgctgggcatcttcagctgcctgtgcctgcctgagctgctgaaggtgtctggagtgtgcaagcgctggtaccgcctggccagtgatgagagcctgtggcagaccctggacctgaccgggaagaacctgcacccagatgtgacaggccgcctgctgagccagggcgtgattgccttccgctgccccaggagcttcatggaccagcccctggccgagcacttcagccccttccgggtgcagcacatggacctgagcaacagcgtgattgaggtgtccaccctgcacggcatcctgagccagtgcagcaagctgcagaacctgagcctggagggcctgcggctgagtgaccccatcgtgaacaccctggccaagaacagcaacctggtgcggctgaacctgagcggctgcagcggcttcagcgagtttgccctgcagaccctgctgagcagctgcagccggctggatgagctgaacctgtcctggtgctttgacttcacagagaagcacgtgcaggtggccgtggcccacgtgtctgagaccatcacccagctgaacctgagcggctacaggaagaacctgcagaagagtgacctgagcaccctggtgcggcgctgccccaacctggtgcacctggacctgagtgacagcgtgatgctgaagaatgactgcttccaggagttcttccagctgaactacctgcagcacctgagcctgagccgctgctatgacatcatccctgagaccctgctgctggtgaccagggctggggtgcgcatccggctggacagcgacatcggctgcccccagacctaccgcaccagcaagctgaagagcagccacaagctgttctgccagcacgtgcgggtcatctgcatctttgtgtgtgacttctacttctaccgcctggtgctgaagcagtag

SEQ ID NO: 171463 - DNA, 1275 bp, Artificial Sequence
  Description of Artificial Sequence: Synthetic coding sequence
atgcacaggaagcacctgcaggagatcccagacctgagcagcaatgtggccaccagcttcacctggggctgggacagcagcaagaccagcgagctgctgagcggcatgggcgtgtctgccctggagaaggaggagccagacagcgagaacatcccccaggagctgctgagcaacctgggccaccctgagagcccccccaggaagaggctgaagagcaaaggaagtgacaaggactttgtgattgtgagaagacccaagctgaaccgggagaacttccctggggtgtcctgggacagcctgcctgatgagctgctgctgggcatcttcagctgcctgtgcctgcctgagctgctgaaggtgtctggagtgtgcaagcgctggtaccgcctggccagtgatgagagcctgtggcagaccctggacctgaccgggaagaacctgcacccagatgtgacaggccgcctgctgagccagggcgtgattgccttccgctgccccaggagcttcatggaccagcccctggccgagcacttcagccccttccgggtgcagcacatggacctgagcaacagcgtgattgaggtgtccaccctgcacggcatcctgagccagtgcagcaagctgcagaacctgagcctggagggcctgcggctgagtgaccccatcgtgaacaccctggccaagaacagcaacctggtgcggctgaacctgagcggctgcagcggcttcagcgagtttgccctgcagaccctgctgagcagctgcagccggctggatgagctgaacctgtcctggtgctttgacttcacagagaagcacgtgcaggtggccgtggcccacgtgtctgagaccatcacccagctgaacctgagcggctacaggaagaacctgcagaagagtgacctgagcaccctggtgcggcgctgccccaacctggtgcacctggacctgagtgacagcgtgatgctgaagaatgactgcttccaggagttcttccagctgaactacctgcagcacctgagcctgagccgctgctatgacatcatccctgagaccctgctggagctgggggagatccccaccctgaagaccctgcaggtgtttggcatcgtgcctgatggcaccctgcagctgctgaaggaggccctgccccacctgcagatcaactgcagccacttcaccaccatcgcccggcccaccatcggcaacaagaagaaccaggagatctggggcatcaagtgccgcctgaccctgcagaagcccagctgcctgtag

SEQ ID NO: 171464 - DNA, 1173 bp, Artificial Sequence
  Description of Artificial Sequence: Synthetic coding sequence
atgcacaggaagcacctgcaggagaaggaggagccagacagcgagaacatcccccaggagctgctgagcaacctgggccaccctgagagcccccccaggaagaggctgaagagcaaaggaagtgacaaggactttgtgattgtgagaagacccaagctgaaccgggagaacttccctggggtgtcctgggacagcctgcctgatgagctgctgctgggcatcttcagctgcctgtgcctgcctgagctgctgaaggtgtctggagtgtgcaagcgctggtaccgcctggccagtgatgagagcctgtggcagaccctggacctgaccgggaagaacctgcacccagatgtgacaggccgcctgctgagccagggcgtgattgccttccgctgccccaggagcttcatggaccagcccctggccgagcacttcagccccttccgggtgcagcacatggacctgagcaacagcgtgattgaggtgtccaccctgcacggcatcctgagccagtgcagcaagctgcagaacctgagcctggagggcctgcggctgagtgaccccatcgtgaacaccctggccaagaacagcaacctggtgcggctgaacctgagcggctgcagcggcttcagcgagtttgccctgcagaccctgctgagcagctgcagccggctggatgagctgaacctgtcctggtgctttgacttcacagagaagcacgtgcaggtggccgtggcccacgtgtctgagaccatcacccagctgaacctgagcggctacaggaagaacctgcagaagagtgacctgagcaccctggtgcggcgctgccccaacctggtgcacctggacctgagtgacagcgtgatgctgaagaatgactgcttccaggagttcttccagctgaactacctgcagcacctgagcctgagccgctgctatgacatcatccctgagaccctgctggagctgggggagatccccaccctgaagaccctgcaggtgtttggcatcgtgcctgatggcaccctgcagctgctgaaggaggccctgccccacctgcagatcaactgcagccacttcaccaccatcgcccggcccaccatcggcaacaagaagaaccaggagatctggggcatcaagtgccgcctgaccctgcagaagcccagctgcctgtag

SEQ ID NO: 171465 - DNA, 633 bp, Artificial Sequence
  Description of Artificial Sequence: Synthetic coding sequence
atggaccagcccctggccgagcacttcagcaccctggccaagaacagcaacctggtgcggctgaacctgagcggctgcagcggcttcagcgagtttgccctgcagaccctgctgagcagctgcagccggctggatgagctgaacctgtcctggtgctttgacttcacagagaagcacgtgcaggtggccgtggcccacgtgtctgagaccatcacccagctgaacctgagcggctacaggaagaacctgcagaagagtgacctgagcaccctggtgcggcgctgccccaacctggtgcacctggacctgagtgacagcgtgatgctgaagaatgactgcttccaggagttcttccagctgaactacctgcagcacctgagcctgagccgctgctatgacatcatccctgagaccctgctggagctgggggagatccccaccctgaagaccctgcaggtgtttggcatcgtgcctgatggcaccctgcagctgctgaaggaggccctgccccacctgcagatcaactgcagccacttcaccaccatcgcccggcccaccatcggcaacaagaagaaccaggagatctggggcatcaagtgccgcctgaccctgcagaagcccagctgcctgtag

SEQ ID NO: 171466 - DNA, 1362 bp, Artificial Sequence
  Description of Artificial Sequence: Synthetic coding sequence
atggccctggtgcgggccctggtgtgctgcctgctgacagcctggcactgccgcagcggcctgggcctgcctgtggccccagctgggggcagaaatcctcctccagccatcggccagttctggcacgtgacagacctgcacctggaccccacctaccacatcacagatgaccacaccaaggtgtgtgccagcagcaagggggccaatgccagcaaccctggcccctttggagatgtgctgtgtgacagcccctaccagctgatcctgagcgcctttgacttcatcaagaacagcggccaggaggccagcttcatgatctggacaggagacagccccccccacgtgcctgtgcctgagctgagcacagacaccgtcatcaacgtcatcaccaacatgaccaccaccatccagagcctcttccccaacctgcaggtgtttcctgccctgggcaaccacgactactggccccaggaccagctgcctgtggtgaccagcaaggtgtacaatgctgtggccaacctgtggaagccctggctggatgaggaggccatcagcaccctgaggaaaggaggcttctacagccagaaggtgaccaccaaccccaacctgcgcatcatcagcctgaacaccaacctgtactacggccccaacatcatgaccctgaacaagacagatcctgccaaccagtttgagtggctggagagcaccctgaacaacagccagcagaacaaggagaaggtgtacatcatcgcccacgtgcctgtgggctacctgcccagcagccagaacatcacagccatgagggagtactacaatgagaagctgattgacatcttccagaagtacagtgatgtgattgctggccagttctacggccacacccaccgggacagcatcatggtgctgagtgacaagaagggcagccctgtgaacagcctgtttgtggccccagctgtgacccctgtgaagtctgtgctggagaagcagaccaacaaccctggcatccgcctcttccagtatgacccccgggactacaagctgctggacatgctgcagtactacctgaacctgacagaggccaacctgaagggggagagcatctggaagctggagtacatcctgacccagacctatgacatcgaggacctgcagcctgagagcctgtatggcctggccaagcagttcaccatcctggacagcaagcagttcatcaagtactacaactacttctttgtgtcctatgacagctctgtgacctgtgacaagacctgcaaggccttccagatctgtgccatcatgaacctggacaacatctcctatgctgactgcctgaagcagctgtacatcaagcacaactactag

SEQ ID NO: 171467 - DNA, 969 bp, Artificial Sequence
  Description of Artificial Sequence: Synthetic coding sequence
atgaccaccaccatccagagcctcttccccaacctgcaggtgtttcctgccctgggcaaccacgactactggccccaggaccagctgcctgtggtgaccagcaaggtgtacaatgctgtggccaacctgtggaagccctggctggatgaggaggccatcagcaccctgaggaagggcggcttctacagccagaaggtgaccaccaaccccaacctgcgcatcatcagcctgaacaccaacctgtactacggccccaacatcatgaccctgaacaagacagatcctgccaaccagtttgagtggctggagagcaccctgaacaacagccagcagaacaaggagaaggtgtacatcatcgcccacgtgcctgtgggctacctgcccagcagccagaacatcacagccatgagggagtactacaatgagaagctgattgacatcttccagaagtacagtgatgtgattgctggccagttctacggccacacccaccgggacagcatcatggtgctgagtgacaagaagggcagccctgtgaacagcctgtttgtggccccagctgtgacccctgtgaagtctgtgctggagaagcagaccaacaaccctggcatccgcctcttccagtatgacccccgggactacaagctgctggacatgctgcagtactacctgaacctgacagaggccaacctgaagggggagagcatctggaagctggagtacatcctgacccagacctatgacatcgaggacctgcagcctgagagcctgtatggcctggccaagcagttcaccatcctggacagcaagcagttcatcaagtactacaactacttctttgtgtcctatgacagctctgtgacctgtgacaagacctgcaaggccttccagatctgtgccatcatgaacctggacaacatctcctatgctgactgcctgaagcagctgtacatcaagcacaactactag

SEQ ID NO: 171468 - DNA, 726 bp, Artificial Sequence
  Description of Artificial Sequence: Synthetic coding sequence
atgaaggaggtggtgtactggagccccaagaaggtggccgactggctgctggagaatgccatgcctgagtactgtgagcccctggagcacttcaccggccaggacctgatcaacctgacccaggaggacttcaagaagccacccctgtgccgggtgtccagtgacaatggccagaggctgctggacatgattgagaccctgaagatggagcaccacctggaggcccacaagaatggccacgccaacggccacctgaacattggagtggacatccccaccccagatggcagcttcagcatcaagatcaagcccaacggcatgcccaacggctacaggaaggagatgatcaagatccccatgcctgagctggagaggagccagtaccccatggagtggggcaagaccttcctggccttcctgtatgccctgagctgctttgtgctgaccaccgtgatgatctctgtggtgcatgagcgggtgccccccaaggaggtgcagccccccctgcctgacaccttctttgaccacttcaacagagtgcagtgggccttcagcatctgtgagatcaatggcatgatcctggtgggcctgtggctgatccagtggctgctgctgaagtacaaggatgtgggcaatgaaagccgggtggtgatgatcttcctgagcatcgtgcaccctgtgctgctgctgggcagcattgctggcttcctgagcctgagcctgtag

SEQ ID NO: 171469 - DNA, 1242 bp, Artificial Sequence
  Description of Artificial Sequence: Synthetic coding sequence
atgaaggaggtggtgtactggagccccaagaaggtggccgactggctgctggagaatgccatgcctgagtactgtgagcccctggagcacttcaccggccaggacctgatcaacctgacccaggaggacttcaagaagccacccctgtgccgggtgtccagtgacaatggccagaggctgctggacatgattgagaccctgaagatggagcaccacctggaggcccacaagaatggccacgccaacggccacctgaacattggagtggacatccccaccccagatggcagcttcagcatcaagatcaagcccaacggcatgcccaacggctacaggaaggagatgatcaagatccccatgcctgagctggagaggagccagtaccccatggagtggggcaagaccttcctggccttcctgtatgccctgagctgctttgtgctgaccaccgtgatgatctctgtggtgcatgagcgggtgccccccaaggaggtgcagccccccctgcctgacaccttctttgaccacttcaacagagtgcagtgggccttcagcatctgtgagatcaatggcatgatcctggtgggcctgtggctgatccagtggctgctgctgaagtacaagagcatcatcagccgccgcttcttctgcatcgtgggcaccctgtacctgtaccgctgcatcaccatgtatgtgaccaccctgcctgtgcccggcatgcacttcaactgcagccccaagctgtttggagactgggaggcccagctgcggcgcatcatgaagctgattgctgggggcggcctgagcatcaccggcagccacaacatgtgtggggactacctgtacagcggccacacagtgatgctgaccctgacctacctgttcatcaaggagtacagcccccggcggctgtggtggtaccactggatctgctggctgctgtctgtggtgggcatcttctgcatcctgctggcccatgaccactacacagtggatgtggtggtggcctactacatcaccaccaggctcttctggtggtaccacaccatggccaaccagcaggtgctgaaggaggccagccagatgaacctgctggcccgggtgtggtggtaccggcccttccagtactttgagaagaatgtgcagggcatcgtgcccaggagctaccactggcccttcccctggcctgtggtgcacctgagccggcaggtgaagtacagccggctggtgaatgacacctag

SEQ ID NO: 171470 - DNA, 642 bp, Artificial Sequence
  Description of Artificial Sequence: Synthetic coding sequence
acctacatgtacatcagcaacaagagcatcatcagccgccgcttcttctgcatcgtgggcaccctgtacctgtaccgctgcatcaccatgtatgtgaccaccctgcctgtgcccggcatgcacttcaactgcagccccaagctgtttggagactgggaggcccagctgcggcgcatcatgaagctgattgctgggggcggcctgagcatcaccggcagccacaacatgtgtggggactacctgtacagcggccacacagtgatgctgaccctgacctacctgttcatcaaggagtacagcccccggcggctgtggtggtaccactggatctgctggctgctgtctgtggtgggcatcttctgcatcctgctggcccatgaccactacacagtggatgtggtggtggcctactacatcaccaccaggctcttctggtggtaccacaccatggccaaccagcaggtgctgaaggaggccagccagatgaacctgctggcccgggtgtggtggtaccggcccttccagtactttgagaagaatgtgcagggcatcgtgcccaggagctaccactggcccttcccctggcctgtggtgcacctgagccggcaggtgaagtacagccggctggtgaatgacacctag

SEQ ID NO: 171471 - DNA, 735 bp, Artificial Sequence
  Description of Artificial Sequence: Synthetic coding sequence
atgggcggccggggcggcggcggccgcagccggcagctgcccggccgcttccgggccccagctgcccgctggccaggcggccgctggctgcccggggcccccaggacagtgacctggagcatcatcagccgccgcttcttctgcatcgtgggcaccctgtacctgtaccgctgcatcaccatgtatgtgaccaccctgcctgtgcccggcatgcacttcaactgcagccccaagctgtttggagactgggaggcccagctgcggcgcatcatgaagctgattgctgggggcggcctgagcatcaccggcagccacaacatgtgtggggactacctgtacagcggccacacagtgatgctgaccctgacctacctgttcatcaaggagtacagcccccggcggctgtggtggtaccactggatctgctggctgctgtctgtggtgggcatcttctgcatcctgctggcccatgaccactacacagtggatgtggtggtggcctactacatcaccaccaggctcttctggtggtaccacaccatggccaaccagcaggtgctgaaggaggccagccagatgaacctgctggcccgggtgtggtggtaccggcccttccagtactttgagaagaatgtgcagggcatcgtgcccaggagctaccactggcccttcccctggcctgtggtgcacctgagccggcaggtgaagtacagccggctggtgaatgacacctag

SEQ ID NO: 171472 - DNA, 1098 bp, Artificial Sequence
  Description of Artificial Sequence: Synthetic coding sequence
atggacatcatcgagacagccaagctggaggagcacctggagaaccagcccagcgaccccaccaacacctacgcccggcctgctgagcctgtggaggaggagaacaagaatggaaatggcaagcccaagagcctgagcagcggcctgaggaagggcaccaagaagtacccagactacatccagatcgccatgcccacagagagcaggaacaagttccccctggagtggtggaagacaggaattgccttcatctatgctgtgttcaacctggtgctgaccaccgtgatgatcaccgtggtgcatgagcgggtgccccccaaggagctgagcccccccctgcctgacaagttctttgactacatcgacagagtgaagtgggccttctctgtgtctgagatcaatggcatcatcctggtgggcctgtggatcacccagtggctgttcctgcgctacaagagcatcgtgggccgccgcttctgcttcatcatcggcaccctgtacctgtaccgctgcatcaccatgtatgtgaccaccctgcctgtgcccggcatgcacttccagtgtgcccccaagctgaatggagacagccaggccaaggtgcagaggatcctgcggctcatcagcggcggcggcctgagcatcaccggcagccacatcctgtgtggggacttcctgttcagcggccacacagtgaccctgaccctgacctacctgttcatcaaggagtacagccccaggcacttctggtggtaccacctgatctgctggctgctgtctgctgctggcatcatctgcatcctggtggcccacgagcactacaccattgatgtgatcatcgcctactacatcaccaccaggctcttctggtggtaccacagcatggccaatgagaagaacctgaaggtgagcagccagaccaacttcctgagccgggcctggtggttccccatcttctacttctttgagaagaatgtgcagggcagcatcccctgctgcttctcctggcccctgtcctggcccccaggctgcttcaagagcagctgcaagaagtacagccgggtgcagaagattggagaagataatgagaagagcacctag

SEQ ID NO: 171473 - DNA, 1098 bp, Artificial Sequence; identical to SEQ ID NO: 171472
  Description of Artificial Sequence: Synthetic coding sequence

SEQ ID NO: 171474 - DNA, 1098 bp, Artificial Sequence; identical to SEQ ID NO: 171472
  Description of Artificial Sequence: Synthetic coding sequence

SEQ ID NO: 171475 - DNA, 135 bp, Artificial Sequence
  Description of Artificial Sequence: Synthetic coding sequence
atggacatcatcgagacagccaagctggaggagcacctggagaaccagcccagcgaccccaccaacacctacgcccggcctgctgagcctgtggaggaggagaacaagaatggaaatggcaagcccaagagctag

SEQ ID NO: 171476 - DNA, 105 bp, Artificial Sequence
  Description of Artificial Sequence: Synthetic coding sequence
atggacatcatcgagacagccaagctggaggagcacctggagaaccagcccagcgaccccaccaacacctacgcccggcctgctgagcctgtggaggaggagtag

SEQ ID NO: 171477 - DNA, 1326 bp, Artificial Sequence
  Description of Artificial Sequence: Synthetic coding sequence
atgagcctgcggcagaggctggcccagctggtgggccgcctgcaggacccccagaaggtggcccgcttccagaggctgtgtggggtggaggccccaccccggcgctctgctgacagaagagaagatgagaaggccgaggcccccctggccggggacccccggctgcggggccggcagcccggggcccctgggggcccccagcccccaggcagtgacaggaaccagtgcccagccaagccagatggcggcggggccccaaatggagtgagaaatggcctggccgctgagctgggccctgccagccccaggagagctggggccctgcggaggaacagcctgaccggggaggagggccagctggcccgggtgagcaactggcccctgtactgcctcttctgcttcggcacagagctgggcaatgagctgttctacatcctcttcttccccttctggatctggaacctggaccccctggtgggccgccgcctggtggtgatctgggtgctggtgatgtacctgggccagtgcaccaaggacatcatccgctggcccaggcctgccagcccccctgtggtgaagctggaggtgttctacaacagcgagtacagcatgcccagcacccacgccatgtctggaacagccatccccatctccatggtgctgctgacctacggccgctggcagtaccccctcatctacggcctcatcctgatcccctgctggtgcagcctggtgtgcctgagccgcatctacatgggcatgcacagcatcctggacatcatcgccggcttcctgtacaccatcctgatcctggccgtgttctacccctttgtggacctgattgacaacttcaaccagacccacaagtatgcccccttcatcatcatcggcctgcacctggccctgggcatcttctccttcaccctggacacctggagcaccagcagaggagacacagctgagatcctgggcagcggggccggcatcgcctgtggcagccacgtgacctacaacatgggcctggtgctggaccccagcctggacaccctgcccctggccggcccccccatcaccgtgaccctgtttgggaaggccatcctgcgcatcctgattggcatggtgtttgtgctgatcatcagagatgtgatgaagaagatcaccatccccctggcctgcaagatcttcaacatcccctgtgatgacatcaggaaggcccggcagcacatggaggtggagctgccctaccgctacatcacctacggcatggtgggcttcagcatcaccttctttgtgccctacatcttcttcttcatcggcatctcctag

SEQ ID NO: 171478 - DNA, 1200 bp, Artificial Sequence
  Description of Artificial Sequence: Synthetic coding sequence
atggccgagctgctgcggagcctgcaggacagccagctggtggcccgcttccagaggcgctgtggcctcttccctgccccagatgagggccccagagaaaatggagctgaccccacagagcgggccgcccgggtgcctggggtggagcacctgcctgctgccaatggaaaaggaggagaggccccagccaacggcctgcggcgggccgccgcccctgaggcctacgtgcagaagtatgtggtgaagaactacttctactactacctgttccagttctctgctgccctgggccaggaggtgttctacatcaccttcctgcccttcacccactggaacatcgacccctacctgagcagaagactcatcatcatctgggtgctggtgatgtacatcggccaggtggccaaggatgtgctgaagtggccccggcccagcagcccccctgtggtgaagctggagaagaggctgattgctgaatatggcatgcccagcacccacgccatggccgccacagccatcgccttcaccctgctgatcagcaccatggaccgctaccagtacccctttgtgctgggcctggtgatggctgtggtgttcagcaccctggtgtgcctgagccggctgtacacaggcatgcacacagtgctggatgtgctgggcggcgtgctgatcacagccctgctgattgtgctgacctacccagcctggaccttcatcgactgcctggacagcgccagccccctcttccctgtgtgtgtgattgtggtgcccttcttcctgtgctacaactaccctgtgtctgactactacagccccaccagggctgacaccaccaccatcctggccgccggggccggcgtgaccatcggcttctggatcaaccacttcttccagctggtgtccaagccagctgagagcctgcccgtcatccagaacatcccccccctgaccacctacatgctggtgctgggcctgaccaagtttgctgtgggcatcgtgctgatcctgctggtgcggcagctggtgcagaacctgagcctgcaggtgctgtacagctggttcaaggtggtgaccaggaacaaggaggcccggcggcggctggagattgaggtgccctacaagtttgtgacctacacctctgtgggcatctgtgccaccacctttgtgcccatgctgcaccgcttcctgggcctgccctag

SEQ ID NO: 171479 - DNA, 1062 bp, Artificial Sequence
  Description of Artificial Sequence: Synthetic coding sequence
atgggcagcctgtacagcgagtacctgaaccccaacaaggtgcaggagcactacaactacaccaaggagaccctggagacccaggagaccaccagccggcaggtggccagcgccttcatcgtcatcctgtgctgtgccatcgtggtggagaacctgctggtgctgattgctgtggccaggaacagcaagttccacagcgccatgtacctgttcctgggcaacctggccgccagtgacctgctggccggcgtggcctttgtggccaacaccctgctgagcggctctgtgaccctgcggctgacccctgtgcagtggtttgcccgggagggcagcgccttcatcaccctgagcgcctctgtgttcagcctgctggccatcgccatcgagagacatgtggccatcgccaaggtgaagctgtatggcagtgacaagagctgcaggatgctgctgctgattggagcctcctggctgatcagcctggtgctgggcggcctgcccatcctgggctggaactgcctgggccacctggaggcctgcagcacagtgctgcccctgtatgccaagcactacgtgctgtgtgtggtgaccatcttcagcatcatcctgctggccatcgtggccctgtatgtgcgcatctactgtgtggtgcgcagcagccatgctgacatggccgccccccagaccctggccctgctgaagacagtgaccatcgtgctgggcgtcttcatcgtgtgctggctgcctgccttcagcatcctgctgctggactatgcctgccctgtgcacagctgccccatcctgtacaaggcccactacttctttgctgtgtccaccctgaacagcctgctgaaccctgtgatctacacctggaggagccgggacctgcggcgggaggtgctgcggcccctgcagtgctggaggcctggggtgggcgtgcagggcagaagaagaggaggcaccccaggccaccacctgctgcccctgcggagcagcagcagcctggagcggggcatgcacatgcccaccagccccaccttcctggagggcaacacagtggtgtag

SEQ ID NO: 171480 - DNA, 1137 bp, Artificial Sequence
  Description of Artificial Sequence: Synthetic coding sequence
atggccacagccctgcccccccggctgcagcctgtgagaggaaatgagaccctgcgggagcactaccagtatgtgggcaagctggccggccgcctgaaggaggccagcgagggcagcaccctgaccaccgtgctcttcctggtgatctgcagcttcatcgtgctggagaacctgatggtgctgattgccatctggaagaacaacaagttccacaacaggatgtacttcttcatcggcaacctggccctgtgtgacctgctggccggcatcgcctacaaggtgaacatcctgatgtctgggaagaagaccttcagcctgagccccaccgtgtggttcctgcgggagggctccatgtttgtggccctgggcgccagcacctgcagcctgctggccatcgccatcgagcggcacctgaccatgatcaagatgaggccctatgatgccaacaagaggcacagggtcttcctgctgattggcatgtgctggctgattgccttcaccctgggcgccctgcccatcctgggctggaactgcctgcacaacctgcctgactgcagcaccatcctgcccctgtacagcaagaagtacatcgccttctgcatcagcatcttcaccgccatcctggtgaccatcgtcatcctgtatgcccgcatctacttcctggtgaagagcagcagcaggaaggtggccaaccacaacaacagcgagaggtccatggccctgctgaggacagtggtgattgtggtgtctgtgttcatcgcctgctggagccccctcttcatcctcttcctgattgatgtggcctgccgggtgcaggcctgccccatcctcttcaaggcccagtggttcatcgtgctggccgtgctgaacagcgccatgaaccctgtgatctacaccctggccagcaaggagatgaggcgggccttcttccggctggtgtgcaactgcctggtgcggggccgcggggcccgggccagccccatccagcctgccctggaccccagccgcagcaagagcagcagcagcaacaacagcagccacagccccaaggtgaaggaggacctgccccacacagcccccagcagctgcatcatggacaagaatgctgccctgcagaatggcatcttctgcaactag

SEQ ID NO: 171481 - DNA, 1137 bp, Artificial Sequence; identical to SEQ ID NO: 171480
  Description of Artificial Sequence: Synthetic coding sequence

SEQ ID NO: 171482 - DNA, 1155 bp, Artificial Sequence
  Description of Artificial Sequence: Synthetic coding sequence
atgaatgccaccggcacccctgtggcccctgagagctgccagcagctggccgccggcggccacagccggctgattgtgctgcactacaaccacagcggccgcctggccggccggggcggcccagaagatggcggcctgggcgccctgcggggcctgtctgtggccgccagctgcctggtggtgctggagaacctgctggtgctggccgccatcaccagccacatgaggagccgccgctgggtgtactactgcctggtgaacatcaccctgagtgacctgctgactggagctgcctacctggccaacgtgctgctgagcggggcccggaccttccggctggccccagcccagtggttcctgcgggagggcctgctcttcaccgccctggccgccagcaccttcagcctgctcttcaccgctggggagagatttgccaccatggtgcggcctgtggccgagagcggggccaccaagaccagccgggtgtatggcttcatcggcctgtgctggctgctggccgccctgctgggcatgctgcccctgctgggctggaactgcctgtgtgcctttgaccgctgcagcagcctgctgcccctgtacagcaagcgctacatcctcttctgcctggtgatctttgctggggtgctggccaccatcatgggcctgtatggagccatcttccggctggtgcaggccagcggccagaaggcccccaggcctgctgcccggaggaaggcccggcggctgctgaagacagtgctgatgatcctgctggccttcctggtgtgctggggccccctgtttggcctgctgctggctgatgtgtttggcagcaacctgtgggcccaggagtacctgcggggcatggactggatcctggccctggccgtgctgaacagcgctgtgaaccccatcatctacagcttccgcagccgggaggtgtgcagagctgtgctgtccttcctgtgctgcggctgcctgcggctgggcatgaggggccctggggactgcctggcccgggctgtggaggcccacagcggggccagcaccacagacagcagcctgcggccccgggacagcttccggggcagccgcagcctgtccttcaggatgagggagcccctgagcagcatcagctctgtgcgcagcatctag

SEQ ID NO: 171483 - DNA, 1197 bp, Artificial Sequence
  Description of Artificial Sequence: Synthetic coding sequence
atggagagcggcctgctgcggcctgcccctgtgtctgaggtgattgtgctgcactacaactacaccgggaagctgcggggggcccgctaccagcccggggccggcctgcgggcagatgctgtggtgtgcctggccgtgtgtgccttcatcgtgctggagaacctggccgtgctgctggtgctgggccgccacccccgcttccacgcccccatgttcctgctgctgggcagcctgaccctgagtgacctgctggccggggccgcctatgctgccaacatcctgctgagcggccccctgaccctgaagctgagccctgccctgtggtttgcccgggagggcggcgtgtttgtggccctgacagcctctgtgctgagcctgctggccatcgccctggagaggagcctgaccatggcccggcggggccctgcccctgtgagcagccggggccgcaccctggccatggctgctgctgcctggggcgtgtccctgctgctgggcctgctgcctgccctgggctggaactgcctgggccgcctggatgcctgcagcacagtgctgcccctgtatgccaaggcctacgtgctcttctgtgtgctggcctttgtgggcatcctggccgccatctgtgccctgtatgcccgcatctactgccaggtgcgggccaatgcccggcggctgcctgcccggcccggcacagctggcaccaccagcacccgggcccggaggaagcccaggagcctggccctgctgcggaccctgtctgtggtgctgctggcctttgtggcctgctggggccccctcttcctgctgctgctgctggatgtggcctgcccagcccggacctgccctgtgctgctgcaggccgaccccttcctgggcctggccatggccaacagcctgctgaaccccatcatctacaccctgaccaacagagacctgcggcatgccctgctgcggctggtgtgctgcggccgccacagctgtggccgggaccccagcggcagccagcagagcgccagcgctgctgaggccagcggcggcctgcggcgctgcctgcccccaggcctggatggcagcttcagcggcagcgagaggagcagcccccagagagatggcctggacaccagcggcagcacaggcagccctggggcccccacagctgcccggaccctggtgtctgagcctgctgctgactag

SEQ ID NO: 171484 - DNA, 933 bp, Artificial Sequence
  Description of Artificial Sequence: Synthetic coding sequence
atggagagcggcctgctgcggcctgcccctgtgtctgaggtgattgtgctgcactacaactacaccgggaagctgcggggggcccgctaccagcccggggccggcctgcgggcagatgctgtggtgtgcctggccgtgtgtgccttcatcgtgctggagaacctggccgtgctgctggtgctgggccgccacccccgcttccacgcccccatgttcctgctgctgggcagcctgaccctgagtgacctgctggccggggccgcctatgctgccaacatcctgctgagcggccccctgaccctgaagctgagccctgccctgtggtttgcccgggagggcggcgtgtttgtggccctgacagcctctgtgctgagcctgctggccatcgccctggagaggagcctgaccatggcccggcggggccctgcccctgtgagcagccggggccgcaccctggccatggctgctgctgcctggggcgtgtccctgctgctgggcctgctgcctgccctgggctggaactgcctgggccgcctggatgcctgcagcacagtgctgcccctgtatgccaaggcctacgtgctcttctgtgtgctggcctttgtgggcatcctggccgccatctgtgccctgtatgccctggccggcctggccgcccacgcccagagaggagcccctggcctgtgtggcatgctgggcccccccctgcctgctgctgtggcccggcggggcgtgcctggggcccacctgagctgcaccccagctggccgcagcctgcccggcaccggccacggccagctgaccagcgagccccaccacctgcacgcccaccagcccaggcctgccccccgggccccagcccctggcctgctgcggacccccctgctgcggcagaggcctgagtggctgcctgctgtgggggagcggggctag

SEQ ID NO: 171485 - DNA, 1197 bp, Artificial Sequence; identical to SEQ ID NO: 171483
  Description of Artificial Sequence: Synthetic coding sequence

SEQ ID NO: 171486 - DNA, 5016 bp, Artificial Sequence
  Description of Artificial Sequence: Synthetic coding sequence
atggatggcaacagcctgctgtctgtgcccagcaacctggagagcagcaggatgtatgatgtgctggagccccagcagggccggggctgcggcagcagcggcagcggccctggcaacagcatcacagcctgcaagaaggtgctgcggagcaacagcctgctggagagcacagactactggctgcagaaccagaggatgccctgccagatcggctttgtggaggacaagtctgagaactgtgcctctgtgtgctttgtgaacctggatgtgaacaaggatgagtgcagcacagagcacctgcagcagaagctggtgaatgtgtccccagacctgcccaagctgatcagctccatgaatgtgcagcagcccaaggaaaatgagatcgtggtgctgagcggcctggccagcggcaacctgcaggccgactttgaggtgtcccagtgcccctggctgcctgacatctgcctggtgcagtgtgcccggggcaaccggcccaacagcaccaactgcatcatctttgagatcaacaagttcctgattggcctggagctggtgcaggagcggcagctgcacctggagaccaacatcctgaagctggaggatgacaccaactgcagcctgagcagcattgaggaggacttcctgacagccagcgagcacctggaggaggagagcgaggtggatgagagcagaaatgactatgagaacatcaacgtgtctgccaacgtgctggagagcaagcagctgaagggggccacccaggtggagtggaactgcaacaaggagaagtggctgtatgccctggaggacaagtacatcaacaagtaccccacccccctcatcaagacagagaggagccctgagaacctgaccaagaacacagccctgcagagcctggaccccagcgccaagcccagccagtggaagcgggaggccgtgggcaatggccggcaggccacccactactaccacagcgaggccttcaagggccagatggagaagagccaggccctgtacatccccaaggatgcctacttctccatgatggacaaggatgtgcccagcgcctgtgctgtggccgagcagaggagcaacctgaaccctggggaccacgaggacaccagaaatgccctgcccccccggcaggatggagaggtgaccaccgggaagtatgccaccaacctggccgagagcgtgctgcaggatgccttcatccggctgagccagagccagagcaccctgccccaggagagcgctgtgtctgtgtctgtgggcagcagcctgctgcccagctgctacagcaccaaggacacagtggtgagccgctcctggaatgagctgcccaagatcgtggtggtgcagagcccagatggcagtgatgctgccccccagcccggcatcagctcctggccagagatggaggtgtctgtggagaccagcagcatcctgagcggggagaacagcagccggcagccccagagcgccctggaggtggccctggcctgtgccgccaccgtgattggcaccatcagcagcccccaggccacagagcggctgaagatggagcaggtggtgagcaacttccccccaggcagcagcggggccctgcagacccaggccccccagggcctgaaggagcccagcatcaatgagtacagcttccccagcgccctgtgtggcatgacccaggtggccagcgctgtggccgtgtgtggcctgggggagcgggaggaggtgacctgcagcgtggcccccagcggcagcctgcccccagctgctgaggccagcgaggccatgccacccctgtgtggcctggcctccatggagctgggcaaggaggccatcgccaagggcctgctgaaggaggccgccctggtgctgacccggcccaacacctacagcagcatcggggacttcctggacagcatgaacagacgcatcatggagacagccagcaagagccagaccctgtgcagtgaaaatgtggtgagaaatgagctggcccacaccctgagcaatgtcatcctgcggcacagcattgatgaggtgcaccacaagaacatgatcatcgaccccaatgacaacagacacagcagcgagatcctggacaccctgatggagagcaccaaccagctgctgctggatgtgatctgcttcaccttcaagaagatgagccacatcgtgcggctgggggagtgcccagctgtgctgagcaaggagaccatcagaagaagagaaacagagcccagctgccagcccagcgaccccggggccagccaggcctggaccaaggccacagagagcagcagcagcagccccctgagcaacagccacaacaccagcctggtgatcaacaacctggtggatggcatgtacagcaagcaggacaagggcggcgtgcggcccggcctcttcaagaaccccaccctgcagagccagctgagccgcagccaccgggtgcctgacagcagcacagccaccaccagcagcaaggagatctacctgaagggcattgctggggaggacaccaagagcccccaccacagtgaaaatgaatgtcgggccagcagcgagggccagaggagccccaccgtgtcccagagccgcagcggcagccaggaggccgaggagagcatccaccccaacacccaggagaagtacaactgtgccaccagccgcatcaatgaggtgcaggtgaacctgagcctgctgggagatgacctgctgctgcctgcccagagcaccctgcagaccaagcacccagacatctactgcatcacagactttgctgaggagctggccgacacagtggtgtccatggccacagaaattgctgccatctgcctggacaacagcagcggcaagcagccctggttctgtgcctggaagaggggcagcgagttcctgatgaccccaaatgtgccctgccgcagcctgaagaggaagaaggagagccagggcagcggcacagctgtgaggaagcacaagccaccccggctgtctgagatcaagaggaagacagatgagcaccctgagctgaaggagaagctgatgaacagagtggtggatgagagcatgaacctggaggatgtgcctgacagcgtgaacctgtttgccaatgaggtggccgccaagatcatgaacctgacagagttctccatggtggatggcatgtggcaggcccagggctaccccaggaaccggctgctgagcggggaccgctggagccggctgaaggccagcagctgtgagagcatcccagaagaagattctgaggcccgggcctacgtgaacagcctgggcctgatgagcaccctgagccagcctgtgtcccgggccagctctgtgtccaagcagagcagctgtgagagcatcacagatgagttcagccgcttcatggtgaaccagatggagaatgaaggccggggctttgagctgctgctggactactatgctgggaagaatgccagcagcatcctgaacagcgccatgcagcaggcctgcaggaagagtgaccacctgtctgtgcggcccagctgccccagcaagcagagcagcacagagagcatcacagaggagttctaccgctacatgctgcgggacatcgagcgggacagccgggagagcgccagcagcagaagaagcagccaggactggacagctggcctgctgagccccagcctgcggagccctgtgtgccaccggcagagctccatgccagacagccgcagcccctgcagccggctgactgtgaatgtgcccatcaaggccaacagcctggatggctttgcccagaactgcccccaggacttcctgtctgtgcagcctgtgtcctctgccagcagcagcggcctgtgcaagagtgacagctgcctgtaccgccggggcggcacagaccacatcaccaacatgctgattcatgagacctgggccagcagcattgaggccctgatgaggaagaacaagatcatcgtggatgatgctgaggaggccgacacagagcctgtgtctgggggcagccccagccaggccgagaagtgtgccaaccggctggccgccagcaggatgtgcagcggccccaccctgctggtgcaggagagcctggactgccccaggaaggacagcgtgacagagtgcaagcagccccctgtgagcagcctgagcaagacagccagcctgaccaaccacagccccctggacagcaagaaggagaccagcagctgccaggaccctgtgcccatcaaccacaagaggaggagcctgtgcagccgggaggtgcccctcatccagattgaaacagaccagcgggaggcctgtgccggggagcctgagcccttcctgagcaagagcagcctgctggaggaggccgagggccacagcaatgacaagaacatcccagatgtggtgcggggcggggacacagctgtgtctgcctgccagatccacagcgacagcctggacaccagagatgtgcctgaggccgaggccagcacagaggcccgggccccagatgaggcccccaacccccccagcagcagcgaggagagcacaggctcctggacccagctggccaatgaggaggacaacccagatgacaccagcagcttcctgcagctgtctgagaggtccatgtctgagctggtggaggagaagaagatcctgaagggccagagcgagagcacagaggccccagccagcggcccccccaccggcacagccagcccccagaggagcctgctggtgatcaactttgacctggagccagaatgtccagatgctgagctgcgggccaccctgcagtggattgctgccagcgagctgggcatccccaccatctacttcaagaagagccaggagaaccgcatcgagaagttcctggatgtggtgcagctggtgcacaggaagtcctggaaggtgggggacatcttccacgctgtggtgcagtactgcaagatgcatgaggagcagaaggatggccgcctgagcctgtttgactggctgctggagctgggctag

SEQ ID NO: 171487 - DNA, 5103 bp, Artificial Sequence
  Description of Artificial Sequence: Synthetic coding sequence
atggatggcaacagcctgctgtctgtgcccagcaacctggagagcagcaggatgtatgatgtgctggagccccagcagggccggggctgcggcagcagcggcagcggccctggcaacagcatcacagcctgcaagaaggtgctgcggagcaacagcctgctggagagcacagactactggctgcagaaccagaggatgccctgccagatcggctttgtggaggacaagtctgagaactgtgcctctgtgtgctttgtgaacctggatgtgaacaaggatgagtgcagcacagagcacctgcagcagaagctggtgaatgtgtccccagacctgcccaagctgatcagctccatgaatgtgcagcagcccaaggaaaatgagatcgtggtgctgagcggcctggccagcggcaacctgcaggccgactttgaggtgtcccagtgcccctggctgcctgacatctgcctggtgcagtgtgcccggggcaaccggcccaacagcaccaactgcatcatctttgagatcaacaagttcctgattggcctggagctggtgcaggagcggcagctgcacctggagaccaacatcctgaagctggaggatgacaccaactgcagcctgagcagcattgaggaggacttcctgacagccagcgagcacctggaggaggagagcgaggtggatgagagcagaaatgactatgagaacatcaacgtgtctgccaacgtgctggagagcaagcagctgaagggggccacccaggtggagtggaactgcaacaaggagaagtggctgtatgccctggaggacaagtacatcaacaagtaccccacccccctcatcaagacagagaggagccctgagaacctgaccaagaacacagccctgcagagcctggaccccagcgccaagcccagccagtggaagcgggaggccgtgggcaatggccggcaggccacccactactaccacagcgaggccttcaagggccagatggagaagagccaggccctgtacatccccaaggatgcctacttctccatgatggacaaggatgtgcccagcgcctgtgctgtggccgagcagaggagcaacctgaaccctggggaccacgaggacaccagaaatgccctgcccccccggcaggatggagaggtgaccaccgggaagtatgccaccaacctggccgagagcgtgctgcaggatgccttcatccggctgagccagagccagagcaccctgccccaggagagcgctgtgtctgtgtctgtgggcagcagcctgctgcccagctgctacagcaccaaggacacagtggtgagccgctcctggaatgagctgcccaagatcgtggtggtgcagagcccagatggcagtgatgctgccccccagcccggcatcagctcctggccagagatggaggtgtctgtggagaccagcagcatcctgagcggggagaacagcagccggcagccccagagcgccctggaggtggccctggcctgtgccgccaccgtgattggcaccatcagcagcccccaggccacagagcggctgaagatggagcaggtggtgagcaacttccccccaggcagcagcggggccctgcagacccaggccccccagggcctgaaggagcccagcatcaatgagtacagcttccccagcgccctgtgtggcatgacccaggtggccagcgctgtggccgtgtgtggcctgggggagcgggaggaggtgacctgcagcgtggcccccagcggcagcctgcccccagctgctgaggccagcgaggccatgccacccctgtgtggcctggcctccatggagctgggcaaggaggccatcgccaagggcctgctgaaggaggccgccctggtgctgacccggcccaacacctacagcagcatcggggacttcctggacagcatgaacagacgcatcatggagacagccagcaagagccagaccctgtgcagtgaaaatgtggtgagaaatgagctggcccacaccctgagcaatgtcatcctgcggcacagcattgatgaggtgcaccacaagaacatgatcatcgaccccaatgacaacagacacagcagcgagatcctggacaccctgatggagagcaccaaccagctgctgctggatgtgatctgcttcaccttcaagaagatgagccacatcgtgcggctgggggagtgcccagctgtgctgagcaaggagaccatcagaagaagagaaacagagcccagctgccagcccagcgaccccggggccagccaggcctggaccaaggccacagagagcagcagcagcagccccctgagcaacagccacaacaccagcctggtgatcaacaacctggtggatggcatgtacagcaagcaggacaagggcggcgtgcggcccggcctcttcaagaaccccaccctgcagagccagctgagccgcagccaccgggtgcctgacagcagcacagccaccaccagcagcaaggagatctacctgaagggcattgctggggaggacaccaagagcccccaccacagtgaaaatgaatgtcgggccagcagcgagggccagaggagccccaccgtgtcccagagccgcagcggcagccaggaggccgaggagagcatccaccccaacacccaggagaagtacaactgtgccaccagccgcatcaatgaggtgcaggtgaacctgagcctgctgggagatgacctgctgctgcctgcccagagcaccctgcagaccaagcacccagacatctactgcatcacagactttgctgaggagctggccgacacagtggtgtccatggccacagaaattgctgccatctgcctggacaacagcagcggcaagcagccctggttctgtgcctggaagaggggcagcgagttcctgatgaccccaaatgtgccctgccgcagcctgaagaggaagaaggagagccagggcagcggcacagctgtgaggaagcacaagccaccccggctgtctgagatcaagaggaagacagatgagcaccctgagctgaaggagaagctgatgaacagagtggtggatgagagcatgaacctggaggatgtgcctgacagcgtgaacctgtttgccaatgaggtggccgccaagatcatgaacctgacagagttctccatggtggatggcatgtggcaggcccagggctaccccaggaaccggctgctgagcggggaccgctggagccggctgaaggccagcagctgtgagagcatcccagaagaagattctgaggcccgggcctacgtgaacagcctgggcctgatgagcaccctgagccagcctgtgtcccgggccagctctgtgtccaagcagagcagctgtgagagcatcacagatgagttcagccgcttcatggtgaaccagatggagaatgaaggccggggctttgagctgctgctggactactatgctgggaagaatgccagcagcatcctgaacagcgccatgcagcaggcctgcaggaagagtgaccacctgtctgtgcggcccagctgccccagcaagcagagcagcacagagagcatcacagaggagttctaccgctacatgctgcgggacatcgagcgggacagccgggagagcgccagcagcagaagaagcagccaggactggacagctggcctgctgagccccagcctgcggagccctgtgtgccaccggcagagctccatgccagacagccgcagcccctgcagccggctgactgtgaatgtgcccatcaaggccaacagcctggatggctttgcccagaactgcccccaggacttcctgtctgtgcagcctgtgtcctctgccagcagcagcggcctgtgcaagagtgacagctgcctgtaccgccggggcggcacagaccacatcaccaacatgctgattcatgagacctgggccagcagcattgaggccctgatgaggaagaacaagatcatcgtggatgatgctgaggaggccgacacagagcctgtgtctgggggcagccccagccaggccgagaagtgtgccaaccggctggccgccagcaggatgtgcagcggccccaccctgctggtgcaggagagcctggactgccccaggaaggacagcgtgacagagtgcaagcagccccctgtgagcagcctgagcaagacagccagcctgaccaaccacagccccctggacagcaagaaggagaccagcagctgccaggaccctgtgcccatcaaccacaagaggaggagcctgtgcagccgggaggtgcccctcatccagattgaaacagaccagcgggaggcctgtgccggggagcctgagcccttcctgagcaagagcagcctgctggaggaggccgagggccacagcaatgacaagaacatcccagatgtggtgcggggcggggacacagctgtgtctgcctgccagatccacagcgacagcctggacaccagagatgtgcctgaggccgaggccagcacagaggcccgggccccagatgaggcccccaacccccccagcagcagcgaggagagcacaggctcctggacccagctggccaatgaggaggacaacccagatgacaccagcagcttcctgcagctgtctgagaggtccatgagcaatggaaacagcagcgccaccagcagcctgggcatcatggacctggacatctaccaggagagcatgcccagcagccccatgatcaatgagctggtggaggagaagaagatcctgaagggccagagcgagagcacagaggccccagccagcggccccccaactggaacagccagcccccagaggagcctgctggtgatcaactttgacctggagcctgagtgcccagatgctgagctgcgggccaccctgcagtggattgctgccagcgagctgggcatccccaccatctacttcaagaagagccaggagaacagaattgagaagttcctggatgtggtgcagctggtgcacaggaagtcctggaaggtgggggacatcttccacgctgtggtgcagtactgcaagatgcatgaggagcagaaggatggccgcctgagcctgtttgactggctgctggagctgggctag

SEQ ID NO: 171488 - DNA, 789 bp, Artificial Sequence
  Description of Artificial Sequence: Synthetic coding sequence
atgctggccctggaggccgcccagctggatggcccccacttcagctgcctgtacccagatggagtcttctatgacctggacagctgcaagcacagcagctacccagattctgagggcgccccagacagcctgtgggactggacagtggcccctcctgtgcctgccaccccctatgaggcctttgatcctgctgctgctgccttcagccacccccaggccgcccagctgtgctatgagccccccacctacagccctgctggcaacctggagctggcccccagcctggaggcccctggccctggcctgcctgcctaccccacagagaactttgccagccagaccctggtgcccccagcctatgccccctaccccagccctgtgctgtctgaggaggaggacctgcccctggacagccctgccctggaggtgtctgacagcgagagtgatgaggccctggtggccggccctgagggcaaaggaagtgaagctggcaccaggaagaagctgcggctgtaccagttcctgctgggcctgctgaccaggggggacatgagagaatgtgtgtggtgggtggagcctggagctggggtcttccagttcagcagcaagcacaaggagctgctggcccggcgctggggccagcagaagggcaacaggaagaggatgacctaccagaagctggcccgggccctgaggaactatgccaagacaggagagatcaggaaggtgaagaggaagctgacctaccagtttgattctgccctgctgcctgctgtgcggcgggcctag

SEQ ID NO: 171489 - DNA, 516 bp, Artificial Sequence
  Description of Artificial Sequence: Synthetic coding sequence
atggccagctccatgacctggacagctgccagcatcccagccaccctcatccagaggggcctgctgaccctggtgcccccagcctatgccccctaccccagccctgtgctgtctgaggaggaggacctgcccctggacagccctgccctggaggtgtctgattctgagagtgatgaggccctggtggccggccctgagggcaagggcagcgaggccggcaccaggaagaagctgcggctgtaccagttcctgctgggcctgctgaccaggggggacatgagagaatgtgtgtggtgggtggagcccggggccggggtcttccagttcagcagcaagcacaaggagctgctggcccggcgctggggccagcagaagggcaacaggaagaggatgacctaccagaagctggcccgggccctgagaaattatgccaagacaggagagatcaggaaggtgaagaggaagctgacctaccagtttgacagcgccctgctgcctgctgtgagaagagcctag

SEQ ID NO: 171490 - DNA, 747 bp, Artificial Sequence
  Description of Artificial Sequence: Synthetic coding sequence
atgacctgtgtggagcaggacaagctgggccaggcctttgaagatgcctttgaggtgctgcggcagcacagcactggagacctgcagtacagcccagactacagaaactacctggccctgatcaaccaccggccccacgtgaagggcaacagcagctgctacggcgtgctgcccacagaggagcctgtgtacaactggaggacagtcatcaacagcgctgctgacttctactttgagggcaacatccaccagagcctgcagaacatcacagagaaccagctggtgcagcccaccctgctgcagcagaagggcggcaagggcaggaagaagctgcggctgtttgagtacctgcacgagagcctgtacaaccctgagatggccagctgcatccagtgggtggacaagaccaagggcatcttccagtttgtgtccaagaacaaggagaagctggccgagctgtggggcaagaggaagggcaacaggaagaccatgacctaccagaagatggcccgggccctgaggaactacggccgctctggagagatcaccaagatccggaggaagctgacctaccagttcagcgaggccatcctgcagaggctgagccccagctacttcctgggcaaggagatcttctacagccagtgtgtgcagcctgaccaggagtacctgagcctgaacaactggaatgccaactacaactacacctacgccaactaccacgagctgaaccaccacgactgctag

SEQ ID NO: 171491 - DNA, 747 bp, Artificial Sequence; identical to SEQ ID NO: 171490
  Description of Artificial Sequence: Synthetic coding sequence

SEQ ID NO: 171492 - DNA, 2568 bp, Artificial Sequence
  Description of Artificial Sequence: Synthetic coding sequence
atgagctttgtgcgggtgaacagatgtggcccccgggtgggcgtgaggaagacccccaaggtgaagaagaagaagacctctgtgaagcaggagtgggacaacacagtgacagacctgactgtgcaccgggccaccccagaggacctggtgagaagacatgagatccacaagagcaagaacagagccctggtgcactgggagctgcaggagaaggccctgaagaggaagtggaggaagcagaagccagagaccctgaacctggagaagaggcggctgagcatcatgaaggagatcctgagtgaccagtaccagatgcaggatgtgctggagaagagtgaccacctgattgctgctgccaaggagctgttccccaggagaagaacaggcttccccaacgtgacagtggccccagacagcagccagggccccatcgtggtgaaccaggaccccatcacccagagcatcttcaatgaatctgtgattgagccccaggccctgaatgatgtggatggagaggaggagggcaccgtgaacagccagagcggggagagtgaaaatgaaaatgagctggacaacagcctgaacagccagagcaacaccaacacagaccgcttcctgcagcagctgacagaggagaactttgagctgatcagcaagctgtggacagacatccagcagaagatcgccacccagagccagatcaccccacctggcacccccagcagcgccctgagcagcggggagcagagagctgccctgaatgccaccaatgctgtgaagaggctgcagacccggctgcagcctgaggagagcacagagaccctggacagcagctatgtggtgggccacgtgctgaacagcaggaagcagaagcagctgctgaacaaggtgaagaggaagcccaacctgcacgccctgagcaagcccaagaagaacatcagcagcggcagcaccaccagcgctgacctgcccaacagaaccaacagcaacctggatgtgctgaagcacatgattcatgaggtggagcacgagatggaggagtatgagcgctggacaggccgggaggtgaagggcctgcagagcagccagggcctgaccggcttcaccctgagcctggtgagcagcctgtgccgcctggtgcgctacctgaaggagagcgagatccagctgaggaaggaggtggagacccggcagcagctggagcaggtgctgggggaccaccgggagctgattgatgccctgacagctgagatcctgcggctgcgggaggagaatgctgccacccaggcccggctgcagcagtacatggtgaccacagatgagcagctgatcagcctgacccacgccatcaagaactgccctgtgatcaacaaccggcaggagatccaggccagcgagagcggggccaccggccggcgggtgatggacagccctgagaggcctgtggtgaatgccaacgtgtctgtgcccctgatgttccgggaggaggtggccgagttcccccaggaggagctgcctgtgaagctgagccaggtgcctgaccccccagacaacatgaacctggccaagaacttccctgcccacatctttgagcctgctgtgctgctgaccccaccccggcagaagagcaacctgaagttcagccccctgcaggatgtgctgcggaggacagtgcagaccaggcctgccccccggctgcccccaacagtggagatcatcgagaaggagcagaactgggaggagaagaccctgcccatcgacacagacatccagaacagcagcgaggagaacagactcttcacccagcgctggagggtgagccacatgggagaggacctggagaacaagacccaggccccctttgtgaacctgagccagcccctgtgcaacagccacagcaacacccagcagagccgcagccccaccttcagcgaggagctgcctgtgctgggagatggccagcagctgcggaccaatgaaagcctcatccagaggaaggacatcatgaccagaattgctgacctgaccctgcagaacagcgccatcaaggcccacatgaacaacatcatcgagcccagaggagagcagggagatggcctgcgggagctgaacaagcaggagagcgccagtgacatgaccagcaccttccctgtggcccagagcctgaccccaggctccatggaggagagaattgctgagctgaaccggcagagcatggaggcccggggcaagctgctgcagctgattgagcagcagaagctggtgggcctgaacctgagcccccccatgagccctgtgcagctgcccctgcgggcctggacagagggcgccaagaggaccatcgaggtgtccatccctggagctgaggcccctgagagcagcaagtgcagcacagtgtcccctgtgtctggcatcaacacccggcgcagcagcggggccaccggcaacagctgcagccccctgaatgccaccagcggcagcggccgcttcacccccctgaacccccgggccaagattgagaagcagaatgaggagggctggtttgccctgagcacccacgtgtcctag

SEQ ID NO: 171493 - DNA, 483 bp, Artificial Sequence
  Description of Artificial Sequence: Synthetic coding sequence
atgagctttgtgcgggtgaacagatgtggcccccgggtgggcgtgaggaagacccccaaggtgaagaagaagaagacctctgtgaagcaggagtgggacaacacagtgacagacctgactgtgcaccgggccaccccagaggacctggtgagaagacatgagatccacaagagcaagaacagagccctggtgcactgggagctgcaggagaaggccctgaagaggaagtggaggaagcagaagccagagaccctgaacctggagaagaggcggctgagcatcatgaaggagatcctgagtgaccagtaccagatgcaggatgtgctggagaagagtgaccacctgattgctgctgccaaggagctgttccccaggagaagaacaggcttccccaacgtgacagtggccccagacagcagccagggccccatcgtggtgaaccaggaccccatcacccagagcatcttcaatgaatctgtgtag

SEQ ID NO: 171494 - DNA, 522 bp, Artificial Sequence
  Description of Artificial Sequence: Synthetic coding sequence
atgagctttgtgcgggtgaacagatgtggcccccgggtgggcgtgaggaagacccccaaggtgaagaagaagaagacctctgtgaagcaggagtgggacaacacagtgacagacctgactgtgcaccgggccaccccagaggacctggtgagaagacatgagatccacaagagcaagaacagagccctggtgcactgggagctgcaggagaaggccctgaagaggaagtggaggaagcagaagccagagaccctgaacctggagaagaggcggctgagcatcatgaaggagatcctgagtgaccagtaccagatgcaggatgtgctggagaagagtgaccacctgattgctgctgccaaggagctgttccccaggagaagaacaggcttccccaacgtgacagtggccccagacagcagccagggccccatcgtggtgaaccaggaccccatcacccagagcatcttcaatgaatctgtgattgagccccaggccctgaatgatgtggatggagaggagtag

SEQ ID NO: 171495 - DNA, 60 bp, Artificial Sequence
  Description of Artificial Sequence: Synthetic coding sequence
atgagctttgtgcgggtgaacagatgtggcccccgggtgggcgtgaggaagaccccctag

SEQ ID NO: 171496 - DNA, 789 bp, Artificial Sequence
  Description of Artificial Sequence: Synthetic coding sequence
atgaagaccccatttgggaagaccccaggccagaggagcagagcagatgctggccacgccggcgtgtctgccaacatgatgaagaagaggaccagccacaagaagcacaggagctctgtgggccccagcaagcctgtgtcccagcccaggagaaatattgtgggctgccgcatccagcacggctggaaggagggcaatggacctgtgacccagtggaagggcaccgtgctggaccaggtgcctgtgaaccccagcctgtacctgatcaagtatgatggctttgactgtgtgtatggcctggagctgaacaaggatgagcgggtgtctgccctggaggtgctgcctgacagagtggccaccagccgcatcagtgatgcccacctggccgacaccatgattggcaaggctgtggagcacatgtttgaaacagaagatggcagcaaggatgagtggaggggcatggtgctggcccgggcccctgtgatgaacacctggttctacatcacctatgagaaggaccctgtgctgtacatgtaccagctgctggatgactacaaggagggggacctgcgcatcatgccagacagcaatgacagccccccagctgagcgggagcccggggaggtggtggacagcctggtgggcaagcaggtggagtatgccaaggaggatggcagcaagaggacaggcatggtgatccaccaggtggaggccaagcccagcgtgtacttcatcaagtttgatgatgacttccacatctacgtgtatgacctggtgaagaccagctag

SEQ ID NO: 171497 - DNA, 789 bp, Artificial Sequence; identical to SEQ ID NO: 171496
  Description of Artificial Sequence: Synthetic coding sequence

SEQ ID NO: 171498 - DNA, 1587 bp, Artificial Sequence
  Description of Artificial Sequence: Synthetic coding sequence
atggccggcagtgacacagcccccttcctgagccaggctgatgatcctgatgatggccctgtgcccggcaccccaggcctgcccggcagcactggaaaccccaagtctgaggagcctgaggtgcctgaccaggagggcctgcagaggatcaccggcctgagccctggccgcagcgccctgattgtggccgtgctgtgctacatcaacctgctgaactacatggaccgcttcaccgtggccggcgtgctgcctgacatcgagcagttcttcaacatcggggacagcagcagcggcctcatccagaccgtcttcatcagcagctacatggtgctggcccctgtgtttggctacctgggggaccgctacaacaggaagtacctgatgtgtggcggcatcgccttctggagcctggtgaccctgggcagcagcttcatccctggagagcacttctggctgctgctgctgacccggggcctggtgggcgtgggggaggccagctacagcaccatcgcccccaccctgattgctgacctgtttgtggccgaccagaggagcaggatgctgagcatcttctactttgccatccctgtgggcagcggcctgggctacatcgccggcagcaaggtgaaggacatggccggggactggcactgggccctgcgggtgaccccaggcctgggcgtggtggccgtgctgctgctcttcctggtggtgcgggagcccccaagaggagctgtggagcggcacagcgacctgccccccctgaaccccacctcctggtgggccgacctgcgggccctggccaggaaccccagctttgtgctgagcagcctgggcttcaccgctgtggcctttgtgacaggcagcctggccctgtgggccccagccttcctgctgcggagccgggtggtgctgggggagaccccaccctgcctgcccggggacagctgcagcagcagtgacagcctcatcttcggcctcatcacctgcctgactggagtgctgggcgtgggcctgggcgtggagatcagccggcggctgcggcacagcaaccccagggctgaccccctggtgtgtgccaccggcctgctgggcagcgcccccttcctgttcctgagcctggcctgtgcccggggcagcatcgtggccacctacatcttcatcttcatcggggagaccctgctgtccatgaactgggccatcgtggccgacatcctgctgtatgtggtgatccccacccggcgcagcacagctgaggccttccagatcgtgctgagccacctgctgggagatgctggcagcccctacctgattggcctcatcagtgaccggctgcggaggaactggccacccagcttcctgtctgagttccgggccctgcagttcagcctgatgctgtgtgcctttgtgggcgccctgggcggggccgccttcctgggcacagccatcttcattgaagctgacagaagaagagcccagctgcacgtgcagggcctgctgcatgaagctggcagcacagatgaccgcatcgtggtgccccagaggggccgcagcaccagggtgcctgtggcctctgtgctgatctag

SEQ ID NO: 171499 - DNA, 1368 bp, Artificial Sequence
  Description of Artificial Sequence: Synthetic coding sequence
atggaccgcttcaccgtggccggcgtgctgcctgacatcgagcagttcttcaacattggagacagcagcagcggcctcatccagacagtgttcatcagcagctacatggtgctggcccctgtgtttggctacctgggggaccgctacaacaggaagtacctgatgtgtggcggcatcgccttctggagcctggtgaccctgggcagcagcttcatccctggagagcacttctggctgctgctgctgacccggggcctggtgggcgtgggggaggccagctacagcaccatcgcccccaccctgattgctgacctgtttgtggccgaccagaggagcaggatgctgagcatcttctactttgccatccctgtgggcagcggcctgggctacatcgccggcagcaaggtgaaggacatggccggggactggcactgggccctgcgggtgaccccaggcctgggcgtggtggccgtgctgctgctcttcctggtggtgcgggagcccccaagaggagctgtggagcggcacagcgacctgccccccctgaaccccacctcctggtgggccgacctgcgggccctggccaggaaccccagctttgtgctgagcagcctgggcttcaccgctgtggcctttgtgacaggcagcctggccctgtgggccccagccttcctgctgcggagccgggtggtgctgggggagaccccaccctgcctgcccggggacagctgcagcagcagtgacagcctcatcttcggcctcatcacctgcctgactggagtgctgggcgtgggcctgggcgtggagatcagccggcggctgcggcacagcaaccccagggctgaccccctggtgtgtgccaccggcctgctgggcagcgcccccttcctgttcctgagcctggcctgtgcccggggcagcatcgtggccacctacatcttcatcttcatcggggagaccctgctgtccatgaactgggccatcgtggccgacatcctgctgtatgtggtgatccccaccaggaggagcacagctgaggccttccagatcgtgctgagccacctgctgggagatgctggcagcccctacctgattggcctcatcagtgaccggctgcggaggaactggcccccatccttcctgtctgagttccgggccctgcagttcagcctgatgctgtgtgcctttgtgggcgccctgggcggggccgccttcctgggcacagccatcttcatcgaggccgacagaagaagagcccagctgcacgtgcagggcctgctgcacgaggccggcagcacagatgacagaattgtggtgccccagaggggccgcagcaccagggtgcctgtggcctctgtgctgatctag

SEQ ID NO: 171500 - DNA, 1431 bp, Artificial Sequence
  Description of Artificial Sequence: Synthetic coding sequence
atggccggcagtgacacagcccccttcctgagccaggctgatgatcctgatgatggccctgtgcccggcaccccaggcctgcccggcagcactggaaaccccaagtctgaggagcctgaggtgcctgaccaggagggcctgcagaggatcaccggcctgagccctggccgcagcgccctgattgtggccgtgctgtgctacatcaacctgctgaactacatggaccgcttcaccgtggccggcgtgctgcctgacatcgagcagttcttcaacatcggggacagcagcagcggcctcatccagaccgtcttcatcagcagctacatggtgctggcccctgtgtttggctacctgggggaccgctacaacaggaagtacctgatgtgtggcggcatcgccttctggagcctggtgaccctgggcagcagcttcatccctggagagcacttctggctgctgctgctgacccggggcctggtgggcgtgggggaggccagctacagcaccatcgcccccaccctgattgctgacctgtttgtggccgaccagaggagcaggatgctgagcatcttctactttgccatccctgtgggcagcggcctgggctacatcgccggcagcaaggtgaaggacatggccggggactggcactgggccctgcgggtgaccccaggcctgggcgtggtggccgtgctgctgctcttcctggtggtgcgggagcccccaagaggagctgtggagcggcacagcgacctgccccccctgaaccccacctcctggtgggccgacctgcgggccctggccaggaacctgatcttcggcctcatcacctgcctgactggagtgctgggcgtgggcctgggcgtggagatcagccggcggctgcggcacagcaaccccagggctgaccccctggtgtgtgccaccggcctgctgggcagcgcccccttcctgttcctgagcctggcctgtgcccggggcagcatcgtggccacctacatcttcatcttcatcggggagaccctgctgtccatgaactgggccatcgtggccgacatcctgctgtatgtggtgatccccacccggcgcagcacagctgaggccttccagatcgtgctgagccacctgctgggagatgctggcagcccctacctgattggcctcatcagtgaccggctgcggaggaactggccacccagcttcctgtctgagttccgggccctgcagttcagcctgatgctgtgtgcctttgtgggcgccctgggcggggccgccttcctgggcacagccatcttcattgaagctgacagaagaagagcccagctgcacgtgcagggcctgctgcatgaagctggcagcacagatgaccgcatcgtggtgccccagaggggccgcagcaccagggtgcctgtggcctctgtgctgatctag

SEQ ID NO: 171501 - DNA, 1365 bp, Artificial Sequence
  Description of Artificial Sequence: Synthetic coding sequence
atggccggcagtgacacagcccccttcctgagccaggctgatgatcctgatgatggccctgtgcccggcaccccaggcctgcccggcagcactggaaaccccaagtctgaggagcctgaggtgcctgaccaggagggcctgcagaggatcaccggcctgagccctggccgcagcgccctgattgtggccgtgctgtgctacatcaacctgctgaactacatggaccgcttcaccgtggccgtgttcatcagcagctacatggtgctggcccctgtgtttggctacctgggggaccgctacaacaggaagtacctgatgtgtggcggcatcgccttctggagcctggtgaccctgggcagcagcttcatccctggagagcacttctggctgctgctgctgacccggggcctggtgggcgtgggggaggccagctacagcaccatcgcccccaccctgattgctgacctgtttgtggccgaccagaggagcaggatgctgagcatcttctactttgccatccctgtgggcagcggcctgggctacatcgccggcagcaaggtgaaggacatggccggggactggcactgggccctgcgggtgaccccaggcctgggcgtggtggccgtgctgctgctcttcctggtggtgcgggagcccccaagaggagctgtggagcggcacagcgacctgccccccctgaaccccacctcctggtgggccgacctgcgggccctggccaggaacctgatcttcggcctcatcacctgcctgactggagtgctgggcgtgggcctgggcgtggagatcagccggcggctgcggcacagcaaccccagggctgaccccctggtgtgtgccaccggcctgctgggcagcgcccccttcctgttcctgagcctggcctgtgcccggggcagcatcgtggccacctacatcttcatcttcatcggggagaccctgctgtccatgaactgggccatcgtggccgacatcctgctgtatgtggtgatccccacccggcgcagcacagctgaggccttccagatcgtgctgagccacctgctgggagatgctggcagcccctacctgattggcctcatcagtgaccggctgcggaggaactggccacccagcttcctgtctgagttccgggccctgcagttcagcctgatgctgtgtgcctttgtgggcgccctgggcggggccgccttcctgggcacagccatcttcattgaagctgacagaagaagagcccagctgcacgtgcagggcctgctgcatgaagctggcagcacagatgaccgcatcgtggtgccccagaggggccgcagcaccagggtgcctgtggcctctgtgctgatctag

SEQ ID NO: 171502 - DNA, 1650 bp, Artificial Sequence
  Description of Artificial Sequence: Synthetic coding sequence
atgatgtgcctggagtgtgccagcgctgctgctggaggagctgaggaggaggaggctgatgctgagaggagaagaagaagaagaggagcccagagaggagctgggggcagcggctgctgcggggcccggggagctggaggagctggggtgtctgctgctggagatgaggtgcagaccctgagcggctctgtgagaagagcccccactggacctcctggcaccccaggcaccccaggctgtgccgccacagccaagggccctggggcccagcagcccaagccagccagcctgggccggggcagaggagctgctgctgccatcctgagcctgggcaatgtgctgaactacctggaccgctacacagtggccggcgtgctgctggacatccagcagcactttggagtgaaggacagaggagctggcctgctgcagagcgtcttcatctgcagcttcatggtggccgcccccatcttcggctacctgggggaccgcttcaacaggaaggtgatcctgagctgtggcatcttcttctggagcgctgtgaccttcagcagcagcttcatcccccagcagtacttctggctgctggtgctgagccggggcctggtgggcattggagaggccagctacagcaccatcgcccccaccatcatcggggacctcttcaccaagaacaccaggaccctgatgctgagcgtcttctactttgccatccccctgggcagcggcctgggctacatcaccggcagctctgtgaagcaggccgccggggactggcactgggccctgcgggtgtcccctgtgctgggcatgatcaccggcaccctcatcctgatcctggtgcctgccaccaagaggggccatgctgaccagctgggggaccagctgaaggcccggacctcctggctgcgggacatgaaggccctgatccggaacagaagctatgtgttcagcagcctggccaccagcgctgtgtcctttgccactggagccctgggcatgtggatccccctgtacctgcaccgggcccaggtggtgcagaagacagctgagacctgcaacagccccccctgtggggccaaggacagcctcatctttggagccatcacctgcttcaccggcttcctgggcgtggtgactggagctggggccacccgctggtgccgcctgaagacccagagagctgaccccctggtgtgtgctgtgggcatgctgggcagcgccatcttcatctgcctgatctttgtggccgccaagagcagcatcgtgggcgcctacatctgcatctttgtgggggagaccctgctcttcagcaactgggccatcacagctgacatcctgatgtatgtggtgatccccacccggcgggccacagctgtggccctgcagagcttcaccagccacctgctgggagatgctggcagcccctacctgattggcttcatcagtgacctgatccggcagagcaccaaggacagccccctgtgggagttcctgagcctgggctacgccctgatgctgtgcccctttgtggtggtgctgggcggcatgttcttcctggccacagccctcttctttgtgtctgaccgggcccgggcagagcagcaggtgaaccagctggccatgcccccagcctctgtgaaggtgtag

SEQ ID NO: 171503 - DNA, 1158 bp, Artificial Sequence
  Description of Artificial Sequence: Synthetic coding sequence
atgctggtgtgcttccggctgtacagctggctgttcttcctgagccggggcatcgtgggcactggaagtgccagctacagcaccatcgcccccaccgtgctgggggacctgtttgtgcgggaccagaggaccagggtgctggccgtgttctacatcttcatccctgtgggcagcggcctgggctacgtgctgggcagcgctgtgaccatgctgaccggcaactggcgctgggccctgcgggtgatgccctgcctggaggccgtggccctgatcctgctgatcctgctggtgcctgaccccccaagaggagctgctgagacccagggcgagggcgctgtgggcggcttccgcagctcctggtgtgaagatgtgcgctacctgggcaagaactggagctttgtgtggagcaccctgggcgtgacagccatggcctttgtgactggagccctgggcttctgggcccccaagttcctgctggaggcccgggtggtgcacggcctgcagcccccctgcttccaggagccctgcagcaacccagacagcctcatctttggagccctgaccatcatgactggagtcatcggggtcatcctgggcgctgaggccgcccggcgctacaagaaggtgattcctggagctgagcccctcatctgtgccagcagcctgctggccacagccccctgcctgtacctggccctggtgctggcccccaccaccctgctggccagctatgtgttcctgggcctgggggagctgctgctgagctgcaactgggccgtggtggccgacatcctgctgtctgtggtggtgccccgctgccggggcacagctgaggccctgcagatcaccgtgggccacatcctgggagatgctggcagcccctacctgaccggcctcatcagctctgtgctgcgggcccggcggccagacagctacctgcagcgcttccgcagcctgcagcagagcttcctgtgctgtgccttcgtcatcgccctgggcggcggctgcttcctgctgacagccctgtacctggagagagatgagacccgggcctggcagcctgtgacaggcaccccagacagcaatgatgtggacagcaatgacctggagcggcagggcctgctgagcggggccggggccagcacagaggagccctag

SEQ ID NO: 171504 - DNA, 1539 bp, Artificial Sequence
  Description of Artificial Sequence: Synthetic coding sequence
atggccggcggcatgtctgctgagtgcccagagcccggccctgggggcctgcagggccagagccctggccctggccggcagtgccccccacccatcacccccacctcctggagcctgcccccctggagggcctacgtggccgctgctgtgctgtgctacatcaacctgctgaactacatgaactggttcatcatcgccggcgtgctgctggacatccaggaggtgttccagatcagtgacaaccacgccggcctgctgcagacagtgtttgtgtcctgcctgctgctgagcgcccctgtgtttggctacctgggggacagacacagcaggaaggccaccatgagctttggcatcctgctgtggagcggggccggcctgagcagcagcttcatcagcccccgctacagctggctgttcttcctgagccggggcatcgtgggcaccggcagcgccagctacagcaccatcgcccccaccgtgctgggggacctgtttgtgcgggaccagaggaccagggtgctggccgtgttctacatcttcatccctgtgggcagcggcctgggctacgtgctgggcagcgctgtgaccatgctgactggaaactggcgctgggccctgcgggtgatgccctgcctggaggccgtggccctgatcctgctgatcctgctggtgcctgaccccccaagaggagctgctgagacccagggcgagggcgctgtgggcggcttccgcagctcctggtgtgaagatgtgcgctacctgggcaagaactggagctttgtgtggagcaccctgggcgtgacagccatggcctttgtgactggagccctgggcttctgggcccccaagttcctgctggaggcccgggtggtgcacggcctgcagcccccctgcttccaggagccctgcagcaacccagacagcctcatctttggagccctgaccatcatgactggagtgattggagtcatcctgggcgctgaggccgcccggcgctacaagaaggtgattcctggagctgagcccctcatctgtgccagcagcctgctggccacagccccctgcctgtacctggccctggtgctggcccccaccaccctgctggccagctatgtgttcctgggcctgggggagctgctgctgagctgcaactgggccgtggtggccgacatcctgctgtctgtggtggtgccccgctgccggggcacagctgaggccctgcagatcaccgtgggccacatcctgggagatgctggcagcccctacctgaccggcctcatcagctctgtgctgcgggcccggcggccagacagctacctgcagcgcttccgcagcctgcagcagagcttcctgtgctgtgcctttgtgattgccctgggcggcggctgcttcctgctgacagccctgtacctggagagagatgagacccgggcctggcagcctgtgacaggcaccccagacagcaatgatgtggacagcaatgacctggagcggcagggcctgctgtctggagctggggccagcacagaggagccctag

SEQ ID NO: 171505 - DNA, 249 bp, Artificial Sequence
  Description of Artificial Sequence: Synthetic coding sequence
atgggccagacagccctggccggcggcagcagcagcacccccaccccccaggccctgtacccagacctgagctgcccagagggcctggaggagctgctgagcgcccctcctccagacctgggcgcccagaggagacatggctggaaccccaaggactgcagtgaaaatattgaggtgaaggagggcggcctgtactttgagcggcggcctgtggcccagagcacagatggagcccggggcaagaggtag

SEQ ID NO: 171506 - DNA, 792 bp, Artificial Sequence
  Description of Artificial Sequence: Synthetic coding sequence
atgggccagacagccctggccggcggcagcagcagcacccccaccccccaggccctgtacccagacctgagctgcccagagggcctggaggagctgctgagcgcccctcctccagacctgggcgcccagaggagacatggctggaaccccaaggactgcagtgaaaatattgaggtgaaggagggcggcctgtactttgagcggcggcctgtggcccagagcacagatggagcccggggcaagaggggctacagccggggcctgcacgcctgggagatctcctggcccctggagcagaggggcacccatgctgtggtgggcgtggccacagccctggcccccctgcagacagaccactatgctgccctgctgggcagcaacagcgagagctggggctgggacatcggccggggcaagctgtaccaccagagcaaaggacctggggccccccagtacccagctggcacccagggcgagcagctggaggtgcctgagcggctgctggtggtgctggacatggaggagggcaccctgggctacgccatcggcggcacctacctgggccctgccttccggggcctgaagggccgcaccctgtacccagctgtgtctgctgtgtggggccagtgccaggtgcgcatccgctacctgggggagcggcgggcagagccccacagcctgctgcacctgagccggctgtgtgtgcgccacaacctgggggacacccggctgggccaggtgtctgccctgcccctgcccccagccatgaagcgctacctgctgtaccagtag

SEQ ID NO: 171507 - DNA, 792 bp, Artificial Sequence; identical to SEQ ID NO: 171506
  Description of Artificial Sequence: Synthetic coding sequence

SEQ ID NO: 171508 - DNA, 1068 bp, Artificial Sequence
  Description of Artificial Sequence: Synthetic coding sequence
atggcccggcggcccaggaacagccgggcctggcactttgtgctgtctgctgccaggagagatgctgatgcccgggctgtggccctggccggcagcaccaactggggctatgacagtgatggccagcacagcgacagcgacagcgaccctgagtacagcaccctgccccccagcatccccagcgctgtgcctgtgactggagagagcttctgtgactgtgccggccagagcgaggccagcttctgcagcagcctgcacagcgcccaccggggccgggactgccgctgtggggaggaggatgagtactttgactgggtgtgggatgacctgaacaagagcagcgccaccctgctgagctgtgacaacaggaaggtgtccttccacatggagtacagctgtggcacagctgccatccggggcaccaaggagctgggggagggccagcacttctgggagatcaagatgaccagccctgtgtatggaacagacatgatggtgggcatcggcaccagtgatgtggacctggacaagtaccgccacaccttctgcagcctgctgggcagagatgaggacagctggggcctgagctacacaggcctgctgcaccacaagggggacaagaccagcttcagcagccgcttcggccagggcagcatcatcggcgtgcacctggacacctggcacggcaccctgaccttcttcaagaacaggaagtgcatcggcgtggccgccaccaagctgcagaacaagcgcttctaccccatggtgtgcagcacagctgcccggagctccatgaaggtgaccaggagctgtgccagcgccaccagcctgcagtacctgtgctgccaccggctgcggcagctgcggccagacagcggggacaccctggagggcctgcccctgcccccaggcctgaagcaggtgctgcacaacaagctgggctgggtgctgtccatgagctgcagcaggaggaaggcccctgtgtctgacccccaggccgccaccagcgcccaccccagcagccgggagccccggccctgccagaggaagcgctgcagaagaacatag

SEQ ID NO: 171509 - DNA, 480 bp, Artificial Sequence
  Description of Artificial Sequence: Synthetic coding sequence
atggagtacagctgtggcacagctgccatccggggcaccaaggagctgggggagggccagcacttctgggagatcaagatgaccagccctgtgtatggcaccctgaccttcttcaagaacaggaagtgcatcggcgtggccgccaccaagctgcagaacaagcgcttctaccccatggtgtgcagcacagctgcccggagctccatgaaggtgaccaggagctgtgccagcgccaccagcctgcagtacctgtgctgccaccggctgcggcagctgcggccagacagcggggacaccctggagggcctgcccctgcccccaggcctgaagcaggtgctgcacaacaagctgggctgggtgctgtccatgagctgcagcaggaggaaggcccctgtgtctgacccccaggccgccaccagcgcccaccccagcagccgggagccccggccctgccagaggaagcgctgcagaagaacatag

SEQ ID NO: 171510 - DNA, 1068 bp, Artificial Sequence; identical to SEQ ID NO: 171508
  Description of Artificial Sequence: Synthetic coding sequence

SEQ ID NO: 171511 - DNA, 822 bp, Artificial Sequence
  Description of Artificial Sequence: Synthetic coding sequence
atgggccagaagctgagcggcagcctgaagtctgtggaggtgcgggagcccgccctgcggcctgccaagcgggagctgcggggagctgagcccggccggcctgcccggctggaccagctgctggacatgcctgctgctggcctggccgtgcagctgcggcatgcctggaacccagaagatagaagcctgaatgtgtttgtgaaggatgatgaccggctgaccttccaccgccaccctgtggcccagagcacagatggcatccggggcaaggtgggccacgcccggggcctgcacgcctggcagatcaactggccagcccggcagaggggcacccatgctgtggtgggcgtggccacagcccgggcccccctgcacagcgtgggctacacagccctggtgggcagtgatgctgagagctggggctgggacctgggccgcagccggctgtaccatgatggcaagaaccagcccggggtggcctacccagccttcctgggcccagatgaggcctttgccctgcctgacagcctgctggtggtgctggacatggatgagggcaccctgtccttcatcgtggatggccagtacctgggcgtggccttccggggcctgaagggcaagaagctgtaccctgtggtgtctgctgtgtggggccactgtgaggtgaccatgagatacatcaatggcctggaccctgagcccctgcccctgatggacctgtgccgccgcagcatccgcagcgccctgggccggcagaggctgcaggacatcagcagcctgcccctgccccagagcctgaagaactacctgcagtaccagtag

SEQ ID NO: 171512 - DNA, 1908 bp, Artificial Sequence
  Description of Artificial Sequence: Synthetic coding sequence
atggccagcagcggcatggctgacagcgccaaccacctgcccttcttctttggaaacatcacccgggaggaggccgaggactacctggtgcagggcggcatgtctgatggcctgtacctgctgcggcagagcaggaactacctgggcggctttgccctgtctgtggcccacggcaggaaggcccaccactacaccatcgagcgggagctgaatggcacctacgccatcgccggcggccgcacccacgccagccctgctgacctgtgccactaccacagccaggagagtgatggcctggtgtgcctgctgaagaagcccttcaaccggccccagggcgtgcagcccaagacaggcccctttgaggacctgaaggaaaatctcatccgggagtatgtgaagcagacctggaacctgcagggccaggccctggagcaggccatcatcagccagaagccccagctggagaagctgattgccaccacagcccacgagaagatgccctggttccacggcaagatcagccgggaggagagcgagcagatcgtgctgattggcagcaagaccaacgggaagttcctgatccgggcccgggacaacaacggcagctatgccctgtgcctgctgcacgagggcaaggtgctgcactacagaattgacaaggacaagacaggcaagctgagcatccctgagggcaagaagtttgacaccctgtggcagctggtggagcactacagctacaaggcagatggcctgctgcgggtgctgactgtgccctgccagaagattggcacccagggcaatgtgaactttggaggccggccccagctgcccggcagccacccagccacctggagcgctgggggcatcatcagccgcatcaagagctacagcttccccaagccaggccacaggaagagcagccctgcccagggcaaccggcaggagagcacagtgtccttcaacccctatgagcctgagctggccccctgggccgctgacaagggcccccagcgggaggccctgcccatggacacagaggtgtatgagagcccctatgctgaccctgaggagatccggcccaaggaggtgtacctggacaggaagctgctgaccctggaggacaaggagctgggcagcggcaactttggcaccgtgaagaagggctactaccagatgaagaaggtggtgaagacagtggccgtgaagatcctgaagaatgaggccaatgaccctgccctgaaggatgagctgctggccgaggccaacgtgatgcagcagctggacaacccctacatcgtgaggatgattggcatctgtgaggccgagagctggatgctggtgatggagatggccgagctgggccccctgaacaagtacctgcagcagaacagacatgtgaaggacaagaacatcatcgagctggtgcaccaggtgtccatgggcatgaagtacctggaggagagcaactttgtgcaccgggacctggccgccagaaatgtgctgctggtgacccagcactacgccaagatcagtgactttggcctgagcaaggccctgcgggcagatgagaactactacaaggcccagacccacggcaagtggcctgtgaagtggtacgcccctgagtgcatcaactactacaagttcagcagcaagagtgatgtgtggagctttggagtgctgatgtgggaggccttctcctatggccagaagccctaccggggcatgaagggcagcgaggtgacagccatgctggagaagggggagaggatgggctgcccagctggctgcccccgggagatgtatgacctgatgaacctgtgctggacctatgatgtggagaacagacctggctttgctgctgtggagctgcggctgaggaactactactatgatgtggtgaactag

SEQ ID NO: 171513 - DNA, 1839 bp, Artificial Sequence
  Description of Artificial Sequence: Synthetic coding sequence
atggccagcagcggcatggctgacagcgccaaccacctgcccttcttctttggaaacatcacccgggaggaggccgaggactacctggtgcagggcggcatgtctgatggcctgtacctgctgcggcagagcaggaactacctgggcggctttgccctgtctgtggcccacggcaggaaggcccaccactacaccatcgagcgggagctgaatggcacctacgccatcgccggcggccgcacccacgccagccctgctgacctgtgccactaccacagccaggagagtgatggcctggtgtgcctgctgaagaagcccttcaaccggccccagggcgtgcagcccaagacaggcccctttgaggacctgaaggaaaatctcatccgggagtatgtgaagcagacctggaacctgcagggccaggccctggagcaggccatcatcagccagaagccccagctggagaagctgattgccaccacagcccacgagaagatgccctggttccacggcaagatcagccgggaggagagcgagcagatcgtgctgattggcagcaagaccaacgggaagttcctgatccgggcccgggacaacaacggcagctatgccctgtgcctgctgcacgagggcaaggtgctgcactacagaattgacaaggacaagacaggcaagctgagcatccctgagggcaagaagtttgacaccctgtggcagctggtggagcactacagctacaaggcagatggcctgctgcgggtgctgactgtgccctgccagaagattggcacccagggcaatgtgaactttggaggccggccccagctgcccggcagccacccagccagcagccctgcccagggcaaccggcaggagagcacagtgtccttcaacccctatgagcctgagctggccccctgggccgctgacaagggcccccagcgggaggccctgcccatggacacagaggtgtatgagagcccctatgctgaccctgaggagatccggcccaaggaggtgtacctggacaggaagctgctgaccctggaggacaaggagctgggcagcggcaactttggaacagtgaagaagggctactaccagatgaagaaggtggtgaagacagtggccgtgaagatcctgaagaatgaggccaatgaccctgccctgaaggatgagctgctggccgaggccaacgtgatgcagcagctggacaacccctacatcgtgaggatgattggcatctgtgaggccgagagctggatgctggtgatggagatggccgagctgggccccctgaacaagtacctgcagcagaacagacatgtgaaggacaagaacatcatcgagctggtgcaccaggtgtccatgggcatgaagtacctggaggagagcaactttgtgcaccgggacctggccgccagaaatgtgctgctggtgacccagcactacgccaagatcagtgactttggcctgagcaaggccctgcgggcagatgagaactactacaaggcccagacccacggcaagtggcctgtgaagtggtacgcccctgagtgcatcaactactacaagttcagcagcaagagtgatgtgtggagctttggagtgctgatgtgggaggccttctcctatggccagaagccctaccggggcatgaagggcagcgaggtgacagccatgctggagaagggggagaggatgggctgcccagctggctgcccccgggagatgtatgacctgatgaacctgtgctggacctatgatgtggagaaccggcccggctttgctgctgtggagctgcggctgaggaactactactatgatgtggtgaactag

SEQ ID NO: 171514 - DNA, 1839 bp, Artificial Sequence; identical to SEQ ID NO: 171513
  Description of Artificial Sequence: Synthetic coding sequence

SEQ ID NO: 171515 - DNA, 1908 bp, Artificial Sequence; identical to SEQ ID NO: 171512
  Description of Artificial Sequence: Synthetic coding sequence

SEQ ID NO: 171516 - DNA, 990 bp, Artificial Sequence
  Description of Artificial Sequence: Synthetic coding sequence
atggtgtccaagagccgctggaagctgctggccatgctggccctggtgctggtggtgatggtgtggtacagcatcagccgggaggacagcttctacttccccatccctgagaagaaggagccctgcctgcagggcgaggccgagagcaaggccagcaagctgtttggaaactacagccgggaccagcccatcttcctgcggctggaggactacttctgggtgaagacccccagcgcctatgagctgccctacggcaccaagggcagcgaggacctgctgctgcgggtgctggccatcaccagcagcagcatccccaagaacatccagagcctgcgctgccgccgctgtgtggtggtgggcaatggccaccggctgaggaacagcagcctgggagatgccatcaacaagtatgatgtggtgatccggctgaacaatgcccctgtggccggctatgaaggagatgtgggcagcaagaccaccatgaggctcttctacccagagagcgcccactttgaccccaaggtggagaacaacccagacaccctgctggtgctggtggccttcaaggccatggacttccactggattgagaccatcctgagtgacaagaagagggtgaggaagggcttctggaagcagcccccactcatctgggatgtgaaccccaagcagatccgcatcctgaaccccttcttcatggagattgctgctgacaagctgctgagcctgcccatgcagcagcccaggaagatcaagcagaagcccaccaccggcctgctggccatcaccctggccctgcacctgtgtgacctggtgcacatcgccggcttcggctacccagatgcctacaacaagaagcagaccatccactactatgagcagatcaccctgaagtccatggccggcagcggccacaacgtgtcccaggaggccctggccatcaagaggatgctggagatgggcgccatcaagaacctgaccagcttctag

SEQ ID NO: 171517 - DNA, 1917 bp, Artificial Sequence
  Description of Artificial Sequence: Synthetic coding sequence
atggccactggagccaatgccacccccctggacttccccagcaagaagaggaagaggagccgctggaaccaggacaccatggagcagaagacagtcatccctggcatgcccaccgtcatccccccaggcctgacccgggagcaggagcgggcctacatcgtgcagctgcagatcgaggacctgaccaggaagctgaggactggagacctgggcatcccccccaacccagaagatagaagccccagccctgagcccatctacaacagcgagggcaagaggctgaacacccgggagttccgcaccaggaagaagctggaggaggagcggcacaacctgatcacagagatggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggagtgcaatgccaagatcatgatccggggcaagggctctgtgaaggagggcaaggtgggcaggaaggatggccagatgctgcctggagaagatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgcgggaggatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagccggcccccctggatgaacagcggccccagcgagagccggccctaccacggcatgcatggaggcggccctgggggccctgggggcggcccccacagcttcccccaccccctgcccagcctgactggaggccacggcggccaccccatgcagcacaaccccaacggccccccaccaccctggatgcagcccccacctccacccatgaaccagggcccccaccccccaggccaccacggccccccacccatggaccagtacctgggcagcacccctgtgggcagcggcgtgtaccgcctgcaccagggcaagggcatgatgcctcctccacccatgggcatgatgcctcctcctcctcctccacccagcggccagcccccacctccacccagcggccccctgcccccctggcagcagcagcagcagcagcccccacctcctcctccacccagcagctccatggccagcagcacccccctgccctggcagcagaacaccaccaccaccaccaccagcgctggcaccggcagcatccccccctggcagcagcagcaggccgctgctgctgccagccctggggccccccagatgcagggcaaccccaccatggtgcccctgcccccaggagtgcagccccccctgcccccaggggcccctcctcctcctcctcctcctcctcctggcagcgctggcatgatgatccccccaagaggaggagatggccccagccatgaaagtgaggacttcccccggcccctggtgaccctgcccggccggcagccccagcagaggccctggtggacaggctggtttgggaaggccgcctag

SEQ ID NO: 171518 - DNA, 1920 bp, Artificial Sequence
  Description of Artificial Sequence: Synthetic coding sequence
atggccactggagccaatgccacccccctggacttccccagcaagaagaggaagaggagccgctggaaccaggacaccatggagcagaagacagtcatccctggcatgcccaccgtcatccccccaggcctgacccgggagcaggagcgggcctacatcgtgcagctgcagatcgaggacctgaccaggaagctgaggactggagacctgggcatcccccccaacccagaagatagaagccccagccctgagcccatctacaacagcgagggcaagaggctgaacacccgggagttccgcaccaggaagaagctggaggaggagcggcacaacctgatcacagagatggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggagtgcaatgccaagatcatgatccggggcaagggctctgtgaaggagggcaaggtgggcaggaaggatggccagatgctgcctggagaagatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgcgggaggatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagccggcccccctggatgaacagcggccccagcgagagccggccctaccacggcatgcatggaggcggccctgggggccctgggggcggcccccacagcttcccccaccccctgcccagcctgactggaggccacggcggccaccccatgcagcacaaccccaacggccccccaccaccctggatgcagcccccacctccacccatgaaccagggcccccaccccccaggccaccacggccccccacccatggaccagtacctgggcagcacccctgtgggcagcggcgtgtaccgcctgcaccagggcaagggcatgatgcctcctccacccatgggcatgatgcctcctcctcctcctccacccagcggccagcccccacctccacccagcggccccctgcccccctggcagcagcagcagcagcagcccccacctcctcctccacccagcagctccatggccagcagcacccccctgccctggcagcagaacaccaccaccaccaccaccagcgctggcaccggcagcatccccccctggcagcagcagcaggccgctgctgctgccagccctggggccccccagatgcagggcaaccccaccatggtgcccctgcccccaggagtgcagccccccctgcccccaggggcccctcctcctcctcctcctcctcctcctggcagcgctggcatgatgtatgcccctcctcctcctcctcctccacccatggaccccagcaactttgtgaccatgatgggcatgggcgtggccggcatgccacccttcggcatgcccccagcccctcctcctcctccaccccagaactag

SEQ ID NO: 171519 - DNA, 1716 bp, Artificial Sequence
  Description of Artificial Sequence: Synthetic coding sequence
atggccactggagccaatgccacccccctggacttccccagcaagaagaggaagaggagccgctggaaccaggacaccatggagcagaagacagtcatccctggcatgcccaccgtcatccccccaggcctgacccgggagcaggagcgggcctacatcgtgcagctgcagatcgaggacctgaccaggaagctgaggactggagacctgggcatcccccccaacccagaagatagaagccccagccctgagcccatctacaacagcgagggcaagaggctgaacacccgggagttccgcaccaggaagaagctggaggaggagcggcacaacctgatcacagagatggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggagtgcaatgccaagatcatgatccggggcaagggctctgtgaaggagggcaaggtgggcaggaaggatggccagatgctgcctggagaagatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgcgggaggatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagccggcccccctggatgaacagcggccccagcgagagccggccctaccacggcatgcatggaggcggccctgggggccctgggggcggcccccacagcttcccccaccccctgcccagcctgactggaggccacggcggccaccccatgcagcacaaccccaacggccccccaccaccctggatgcagcccccacctccacccatgaaccagggcccccaccccccaggccaccacggccccccacccatgggcaagtctgtgcctgggaagtatgcctgtggcctgtggggcctgagccctgccagcaggaagagatatgatgctgccaccacctacggccatgatgctgctgctgctgctgccagccagtgggccgcccccacccccagcctgtggagcagcagccccatggccaccacagctgctgctgccagcgccaccccatctgcccagcagcagtatggcttccagtaccccctggccatggccgccaagatccccccaagaggaggagatggccccagccatgaaagtgaggacttcccccggcccctggtgaccctgcccggccggcagccccagcagaggccctggtggacaggctggtttgggaaggccgcctag

SEQ ID NO: 171520 - DNA, 1302 bp, Artificial Sequence
  Description of Artificial Sequence: Synthetic coding sequence
atggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggaatgtaatgccaagatcatgatccggggcaaaggatctgtgaaggagggcaaggtgggcaggaaggatggccagatgctgcccggggaggatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgagagaagatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagcaggcctccctggatgaacagcggccccagcgagagccggccctaccacggcatgcacggcggcggccctgggggccctgggggcggcccccacagcttcccccaccccctgcccagcctgaccggcggccatggaggccaccccatgcagcacaaccccaatggacctcctccaccctggatgcagcccccacctccacccatgaaccagggcccccaccccccaggccaccacggccccccacccatggaccagtacctgggcagcacccctgtgggcagcggcgtgtaccgcctgcaccagggcaagggcatgatgcctcctccacccatgggcatgatgcctcctcctcctcctcctccttctggccagcccccacctcctccttctggccccctgcccccctggcagcagcagcagcagcagcccccacctcctcctccacccagcagctccatggccagcagcacccccctgccctggcagcagaggagcctgcctgctgctgccatggcccgggccatgagggtgaggaccttccgggcccactggtag

SEQ ID NO: 171521 - DNA, 2022 bp, Artificial Sequence
  Description of Artificial Sequence: Synthetic coding sequence
atggccactggagccaatgccacccccctgggcaagctgggccccccaggcctgccccccctgcccggccccaagggcggctttgagcccggccccccaccagcccctggccctggggccggcctgctggcccctggccccccacctcctcctcctgtgggctccatgggcgccctgacagctgccttcccctttgctgccctgcccccacctcctcctcctcctcctcctcctccaccccagcagcccccacctcctcctcctccacccagccctggggccagctaccccccaccccagcccccacctcctccacccctgtaccagagggtgtccccaccccagcccccaccaccccagccccccaggaaggaccagcagcccggccctgctgggggcggcggggacttccccagcaagaagaggaagaggagccgctggaaccaggacaccatggagcagaagacagtcatccctggcatgcccaccgtcatccccccaggcctgacccgggagcaggagcgggcctacatcgtgcagctgcagatcgaggacctgaccaggaagctgaggactggagacctgggcatcccccccaaccctgaggacaggagccccagccctgagcccatctacaacagcgagggcaagaggctgaacacccgggagttccgcaccaggaagaagctggaggaggagcggcacaacctgatcacagagatggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggaatgtaatgccaagatcatgatccggggcaaaggatctgtgaaggagggcaaggtgggcaggaaggatggccagatgctgcccggggaggatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgagagaagatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagcaggcctccctggatgaacagcggccccagcgagagccggccctaccacggcatgcacggcggcggccctgggggccctgggggcggcccccacagcttcccccaccccctgcccagcctgaccggcggccatggaggccaccccatgcagcacaaccccaatggacctcctccaccctggatgcagcccccacctccacccatgaaccagggcccccaccccccaggccaccacggccccccacccatggaccagtacctgggcagcacccctgtgggcagcggcgtgtaccgcctgcaccagggcaagggcatgatgcctcctccacccatgggcatgatgcctcctcctcctcctcctccttctggccagcccccacctcctccttctggccccctgcccccctggcagcagcagcagcagcagcccccacctcctcctccacccagcagctccatggccagcagcacccccctgccctggcagcagaggagcctgcctgctgctgccatggcccgggccatgagggtgaggaccttccgggcccactggtag

SEQ ID NO: 171522 - DNA, 1842 bp, Artificial Sequence
  Description of Artificial Sequence: Synthetic coding sequence
atggagcagaagacagtcatccctggcatgcccaccgtcatccccccaggcctgacccgggagcaggagcgggcctacatcgtgcagctgcagatcgaggacctgaccaggaagctgaggactggagacctgggcatcccccccaacccagaagatagaagccccagccctgagcccatctacaacagcgagggcaagaggctgaacacccgggagttccgcaccaggaagaagctggaggaggagcggcacaacctgatcacagagatggtggccctgaacccagacttcaagcccccagctgactacaagcccccagccaccagggtgtctgacaaggtgatgatcccccaggatgagtacccagagatcaactttgtgggcctgctgattggcccccggggcaacaccctgaagaacatcgagaaggagtgcaatgccaagatcatgatccggggcaagggctctgtgaaggagggcaaggtgggcaggaaggatggccagatgctgcctggagaagatgagcccctgcacgccctggtgacagccaacaccatggagaatgtgaagaaggctgtggagcagatccggaacatcctgaagcagggcatcgagaccccagaggaccagaatgacctgaggaagatgcagctgcgggagctggcccggctgaatggcaccctgcgggaggatgacaaccgcatcctgcggccctggcagagcagcgagaccaggagcatcaccaacaccaccgtgtgcaccaagtgtggcggggccggccacatcgccagtgactgcaagttccagaggcctggggacccccagagcgcccaggacaaggccaggatggacaaggagtacctgagcctgatggccgagctgggggaggcccctgtgcctgcctctgtgggcagcaccagcggccctgccaccacccccctggccagcgcccccaggcctgctgccccagccaacaaccccccaccacccagcctgatgagcaccacccagagccggcccccctggatgaacagcggccccagcgagagccggccctaccacggcatgcatggaggcggccctgggggccctgggggcggcccccacagcttcccccaccccctgcccagcctgactggaggccacggcggccaccccatgcagcacaaccccaacggccccccaccaccctggatgcagcccccacctccacccatgaaccagggcccccaccccccaggccaccacggccccccacccatggaccagtacctgggcagcacccctgtgggcagcggcgtgtaccgcctgcaccagggcaagggcatgatgcctcctccacccatgggcatgatgcctcctcctcctcctccacccagcggccagcccccacctccacccagcggccccctgcccccctggcagcagcagcagcagcagcccccacctcctcctccacccagcagctccatggccagcagcacccccctgccctggcagcagaacaccaccaccaccaccaccagcgctggcaccggcagcatccccccctggcagcagcagcaggccgctgctgctgccagccctggggccccccagatgcagggcaaccccaccatggtgcccctgcccccaggagtgcagccccccctgcccccaggggcccctcctcctcctcctcctcctcctcctggcagcgctggcatgatgtatgcccctcctcctcctcctcctccacccatggaccccagcaactttgtgaccatgatgggcatgggcgtggccggcatgccacccttcggcatgcccccagcccctcctcctcctccaccccagaactag

SEQ ID NO: 171523 - DNA, 1527 bp, Artificial Sequence
  Description of Artificial Sequence: Synthetic coding sequence
atggccaagagcaatggagaaaatggcccccgggccccagctgctggggagagcctgagcggcacccgggagagcctggcccagggcccagatgctgccaccacagatgagctgagcagcctgggcagtgacagcgaggccaacggctttgctgagaggagaattgacaagtttggcttcatcgtgggcagccagggcgctgagggcgccctggaggaggtgcccctggaggtgctgcggcagcgggagagcaagtggctggacatgctgaacaactgggacaagtggatggccaagaagcacaagaagatccggctgcgctgccagaagggcatcccccccagcctgcggggccgggcctggcagtacctgagcggcggcaaggtgaagctgcagcagaaccctgggaagtttgatgagctggacatgagccctggggaccccaagtggctggatgtgattgaaagagacctgcaccggcagttccccttccacgagatgtttgtgtcccggggcggccacggccagcaggacctcttccgggtgctgaaggcctacaccctgtacagacctgaggagggctactgccaggcccaggcccccatcgctgctgtgctgctgatgcacatgcctgctgagcaggccttctggtgcctggtgcagatctgtgagaagtacctgcccggctactacagcgagaagctggaggccatccagctggatggagagatcctcttcagcctgctgcagaaggtgtcccctgtggcccacaagcacctgagccggcagaagattgaccccctgctgtacatgacagagtggttcatgtgtgccttcagcaggaccctgccctggagctctgtgctgcgggtgtgggacatgttcttctgtgaaggagtgaagatcatcttccgggtgggcctggtgctgctgaagcacgccctgggcagccctgagaaggtgaaggcctgccagggccagtatgagaccatcgagcggctgcggagcctgagccccaagatcatgcaggaggccttcctggtgcaggaggtggtggagctgcctgtgacagagcggcagatcgagcgggagcacctgatccagctgcggcgctggcaggagaccagaggagagctgcagtgccgcagccccccccggctgcacggggccaaggccatcctggatgctgagcccggccccaggcctgccctgcagcccagccccagcatccggctgcccctggatgcccccctgcccggcagcaaggccaagcccaagccacccaagcaggcccagaaggagcagaggaagcagatgaagggccggggccagctggagaagcccccagcccccaaccaggccatggtggtggccgctgctggagatgcctgccccccccagcacgtgccccccaaggacagcgcccccaaggacagcgccccccaggacctggccccccaggtgtctgcccaccacaggagccaggagagcctgaccagccaggagagcgaggacacctacctgtag

SEQ ID NO: 171524 - DNA, 2187 bp, Artificial Sequence
  Description of Artificial Sequence: Synthetic coding sequence
atgcctgctggccctgtgcaggccgtgcccccacctcctcctgtgcccacagagcccaagcagcccacagaggaggaggccagcagcaaagaagattctgcccccagcaagcctgtggtgggcatcatctacccacctcctgaggtgaggaacatcgtggacaagacagccagctttgtggccagaaatggacctgagtttgaggcccgcatccggcagaatgagatcaacaaccccaagttcaacttcctgaaccccaatgacccctaccacgcctactaccgccacaaggtgtctgagttcaaggagggcaaggcccagtttgtggccagaaatggccggcagttcctgacccagctgatgcagaaggagcagaggaactaccagtttgacttcctgcggccccagcacagcctcttcaactacttcaccaagctggtggagcagtacaccaagatcctgatcccccccaagggcctcttcagcaagctgaagaaggaggccgagaacccccgggaggtgctggaccaggtgtgctacagagtggagtgggccaagttccaggagcgggagaggaagaaggaggaggaggagaaggagaaggagcgggtggcctatgcccagattgactggcatgactttgtggtggtggagaccgtggacttccagcccaatgagcagggcaacttccccccacccaccaccccagaggagctgggcgcccgcatcctgatccaggagagatatgagaagtttggagagagcgaggaggtggagatggaggtggagagtgatgaagaagatgacaagcaggagaaggccgaggagccccccagccagctggaccaggacacccaggtgcaggacatggatgagggcagtgatgatgaggaggagggccagaaggtgcccccacctcctgagacccccatgcccccacccctgccccccaccccagaccaggtgattgtgaggaaggactatgaccccaaggccagcaagcccctgcccccagccccagccccagatgagtacctggtgagccccatcactggagagaagatcccagccagcaagatgcaggagcacatgagaattggcctgctggacccccgctggctggagcagagggacaggagcatccgggagaagcagagtgatgatgaggtgtatgcccctggcctggacatcgagagcagcctgaagcagctggccgagaggagaacagacatcttcggcgtggaggagacagccatcggcaagaagattggagaggaggagatccagaagccagaggagaaggtgacctgggatggccacagcggctccatggcccggacccagcaggccgcccaggccaacatcaccctgcaggagcagatcgaggccatccacaaggccaagggcctggtgcctgaagatgacaccaaggagaagattggccccagcaagcccaatgagatcccccagcagcccccaccacccagcagcgccaccaacatccccagcagcgccccacccatcacctctgtgccccggccccccaccatgcctcctcctgtgaggaccaccgtggtgtctgctgtgcctgtgatgcccaggcctcccatggcctctgtggtgcggctgcccccaggctctgtgattgcccccatgccacccatcatccacgccccccgcatcaacgtggtgcccatgcctccttctgccccacccatcatggccccccggcccccacccatgattgtgcccacagcctttgtgcctgcccctcctgtggcccctgtgcctgccccagcccccatgcctcctgtgcaccccccaccacccatggaggatgagcccaccagcaagaagctgaagacagaggacagcctgatgcctgaggaggagttcctgcggagaaataaaggacctgtgtccatcaaggtgcaggtgcccaacatgcaggacaagacagagtggaagctgaatggccaggtgctggtgttcaccctgcccctgacagaccaggtgtctgtcatcaaggtgaagatccacgaggccaccggcatgcctgctgggaagcagaagctgcagtatgagggcatcttcatcaaggacagcaacagcctggcctactacaacatggccaacggggccgtcatccacctggccctgaaggagcggggcggcaggaagaagtag

SEQ ID NO: 171525 - DNA, 2073 bp, Artificial Sequence
  Description of Artificial Sequence: Synthetic coding sequence
atgaccctgaccatgcccaccacagccatccccaaggtgatgcagcagcagcagcagaccacccagcagcagctgccccagaaggtgcaggcccaggtgatccaggagaccatcgtgcccaaggagcccccacctgagtttgagttcatcgctgaccccccatccatcagcgcctttgacctggatgtggtgaagctgacagcccagtttgtggccagaaatggccggcagttcctgacccagctgatgcagaaggagcagaggaactaccagtttgacttcctgcggccccagcacagcctcttcaactacttcaccaagctggtggagcagtacaccaagatcctgatcccccccaagggcctcttcagcaagctgaagaaggaggccgagaacccccgggaggtgctggaccaggtgtgctacagagtggagtgggccaagttccaggagcgggagaggaagaaggaggaggaggagaaggagaaggagcgggtggcctatgcccagattgactggcatgactttgtggtggtggagaccgtggacttccagcccaatgagcagggcaacttccccccacccaccaccccagaggagctgggcgcccgcatcctgatccaggagagatatgagaagtttggagagagcgaggaggtggagatggaggtggagagtgatgaagaagatgacaagcaggagaaggccgaggagccccccagccagctggaccaggacacccaggtgcaggacatggatgagggcagtgatgatgaggaggagggccagaaggtgcccccacctcctgagacccccatgcccccacccctgccccccaccccagaccaggtgattgtgaggaaggactatgaccccaaggccagcaagcccctgcccccagccccagccccagatgagtacctggtgagccccatcactggagagaagatcccagccagcaagatgcaggagcacatgagaattggcctgctggacccccgctggctggagcagagggacaggagcatccgggagaagcagagtgatgatgaggtgtatgcccctggcctggacatcgagagcagcctgaagcagctggccgagaggagaacagacatcttcggcgtggaggagacagccatcggcaagaagattggagaggaggagatccagaagccagaggagaaggtgacctgggatggccacagcggctccatggcccggacccagcaggccgcccaggccaacatcaccctgcaggagcagatcgaggccatccacaaggccaagggcctggtgcctgaagatgacaccaaggagaagattggccccagcaagcccaatgagatcccccagcagcccccaccacccagcagcgccaccaacatccccagcagcgccccacccatcacctctgtgccccggccccccaccatgcctcctcctgtgaggaccaccgtggtgtctgctgtgcctgtgatgcccaggcctcccatggcctctgtggtgcggctgcccccaggctctgtgattgcccccatgccacccatcatccacgccccccgcatcaacgtggtgcccatgcctccttctgccccacccatcatggccccccggcccccacccatgattgtgcccacagcctttgtgcctgcccctcctgtggcccctgtgcctgccccagcccccatgcctcctgtgcaccccccaccacccatggaggatgagcccaccagcaagaagctgaagacagaggacagcctgatgcctgaggaggagttcctgcggagaaataaaggacctgtgtccatcaaggtgcaggtgcccaacatgcaggacaagacagagtggaagctgaatggccaggtgctggtgttcaccctgcccctgacagaccaggtgtctgtcatcaaggtgaagatccacgaggccaccggcatgcctgctgggaagcagaagctgcagtatgagggcatcttcatcaaggacagcaacagcctggcctactacaacatggccaacggggccgtcatccacctggccctgaaggagcggggcggcaggaagaagtag

SEQ ID NO: 171526 - DNA, 900 bp, Artificial Sequence
  Description of Artificial Sequence: Synthetic coding sequence
atggacctgtctgagctggagcgggacaacacaggccgctgccgcctgagcagccctgtgcctgctgtgtgcaggaaggagccctgtgtgctgggcgtggatgaggccggccggggccctgtgctgggccccatggtgtatgccatctgctactgccccctgccccggctggccgacctggaggccctgaaggtggccgacagcaagaccctgctggagagcgagcgggagcggctgtttgccaagatggaggacacagactttgtgggctgggccctggatgtgctgagccccaacctgatcagcacctccatgctgggccgggtgaagtacaacctgaacagcctgagccatgacacagccaccggcctcatccagtatgccctggaccagggcgtgaatgtgacccaggtgtttgtggacacagtgggcatgcctgagacctaccaggcccggctgcagcagagcttccctggcatcgaggtgacagtgaaggccaaggcagatgccctgtaccctgtggtgtctgctgccagcatctgtgccaaggtggcccgggaccaggccgtgaagaagtggcagtttgtggagaagctgcaggacctggacacagattatggcagcggctacccaaatgaccccaagaccaaggcctggctgaaggagcacgtggagcctgtgtttggcttcccccagtttgtgcgcttctcctggaggacagcccagaccatcctggagaaggaggccgaggatgtgatctgggaggacagcgccagcgagaaccaggagggcctgaggaagatcaccagctacttcctgaatgaaggcagccaggcccggcccaggagcagccaccgctacttcctggagcggggcctggagagcgccaccagcctgtag

SEQ ID NO: 171527 - DNA, 3915 bp, Artificial Sequence
  Description of Artificial Sequence: Synthetic coding sequence
atggccaagatcgccaagacccatgaagatattgaggcccagatccgggagatccagggcaagaaggccgccctggatgaggcccagggcgtgggcctggacagcacaggctactatgaccaggagatctacggcggcagtgacagcagatttgctggctacgtgaccagcattgctgccacagagctggaggatgatgatgatgactacagcagcagcaccagcctgctgggccagaagaagccaggctaccacgcccctgtggccctgctgaatgacatcccccagagcacagagcagtatgacccctttgctgagcacaggcctcccaagattgctgaccgggaggatgagtacaagaagcacaggaggaccatgatcatcagccctgagcggctggacccctttgctgatggcggcaagaccccagaccccaagatgaatgcccggacctacatggatgtgatgagggagcagcacctgaccaaggaggagcgggagatccggcagcagctggccgagaaggccaaggccggggagctgaaggtggtgaatggagctgctgccagccagccccccagcaagaggaagaggcgctgggaccagacagctgaccagacccctggggccacccccaagaagctgagctcctgggaccaggccgagaccccaggccacacccccagcctgcgctgggatgagaccccaggccgggccaagggcagcgagacccctggggccaccccaggcagcaagatctgggaccccacccccagccacaccccagctggagctgccaccccaggccgcggggacaccccaggccacgccaccccaggccatggaggagccaccagcagcgccaggaagaaccgctgggatgagacccccaagacagagcgggacaccccaggccacggcagcggctgggccgagacccccaggacagacagaggaggagacagcattggagagacccccacccctggggccagcaagaggaagagccgctgggatgagaccccagccagccagatgggcggcagcacccctgtgctgaccccaggcaagacccccatcggcaccccagccatgaacatggccacccccaccccaggccacatcatgtccatgaccccagagcagctgcaggcctggcgctgggagcgggagattgatgaaagaaaccggcccctgagtgatgaggagctggatgccatgtttcctgagggctacaaggtgctgcccccacctgctggctacgtgcccatccgcaccccagccaggaagctgacagccacccccacccccctgggcggcatgacaggcttccacatgcagacagaggacaggaccatgaagtctgtgaatgaccagcccagcggcaacctgcccttcctgaagccagatgacatccagtactttgacaagctgctggtggatgtggatgagagcaccctgagccctgaggagcagaaggagaggaagatcatgaagctgctgctgaagatcaagaatggcaccccacccatgaggaaggccgccctgcggcagatcacagacaaggcccgggagtttggagctggccccctcttcaaccagatcctgcccctgctgatgagccccaccctggaggaccaggagcggcacctgctggtgaaggtgattgaccgcatcctgtacaagctggatgacctggtgcggccctacgtgcacaagatcctggtggtgattgagcccctgctgattgatgaggactactatgcccgggtggagggccgggagatcatcagcaacctggccaaggccgccggcctggccaccatgatcagcaccatgaggccagacatcgacaacatggatgaatatgtgaggaacaccacagcccgggcctttgctgtggtggccagcgccctgggcatccccagcctgctgcccttcctgaaggctgtgtgcaagagcaagaagtcctggcaggcccggcacacaggcatcaagatcgtgcagcagatcgccatcctgatgggctgtgccatcctgccccacctgcggagcctggtggagatcatcgagcacggcctggtggatgagcagcagaaggtgaggaccatcagcgccctggccatcgccgccctggccgaggccgccaccccctatggaattgagagctttgacagcgtgctgaagcccctgtggaagggcatccggcagcaccggggcaagggcctggccgccttcctgaaggccatcggctacctgatccccctgatggatgctgaatatgccaactactacacccgggaggtgatgctgatcctgatccgggagttccagagcccagatgaggagatgaagaagatcgtgctgaaggtggtgaagcagtgctgcggcacagatggagtggaggccaactacatcaagacagagatcctgccccccttcttcaagcacttctggcagcacaggatggccctggacagaagaaactaccggcagctggtggacaccaccgtggagctggccaacaaggtgggcgctgctgagatcatcagcagaattgtggatgacctgaaggatgaagctgagcagtacaggaagatggtgatggagaccatcgagaagatcatgggcaacctgggcgctgctgacatcgaccacaagctggaggagcagctgattgatggcatcctgtatgccttccaggagcagaccacagaggacagcgtgatgctgaatggcttcggcaccgtggtgaatgccctgggcaagagggtgaagccctacctgccccagatctgtggcaccgtgctgtggaggctgaacaacaagagcgccaaggtgcggcagcaggccgctgacctgatcagcaggacagctgtggtgatgaagacctgccaggaggagaagctgatgggccacctgggcgtggtgctgtatgagtacctgggggaggagtacccagaggtgctgggcagcatcctgggcgccctgaaggccatcgtgaatgtcatcggcatgcacaagatgaccccacccatcaaggacctgctgccccggctgacccccatcctgaagaacagacatgagaaggtgcaggagaactgcatcgacctggtgggcagaattgctgacagaggagcagaatatgtgtctgcccgggagtggatgaggatctgctttgagctgctggagctgctgaaggcccacaagaaggccatccggcgggccaccgtgaacaccttcggctacatcgccaaggccatcggcccccatgatgtgctggccaccctgctgaacaacctgaaggtgcaggagcggcagaacagagtgtgcaccaccgtggccatcgccatcgtggccgagacctgcagccccttcaccgtgctgcctgccctgatgaatgagtacagagtgcctgagctgaatgtgcagaatggagtgctgaagagcctgtccttcctgtttgagtacatcggggagatgggcaaggactacatctatgctgtgacccccctgctggaggatgccctgatggaccgggacctggtgcaccggcagacagccagcgctgtggtgcagcacatgagcctgggcgtgtatggcttcggctgtgaggacagcctgaaccacctgctgaactacgtgtggcccaacgtgtttgagaccagcccccacgtgatccaggccgtgatgggcgccctggagggcctgcgggtggccatcggcccctgcaggatgctgcagtactgcctgcagggcctcttccacccagccaggaaggtgagagatgtgtactggaagatctacaacagcatctacatcggcagccaggatgccctgattgcccactacccccgcatctacaatgatgacaagaacacctacatccgctatgagctggactacatcctgtag

SEQ ID NO: 171528 - DNA, 435 bp, Artificial Sequence
  Description of Artificial Sequence: Synthetic coding sequence
atggccaagatcgccaagacccatgaagatattgaggcccagatccgggagatccagggcaagaaggccgccctggatgaggcccagggcgtgggcctggacagcacaggctactatgaccaggagatctacggcggcagtgacagcagatttgctggctacgtgaccagcattgctgccacagagctggaggatgatgatgatgactacagcagcagcaccagcctgctgggccagaagaagccaggctaccacgcccctgtggccctgctgaatgacatcccccagagcacagagcagtatgacccctttgctgagcacaggcctcccaagattgctgaccgggaggatgagtacaagaagcacaggaggaccatgatcatcagccctgagcggctggacccctttgctgatggcttctacagcgctgcctag

SEQ ID NO: 171529 - DNA, 435 bp, Artificial Sequence; identical to SEQ ID NO: 171528
  Description of Artificial Sequence: Synthetic coding sequence

SEQ ID NO: 171530 - DNA, 2688 bp, Artificial Sequence
  Description of Artificial Sequence: Synthetic coding sequence
atggccacagagcaccctgagccccccaaggccgagctgcagctgcccccacctcctcctcctggccactacggggcctgggccgcccaggagctgcaggccaagctggccgagattggagcccccatccagggcaaccgggaggagctggtggagcggctgcagagctacacccggcagacaggaattgtgctgaacagacctgtgctgcggggagaagatggagacaaggccgcccccccacccatgtctgcccagctgcccggcatccccatgcctcctccacccctgggcctgccccccctgcagcccccacctcctcctcctcctcctcctcctggcctgggcctgggcttccccatggcccacccccccaacctgggccccccaccacccctgcgggtgggggagcctgtggccctgtctgaggaggagcggctgaagctggcccagcagcaggccgccctgctgatgcagcaggaggagcgggccaagcagcagggcgaccacagcctgaaggagcacgagctgctggagcagcagaagagagctgctgtgctgctggagcaggagcggcagcaggagatcgccaagatgggcacccctgtgccccggcccccccaggacatgggccagattggagtgaggacccccctgggcccccgggtggccgcccctgtgggccctgtgggccccacccccaccgtgctgcccatgggcgcccctgtgccccggccccggggccccccacctcctcctggagatgagaaccgggagatggatgaccccagcgtgggccccaagatcccccaggccctggagaagatcctgcagctgaaggagagccggcaggaggagatgaacagccagcaggaggaggaggagatggagacagatgcccggagcagcctgggccagagcgccagcgagacagaagaagatactgtgtctgtgtccaagaaggagaagaacaggaagagaagaaacaggaagaagaagaagaagccccagagggtgcggggcgtgagcagcgagagcagcggggaccgggagaaggacagcaccaggagccggggcagtgacagccctgctgctgatgtggagattgaatatgtgacagaggagcctgagatctatgagcccaacttcatcttcttcaagaggatctttgaggccttcaagctgacagatgatgtgaagaaggagaaggagaaggagcctgagaagctggacaagctggagaacagcgctgcccccaagaagaagggctttgaggaggagcacaaggacagtgatgatgacagcagtgatgatgagcaggagaagaagccagaggcccccaagctgagcaagaagaagctgcggaggatgaaccgcttcaccgtggccgagctgaagcagctggtggcccggccagatgtggtggagatgcatgatgtgacagcccaggaccccaagctgctggtgcacctgaaggccaccagaaattctgtgcctgtgcccaggcactggtgcttcaagaggaagtacctgcagggcaagaggggcatcgagaagcccccatttgagctgcctgacttcatcaagaggacaggcatccaggagatgagggaggccctgcaggagaaggaggagcagaagaccatgaagagcaagatgagggagaaggtgcggcccaagatgggcaagattgacatcgactaccagaagctgcatgatgccttcttcaagtggcagaccaagcccaagctgaccatccatggagacctgtactatgagggcaaggagtttgagacccggctgaaggagaagaagccaggggacctgagtgatgagctgcgcatcagcctgggcatgcctgtgggccccaatgcccacaaggtgcccccaccctggctgattgccatgcagagatatggccccccacccagctaccccaacctgaagatccctggcctgaacagccccatccctgagagctgcagctttggctaccacgccggcggctggggcaagccccctgtggatgagaccgggaagcccctgtatggagatgtgtttggcaccaatgctgctgagttccagaccaagacagaggaggaggagattgacaggaccccctggggcgagctggagcccagtgatgaggagagcagcgaggaggaggaggaggaggagagtgatgaggacaagccagatgaaacaggcttcatcaccccagctgacagcggcctcatcacccctgggggcttcagctctgtgcctgctggcatggagaccccagagctgattgagctgaggaagaagaagattgaggaggccatggatggcagcgagaccccccagctgttcaccgtgctgcctgagaagaggacagccaccgtgggcggggccatgatgggcagcacccacatctatgacatgagcacagtgatgagcaggaaaggacctgcccctgagctgcagggcgtggaggtggccctggcccctgaggagctggagctggaccccatggccatgacccagaagtatgaggagcacgtgcgggagcagcaggcccaggtggagaaggaggacttcagtgacatggtggccgagcacgccgccaagcagaagcagaagaagaggaaggcccagccccaggacagcagaggaggcagcaagaagtacaaggagttcaagttctag

SEQ ID NO: 171531 - DNA, 2400 bp, Artificial Sequence
  Description of Artificial Sequence: Synthetic coding sequence
gccaagatggccacagagcaccctgagccccccaaggccgagctgcagctgcccccacctcctcctcctggccactacggggcctgggccgcccaggagctgcaggccaagctggccgagattggagcccccatccagggcaaccgggaggagctggtggagcggctgcagagctacacccggcagacaggaattgtgctgaacagacctgtgctgcggggagaagatggagacaaggccgcccccccacccatgtctgcccagctgcccggcatccccatgcctcctccacccctgggcctgccccccctgcagcccccacctcctcctcctcctcctcctcctggcctgggcctgggcttccccatggcccacccccccaacctgggccccccaccacccctgcgggtgggggagcctgtggccctgtctgaggaggagcggctgaagctggcccagcagcaggccgccctgctgatgcagcaggaggagcgggccaagcagggcgaccacagcctgaaggagcacgagctgctggagcagcagaagagagctgctgtgctgctggagcaggagcggcagcaggaggaggaggagatggagacagatgcccggagcagcctgggccagagcgccagcgagacagaagaagatactgtgtctgtgtccaagaaggagaagaacaggaagagaagaaacaggaagaagaagaagaagccccagagggtgcggggcgtgagcagcgagagcagcggggaccgggagaaggacagcaccaggagccggggcagtgacagccctgctgctgatgtggagattgaatatgtgacagaggagcctgagatctatgagcccaacttcatcttcttcaagaggatctttgaggccttcaagctgacagatgatgtgaagaaggagaaggagaaggagcctgagaagctggacaagctggagaacagcgctgcccccaagaagaagggctttgaggaggagcacaaggacagtgatgatgacagcagtgatgatgagcaggagaagaagccagaggcccccaagctgagcaagaagaagctgcggaggatgaaccgcttcaccgtggccgagctgaagcagctggtggcccggccagatgtggtggagatgcatgatgtgacagcccaggaccccaagctgctggtgcacctgaaggccaccagaaattctgtgcctgtgcccaggcactggtgcttcaagaggaagtacctgcagggcaagaggggcatcgagaagcccccatttgagctgcctgacttcatcaagaggacaggcatccaggagatgagggaggccctgcaggagaaggaggagcagaagaccatgaagagcaagatgagggagaaggtgcggcccaagatgggcaagattgacatcgactaccagaagctgcatgatgccttcttcaagtggcagaccaagcccaagctgaccatccatggagacctgtactatgagggcaaggagtttgagacccggctgaaggagaagaagccaggggacctgagtgatgagctgcgcatcagcctgggcatgcctgtgggccccaatgcccacaaggtgcccccaccctggctgattgccatgcagagatatggccccccacccagctaccccaacctgaagatccctggcctgaacagccccatccctgagagctgcagctttggctaccacgccggcggctggggcaagccccctgtggatgagaccgggaagcccctgtatggagatgtgtttggcaccaatgctgctgagttccagaccaagacagaggaggaggagattgacaggaccccctggggcgagctggagcccagtgatgaggagagcagcgaggaggaggaggaggaggagagtgatgaggacaagccagatgaaacaggcttcatcaccccagctgacagcggcctcatcacccctgggggcttcagctctgtgcctgctggcatggagaccccagagctgattgagctgaggaagaagaagattgaggaggccatggatggcagcgagaccccccagctgttcaccgtgctgcctgagaagaggacagccaccgtgggcggggccatgatgggcagcacccacatctatgacatgagcacagtgatgagcaggaaaggacctgcccctgagctgcagggcgtggaggtggccctggcccctgaggagctggagctggaccccatggccatgacccagaagtatgaggagcacgtgcgggagcagcaggcccaggtggagaaggaggacttcagtgacatggtggccgagcacgccgccaagcagaagcagaagaagaggaaggcccagccccaggacagcagaggaggcagcaagaagtacaaggagttcaagttctag

SEQ ID NO: 171532 - DNA, 3654 bp, Artificial Sequence
  Description of Artificial Sequence: Synthetic coding sequence
atgttcctgtacaacctgaccctgcagagggccaccggcatcagctttgccatccacggcaacttcagcggcaccaagcagcaggagatcgtggtgtcccggggcaagatcctggagctgctgcggccagaccccaacacaggcaaggtgcacaccctgctgactgtggaggtgtttggagtcatccgcagcctgatggccttccggctgactggaggcaccaaggactacatcgtggtgggcagtgacagcggcagaattgtcatcctggagtaccagcccagcaagaacatgtttgagaagatccaccaggagaccttcggcaagagcggctgcagaagaattgtgcccggccagttcctggccgtggaccccaagggccgggctgtgatgatcagcgccatcgagaagcagaagctggtgtacatcctgaacagagatgctgctgcccggctgaccatcagcagccccctggaggcccacaaggccaacaccctggtgtaccacgtggtgggcgtggatgtgggctttgagaaccccatgtttgcctgcctggagatggactatgaggaggccgacaatgaccccactggagaggccgccgccaacacccagcagaccctgaccttctatgagctggacctgggcctgaaccacgtggtgaggaagtacagcgagcccctggaggagcacggcaacttcctgatcaccgtgcctgggggcagtgatggccccagcggcgtgctgatctgcagcgagaactacatcacctacaagaactttggagaccagcctgacatccgctgccccatccccaggagaagaaatgacctggatgatcctgagcggggcatgatctttgtgtgcagcgccacccacaagaccaagtccatgttcttcttcctggcccagacagagcagggcgacatcttcaagatcaccctggagacagatgaggacatggtgacagagatccggctgaagtactttgacacagtgcctgtggccgccgccatgtgtgtgctgaagacaggcttcctgtttgtggccagcgagtttggaaaccactacctgtaccagatcgcccacctgggagatgatgatgaggagcctgagttcagcagcgccatgcccctggaggagggggacaccttcttcttccagccccggcccctgaagaacctggtgctggtggatgagctggacagcctgagccccatcctcttctgccagattgctgacctggccaatgaagacaccccccagctgtatgtggcctgtggccggggccccaggagcagcctgcgggtgctgcggcacggcctggaggtgtctgagatggctgtgtctgagctgcccggcaaccccaatgctgtgtggacagtgagaagacacattgaagatgaatttgatgcctacatcatcgtgtcctttgtgaatgccaccctggtgctgagcattggagagaccgtggaggaggtgacagattctggcttcctgggcaccacccccaccctgagctgcagcctgctgggagatgatgccctggtgcaggtgtacccagatggcatccgccacatccgggctgacaagagggtgaatgagtggaagaccccaggcaagaagaccatcgtgaagtgtgctgtgaaccagaggcaggtggtgattgccctgactggaggagagctggtgtactttgagatggaccccagcggccagctgaatgagtacacagagaggaaggagatgtctgcagatgtggtgtgcatgagcctggccaacgtgcccccaggagagcagaggagccgcttcctggccgtgggcctggtggacaacacagtgcgcatcatcagcctggaccccagcgactgcctgcagcccctgtccatgcaggccctgcctgcccagcctgagagcctgtgcatcgtggagatgggcggcacagagaagcaggatgagctgggggagcggggcagcatcggcttcctgtacctgaacatcggcctgcagaatggagtgctgctgaggacagtgctggaccctgtgactggagacctgagtgacaccaggacccgctacctgggcagcaggcctgtgaagctgttccgggtgaggatgcagggccaggaggccgtgctggccatgagcagccgctcctggctgagctacagctaccagagccgcttccacctgacccccctgtcctatgagaccctggagtttgccagcggctttgccagcgagcagtgcccagagggcatcgtggccatcagcaccaacaccctgcgcatcctggccctggagaagctgggcgctgtgttcaaccaggtggccttccccctgcagtacacccccaggaagtttgtgatccaccctgagagcaacaacctgatcatcatcgagacagaccacaatgcctacacagaggccaccaaggcccagaggaagcagcagatggccgaggagatggtggaggccgctggagaagatgagcgggagctggccgctgagatggccgccgccttcctgaatgaaaacctgcctgagagcatctttggagcccccaaggctggaaatggccagtgggccagcgtcatccgggtgatgaaccccatccagggcaacaccctggacctggtgcagctggagcagaatgaagctgccttctctgtggccgtgtgccgcttcagcaacacaggagaggactggtacgtgctggtgggcgtggccaaggacctgatcctgaaccccaggtctgtggccggcggctttgtgtacacctacaagctggtgaacaatggagagaagctggagttcctgcacaagacccctgtggaggaggtgcctgctgccatcgcccccttccagggccgggtgctgattggagtgggcaagctgctgcgggtgtatgacctgggcaagaagaagctgctgaggaaatgtgagaacaagcacatcgccaactacatcagcggcatccagaccatcggccaccgggtgattgtgtctgatgtgcaggagagcttcatctgggtgcgctacaagagaaatgaaaaccagctgatcatctttgctgatgacacctacccccgctgggtgaccacagccagcctgctggactatgacacagtggccggggctgacaagtttggaaacatctgtgtggtgcggctgccccccaacaccaatgatgaggtggatgaggaccccactggaaacaaggccctgtgggaccggggcctgctgaatggagccagccagaaggccgaggtgatcatgaactaccacgtgggggagaccgtgctgagcctgcagaagaccaccctcatccctgggggcagcgagagcctggtgtacaccaccctgagcggcggcatcggcatcctggtgcccttcaccagccatgaggaccatgacttcttccagcacgtggagatgcacctgcggtctgagcacccccccctgtgtggccgggaccacctgtccttccgcagctactacttccctgtgaagaatgtgattgatggagacctgtgtgagcagttcaacagcatggagcccaacaagcagaagaatgtgtctgaggagctggacaggaccccacctgaggtgtccaagaagctggaggacatccgcaccaggtatgccttctag

SEQ ID NO: 171533 - DNA, 828 bp, Artificial Sequence
  Description of Artificial Sequence: Synthetic coding sequence
atgttcctgtacaacctgaccctgcagagggccaccggcatcagctttgccatccacggcaacttcagcggcaccaagcagcaggagatcgtggtgtcccggggcaagatcctggagctgctgcggccagaccccaacacaggcaaggtgcacaccctgctgactgtggaggtgtttggagtcatccgcagcctgatggccttccggctgactggaggcaccaaggactacatcgtggtgggcagtgacagcggcagaattgtcatcctggagtaccagcccagcaagaacatgtttgagaagatccaccaggagaccttcggcaagagcggctgcagaagaattgtgcccggccagttcctggccgtggaccccaagggccgggctgtgatgatcagcgccatcgagaagcagaagctggtgtacatcctgaacagagatgctgctgcccggctgaccatcagcagccccctggaggcccacaaggccaacaccctggtgtaccacgtggtgggcgtggatgtgggctttgagaaccccatgtttgcctgcctggagatggactatgaggaggccgacaatgaccccactggagaggccgccgccaacacccagcagaccctgaccttctatgagctggacctgggcctgaaccacgtggtgaggaagtacagcgagcccctggaggagcacggcaacttcctgatcaccgtgcctgggggcagtgatggccccagcggcgtgctgaacctgagcccccccttccccaaggccatcccagccctgatctgcctggacagccctgtgtacttctgcacccacccctag

SEQ ID NO: 171534 - DNA, 1275 bp, Artificial Sequence
  Description of Artificial Sequence: Synthetic coding sequence
atggctgctggccccatcagcgagaggaaccaggatgccaccgtgtatgtgggcggcctggatgagaaggtgtctgagcccctgctgtgggagctgttcctgcaggccggccctgtggtgaacacccacatgcccaaggacagagtgacaggccagcaccagggctacggctttgtggagttcctgtctgaagaagatgctgactatgccatcaagatcatgaacatgatcaagctgtatggcaagcccatccgggtgaacaaggccagcgcccacaacaagaacctggatgtgggcgccaacatcttcatcggcaacctggaccctgagattgatgagaagctgctgtatgacaccttcagcgcctttggagtcatcctgcagacccccaagatcatgagggaccctgacaccggcaacagcaagggctacgccttcatcaactttgccagctttgatgccagtgatgctgccatcgaggccatgaatggccagtacctgtgcaaccggcccatcaccgtgtcctatgccttcaagaaggacagcaaaggagagagacatggcagcgctgctgagcggctgctggccgcccagaaccccctgagccaggccgaccggccccaccagctgtttgctgatgcccctcctcctccttctgcccccaaccctgtggtgagcagcctgggcagcggcctgcccccacctggcatgcctcctcctggcagcttccccccacctgtgcccccacctggggccctgcccccaggcatccccccagccatgcctcctccacccatgcctcctggagctgctggccacggccccccatctgctggcaccccaggagctggccaccctggccacggccacagccacccccaccccttccccccaggcggcatgccccaccctggcatgagccagatgcagctggcccaccacggcccccacggcctgggccacccccacgccggccccccaggcagcggcggccagcccccacccaggcctcctcctggcatgccccaccctggccccccacccatgggcatgccaccccggggcccccccttcggcagccccatgggccaccctggccccatgcctcctcatggcatgaggggccccccacccctgatgcctcctcatggctacacaggccccccccggcccccaccctacggctaccagaggggccccctgcccccaccccggcccaccccccggccccctgtgcccccccggggccccctgcggggccccctgccccagtag

SEQ ID NO: 171535 - DNA, 573 bp, Artificial Sequence
  Description of Artificial Sequence: Synthetic coding sequence
atgcccaaggacagagtgacaggccagcaccagggctacggctttgtggagttcctgtctgaggaggatgctgactatgccatcaagatcatgaacatgatcaagctgtatggcaagcccatccgggtgaacaaggccagcgcccacaacaagaacctggatgtgggcgccaacatcttcatcggcaacctggaccctgagattgatgagaagctgctgtatgacaccttcagcgccttcggggtcatcctgcagacccccaagatcatgagggaccctgacaccggcaacagcaagggctacgccttcatcaactttgccagctttgatgccagtgatgctgccatcgaggccatgaatggccagtacctgtgcaaccggcccatcaccgtgtcctatgccttcaagaaggacagcaagggggagcggcacggcagcgctgctgagcggctgctggccgcccagaaccccctgagccaggccgaccggccccaccagctgtttgctgatgcccctcctccacccagcgcccccaaccctgtggtgagcagcctgggcagcggcctgccctag

SEQ ID NO: 171536 - DNA, 2124 bp, Artificial Sequence
  Description of Artificial Sequence: Synthetic coding sequence
atgagccgggaccgcttccgcagccggggcggcggcggcggcggcttccaccggcggggcggcggcggcggccggggcggcctgcatgacttccgcagccccccacctggcatgggcctgaaccagaacagaggccccatgggccctggccctggccagagcggccccaagccacccatccccccacctccaccccaccagcagcagcagcagcccccaccccagcagcccccaccccagcagcccccaccccaccagcccccaccccacccccagccccaccagcagcagcagcccccacctccaccccaggacagcagcaagcctgtggtggcccagggccctggccctgcccctggggtgggcagcgcccccccagccagcagcagcgcccccccagccaccccacccaccagcggggcccctcctggcagcggccctggccccacccccaccccacctcctgctgtgaccagcgcccctcctggggcccccccacccaccccacccagcagcggcgtgcccaccaccccaccccaggccggcggccccccacctcctcctgctgctgtgcccggccctggccctggccccaagcagggccctggccctgggggccccaagggcggcaagatgcctgggggccccaagccaggcggcggccctggcctgagcaccccaggcggccaccccaagccaccccacagaggaggaggagagccccggggcggccggcagcaccaccccccctaccaccagcagcaccaccagggccccccacctgggggccctgggggccgctctgaggagaagatcagtgacagcgagggcttcaaggccaacctgagcctgctgcggcggcctggagagaagacctacacccagcgctgccgcctgtttgtgggcaacctgcctgctgacatcacagaagatgagttcaagaggctgtttgccaagtacggggagcctggagaggtgttcatcaacaagggcaagggcttcggcttcatcaagctggagagccgggccctggccgagatcgccaaggccgagctggatgacacccccatgaggggccggcagctgcgggtgcgctttgccacccacgccgccgccctgtctgtgaggaacctgagcccctacgtgtccaatgagctgctggaggaggccttcagccagtttggccccatcgagagagctgtggtgattgtggatgaccggggccgcagcactggaaaaggaattgtggagtttgccagcaagccagctgccaggaaggcctttgagcgctgcagcgagggcgtcttcctgctgaccaccacccccaggcctgtgattgtggagcccctggagcagctggatgatgaagatggcctgcctgagaagctggcccagaagaaccccatgtaccagaaggagcgggagaccccacccaggtttgcccagcacggcacctttgaatatgagtacagccagcgctggaagagcctggatgagatggagaagcagcagcgggagcaggtggagaagaacatgaaggatgccaaggacaagctggagagcgagatggaggatgcctaccacgagcaccaggccaacctgctgcggcaggacctgatgaggcggcaggaggagctgcggaggatggaggagctgcacaaccaggagatgcagaagaggaaggagatgcagctgcggcaggaggaggagaggagaagaagagaggaggagatgatgatccggcagcgggagatggaggagcagatgaggcggcagcgggaggagagctacagcaggatgggctacatggacccccgggagcgggacatgaggatgggcggcggcggggccatgaacatgggagacccctacggcagcggcggccagaagttcccccccctgggcggcggcggcggcatcggctatgaggccaaccctggggtgcccccagccaccatgagcggctccatgatgggcagtgacatgaggacagaaagatttggccagggcggggccggccctgtgggcggccagggcccccggggcatgggccctggcaccccagctggctacggccggggccgggaggagtatgagggccccaacaagaagccccgcttctag

SEQ ID NO: 171537 - DNA, 1875 bp, Artificial Sequence
  Description of Artificial Sequence: Synthetic coding sequence
atgaacagcggcggcggcttcggcctgggcctgggcttcggcctgacccccaccagcgtcatccaggtgaccaacctgagcagcgctgtgaccagcgagcagatgaggaccctcttctccttcctgggggagattgaggagctgcggctgtaccccccagacaatgcccccctggccttcagcagcaaggtgtgctacgtgaagttccgggaccccagctctgtgggcgtggcccagcacctgaccaacacagtgttcatcgaccgggccctgattgtggtgccctgtgccgagggcaagatccctgaggagagcaaggccctgagcctgctggccccagcccccaccatgaccagcctgatgcctggggccggcctgctgcccatccccacccccaaccccctgaccaccctgggcgtgtccctgagcagcctgggcgccatcccagctgctgccctggaccccaacatcgccaccctgggggagatcccccagccccccctgatgggaaatgtggaccccagcaagattgatgagatcagaagaacagtgtatgtgggcaacctgaacagccagaccaccacagctgaccagctgctggagttcttcaagcaggtgggggaggtgaagtttgtgaggatggctggagatgagacccagcccaccaggtttgcctttgtggagtttgctgaccagaacagcgtgccccgggccctggccttcaacggggtgatgtttggagaccggcccctgaagatcaaccacagcaacaatgccatcgtgaagcccccagagatgaccccccaggccgccgccaaggagctggaggaggtgatgaagagggtgcgggaggcccagagcttcatctctgctgccatcgagcctgagagcggcaagagcaatgaaaggaagggcggccgcagccgcagccacaccaggagcaagagccgcagcagcagcaagagccacagcaggaggaagaggagccagagcaagcacaggagccgcagccacaacagaagccgcagccggcagaaggacagaagaagaagcaagagcccccacaagaagaggagcaagagccgggagaggaggaagagccgcagccgcagccacagccgggacaagaggaaggacacccgggagaagatcaaggagaaggagcgggtgaaggagaaggaccgggagaaggagcgggagcgggagaaggagcgggagaaggagaaggagcggggcaagaacaaggaccgggacaaggagcgggagaaggaccgggagaaggacaaggagaaggaccgggagcgggagcgggagaaggagcacgagaaggaccgggacaaggagaaggagaaggagcaggacaaggagaaggagcgggagaaggacaggagcaaggagattgatgagaagaggaagaaggacaagaagagcaggaccccacccaggagctacaatgccagccgccgcagccgcagcagcagccgggagaggagaagaagaagaagccgcagcagcagccgcagccccaggaccagcaagaccatcaagaggaagagcagccgcagccccagccccaggagcaggaacaagaaggacaagaagcgggagaaggagcgggaccacatcagcgagcggcgggagcgggagaggagcacctccatgaggaagagcagcaatgacagagatggcaaggagaagctggagaagaacagcaccagcctgaaggagaaggagcacaacaaggagccagacagctctgtgtccaaggaggtggatgacaaggatgcccccaggacagaggagaacaagatccagcacaatggaaactgccagctgaatgaggagaacctgagcaccaagacagaagctgtgtag

SEQ ID NO: 171538 - DNA, 1527 bp, Artificial Sequence
  Description of Artificial Sequence: Synthetic coding sequence
atgaccagcctgatgcctggggccggcctgctgcccatccccacccccaaccccctgaccaccctgggcgtgtccctgagcagcctgggcgccatcccagctgctgccctggaccccaacatcgccaccctgggggagatcccccagccccccctgatgggaaatgtggaccccagcaagattgatgagatcagaagaacagtgtatgtgggcaacctgaacagccagaccaccacagctgaccagctgctggagttcttcaagcaggtgggggaggtgaagtttgtgaggatggctggagatgagacccagcccaccaggtttgcctttgtggagtttgctgaccagaacagcgtgccccgggccctggccttcaacggggtgatgtttggagaccggcccctgaagatcaaccacagcaacaatgccatcgtgaagcccccagagatgaccccccaggccgccgccaaggagctggaggaggtgatgaagagggtgcgggaggcccagagcttcatctctgctgccatcgagcctgagagcggcaagagcaatgaaaggaagggcggccgcagccgcagccacaccaggagcaagagccgcagcagcagcaagagccacagcaggaggaagaggagccagagcaagcacaggagccgcagccacaacagaagccgcagccggcagaaggacagaagaagaagcaagagcccccacaagaagaggagcaagagccgggagaggaggaagagccgcagccgcagccacagccgggacaagaggaaggacacccgggagaagatcaaggagaaggagcgggtgaaggagaaggaccgggagaaggagcgggagcgggagaaggagcgggagaaggagaaggagcggggcaagaacaaggaccgggacaaggagcgggagaaggaccgggagaaggacaaggagaaggaccgggagcgggagcgggagaaggagcacgagaaggaccgggacaaggagaaggagaaggagcaggacaaggagaaggagcgggagaaggacaggagcaaggagattgatgagaagaggaagaaggacaagaagagcaggaccccacccaggagctacaatgccagccgccgcagccgcagcagcagccgggagaggagaagaagaagaagccgcagcagcagccgcagccccaggaccagcaagaccatcaagaggaagagcagccgcagccccagccccaggagcaggaacaagaaggacaagaagcgggagaaggagcgggaccacatcagcgagcggcgggagcgggagaggagcacctccatgaggaagagcagcaatgacagagatggcaaggagaagctggagaagaacagcaccagcctgaaggagaaggagcacaacaaggagccagacagctctgtgtccaaggaggtggatgacaaggatgcccccaggacagaggagaacaagatccagcacaatggaaactgccagctgaatgaggagaacctgagcaccaagacagaagctgtgtag

SEQ ID NO: 171539 - DNA, 231 bp, Artificial Sequence
  Description of Artificial Sequence: Synthetic coding sequence
atgaccagcctgatgcctggggccggcctgctgcccatccccacccccaaccccctgaccaccctgggcgtgtccctgagcagcctgggcgccatcccagctgctgccctggaccccaacatcgccaccctgggggagatcccccagccccccctgatgggaaatgtggaccccagcaagattgatgagatcagaagaacagtgtatgtgggcaacctgaacagccagtag

SEQ ID NO: 171540 - DNA, 1545 bp, Artificial Sequence
  Description of Artificial Sequence: Synthetic coding sequence
atgaacagcggcggcggcttcggcctgggcctgggcttcggcctgacccccaccagcgtcatccaggtgaccaacctgagcagcgctgtgaccagcgagcagatgaggaccctcttctccttcctgggggagattgaggagctgcggctgtaccccccagacaatgcccccctggccttcagcagcaaggtgtgctacgtgaagttccgggaccccagctctgtgggcgtggcccagcacctgaccaacacagtgttcatcgaccgggccctgattgtggtgccctgtgccgagggcaagatccctgaggagagcaaggccctgagcctgctggccccagcccccaccatgaccagcctgatgcctggggccggcctgctgcccatccccacccccaaccccctgaccaccctgggcgtgtccctgagcagcctgggcgccatcccagctgctgccctggaccccaacatcgccaccctgggggagatcccccagccccccctgatgggaaatgtggaccccagcaagattgatgagatcagaagaacagtgtatgtgggcaacctgaacagccagaccaccacagctgaccagctgctggagttcttcaagcaggtgggggaggtgaagtttgtgaggatggctggagatgagacccagcccaccaggtttgcctttgtggagtttgctgaccagaacagcgtgccccgggccctggccttcaacggggtgatgtttggagaccggcccctgaagatcaaccacagcaacaatgccatcgtgaagcccccagagatgaccccccaggccgccgccaaggagctggaggaggtgatgaagagggtgcgggaggcccagagcttcatctctgctgccatcgagcctgagagcggcaagagcaatgaaaggaagggcggccgcagccgcagccacaccaggagcaagagccgcagcagcagcaagagccacagcaggaggaagaggagccagagcaagcacaggagccgcagccacaacagaagccgcagccggcagaaggacagaagaagaagcaagagcccccacaagaagaggagcaagagccgggagaggaggaagagccgcagccgcagccacagccgggacaagaggaaggacacccgggagaagatcaaggagaaggagcgggtgaaggagaaggaccgggagaaggagcgggagcgggagaaggagcgggagaaggagaaggagcggggcaagaacaaggaccgggacaaggagcgggagaaggaccgggagaaggacaaggagaaggaccgggagcgggagcgggagaaggagcacgagaaggaccgggacaaggagaaggagaaggagcaggacaaggagaaggagcgggagaaggacaggagcaaggagattgatgagaagaggaagaaggacaagaaccctgagcaccaccctggggtgaccatgcaccgggaggacctggtggtgcctgctgggaagggcgtgggcggcggggccggcgtgctgcctgaccggcaggagcaccagaagccctag

SEQ ID NO: 171541 - DNA, 213 bp, Artificial Sequence
  Description of Artificial Sequence: Synthetic coding sequence
atgtctgagaagaagcagcctgtggacctgggcctgctggaggaggatgatgaatttgaggagttccctgctgaggactgggccggcctggatgaagatgaagatgcccacgtgtgggaggacaactgggatgatgacaacgtggaggatgacttcagcaaccagctgcgggcagagctggagaagcacggctacaagatggagaccagctag

SEQ ID NO: 171542 - DNA, 1077 bp, Artificial Sequence
  Description of Artificial Sequence: Synthetic coding sequence
atggcctttgcccccatgggccctgaggccagcttctttgatgtgctggacagacaccgggagagcctgctggccgccctgcggcggggcggccgggagccccccaccggcggcagccggctggccagcagatttgaggacagcgtgggcctgcagatggtgagccactgcaccaccaggaagatcaagagtgacagccccaagagcgcccagaagttcagcctcatcctgaagatcctgtccatgatctacaagctggtgcagagcaacacctacgccaccaagagggacatctactacacagacagccagctgtttggaaaccagacagtggtggacaacatcatcaatgacatcagctgcatgctgaaggtgtccagaagaagcctgcacatcctgagcaccagcaagggcctgattgctggcaacctgcgctacattgaagaagatggcaccaaggtgaactgcacctgtggggccacagctgtggccgtgcccagcaacatccagggcatccggaacctggtgacagatgccaagtttgtgctgattgtggagaaggatgccaccttccagaggctgctggatgacaacttctgcaacaagctgagcccctgcatcatgatcaccgggaagggcgtgcctgacctgaacacccggctgctggtgaagaagctgtgggacaccttccacgtgcctgtgttcaccctggtggatgctgacccccatggaattgagatcatgtgcatctacaagtatggctccatgtccatgagctttgaggcccaccacctgactgtgcctgccatccgctggctgggcctgctgcccagcgacctgaagaggctgaatgtgcccaaggacagcctcatccccctgaccaagagggaccagatgaagctggacagcatcctgcggcggccctacgtgacctgccagcccttctggaggaaggagatggagatcatggctgacagcaagatgaaggccgagatccaggccctgaccttcctgagcagtgactacctgagccgggtgtacctgcccaacaagctgaagtttggaggctggatctag

SEQ ID NO: 171543 - DNA, 1065 bp, Artificial Sequence
  Description of Artificial Sequence: Synthetic coding sequence
atggcctttgcccccatgggccctgaggccagcttctttgatgtgctggacagacaccgggagagcctgctggccgccctgcggcggggcggccgggagccccccaccggcggcagccggctggccagcagatttgaggacagcgtgggcctgcagatggtgagccactgcaccaccaggaagatcaagagtgacagccccaagagcgcccagaagttcagcctcatcctgaagatcctgtccatgatctacaagctggtgcagagcaacacctacgccaccaagagggacatctactacacagacagccagctgtttggaaaccagacagtggtggacaacatcatcaatgacatcagctgcatgctgaaggtgtccagaagaagcctgcacatcctgagcaccagcaagggcctgattgctggcaacctgcgctacattgaagaagatggcaccaaggtgaactgcacctgtggggccacagctgtggccgtgcccagcaacatccagggcatcagaaatgccaagtttgtgctgattgtggagaaggatgccaccttccagaggctgctggatgacaacttctgcaacaagctgagcccctgcatcatgatcaccgggaagggcgtgcctgacctgaacacccggctgctggtgaagaagctgtgggacaccttccacgtgcctgtgttcaccctggtggatgctgacccccatggaattgagatcatgtgcatctacaagtatggctccatgtccatgagctttgaggcccaccacctgactgtgcctgccatccgctggctgggcctgctgcccagcgacctgaagaggctgaatgtgcccaaggacagcctcatccccctgaccaagagggaccagatgaagctggacagcatcctgcggcggccctacgtgacctgccagcccttctggaggaaggagatggagatcatggctgacagcaagatgaaggccgagatccaggccctgaccttcctgagcagtgactacctgagccgggtgtacctgcccaacaagctgaagtttggaggctggatctag

SEQ ID NO: 171544 - DNA, 1191 bp, Artificial Sequence
  Description of Artificial Sequence: Synthetic coding sequence
atggcctttgcccccatgggccctgaggccagcttctttgatgtgctggacagacaccgggagagcctgctggccgccctgcggcggggcggccgggagccccccaccggcggcagccggctggccagcagcagcgaggtgctggccagcattgagaacatcatccaggacatcatcaccagcctggccagaaatgaggccccagccttcaccatcgacaacagaagctcctgggagaacatcaagtttgaggacagcgtgggcctgcagatggtgagccactgcaccaccaggaagatcaagagtgacagccccaagagcgcccagaagttcagcctcatcctgaagatcctgtccatgatctacaagctggtgcagagcaacacctacgccaccaagagggacatctactacacagacagccagctgtttggaaaccagacagtggtggacaacatcatcaatgacatcagctgcatgctgaaggtgtccagaagaagcctgcacatcctgagcaccagcaagggcctgattgctggcaacctgcgctacattgaagaagatggcaccaaggtgaactgcacctgtggggccacagctgtggccgtgcccagcaacatccagggcatccggaacctggtgacagatgccaagtttgtgctgattgtggagaaggatgccaccttccagaggctgctggatgacaacttctgcaacaagctgagcccctgcatcatgatcaccgggaagggcgtgcctgacctgaacacccggctgctggtgaagaagctgtgggacaccttccacgtgcctgtgttcaccctggtggatgctgacccccatggaattgagatcatgtgcatctacaagtatggctccatgtccatgagctttgaggcccaccacctgactgtgcctgccatccgctggctgggcctgctgcccagcgacctgaagaggctgaatgtgcccaaggacagcctcatccccctgaccaagagggaccagatgaagctggacagcatcctgcggcggccctacgtgacctgccagcccttctggaggaaggagatggagatcatggctgacagcaagatgaaggccgagatccaggccctgaccttcctgagcagtgactacctgagccgggtgtacctgcccaacaagctgaagtttggaggctggatctag

SEQ ID NO: 171545 - DNA, 813 bp, Artificial Sequence
  Description of Artificial Sequence: Synthetic coding sequence
ctgctggccgccctgcggcggggcggccgggagccccccaccggcggcagccggctggccagcagcagcgaggtgctggccagcattgagaacatcatccaggacatcatcaccagcctggccagaaatgaggccccagccttcaccatcgacaacagaagctcctgggagaacatcaagtttgaggacagcgtgggcctgcagatggtgagccactgcaccaccaggaagatcaagagtgacagccccaagagcgcccagaagttcagcctcatcctgaagatcctgtccatgatctacaagctggtgcagagcaacacctacgccaccaagagggacatctactacacagacagccagctgtttggaaaccagacagtggtggacaacatcatcaatgacatcagctgcatgctgaaggtgtccagaagaagcctgcacatcctgagcaccagcaagggcctgattgctggcaacctgcgctacattgaagaagatggcaccaaggtgaactgcacctgtggggccacagctgtggccgtgcccagcaacatccagggcatccgcatcacagatgccaagtttgtgctgattgtggagaaggatgccaccttccagaggctgctggatgacaacttctgcaacaagctgagcccctgcatcatgatcaccgggaagggcgtgcctgacctgaacacccggctgctggtgaagaagctgtgggacaccttccacgtgcctgtgttcaccctggtggatgctgacccccatggaattgagatcatgtgcatctacaagtatggctccatgtag

SEQ ID NO: 171546 - DNA, 996 bp, Artificial Sequence
  Description of Artificial Sequence: Synthetic coding sequence
atggagaaccccagccctgctgctgccctgggcaaggccctgtgtgccctgctgctggccaccctgggcgctgctggccagcccctgggcggggagagcatctgcagcgcccgggccctggccaagtacagcatcaccttcaccgggaagtggagccagacagccttccccaagcagtaccccctcttccggcccccagcccagtggagcagcctgctgggcgccgcccacagcagtgactacagcatgtggaggaagaaccagtatgtgtccaatggcctgcgggactttgctgagcggggggaggcctgggccctgatgaaggagattgaggccgccggggaggccctgcagagcgtgcatgctgtgttttctgccccagctgtgcccagcggcaccggccagaccagcgctgagctggaggtgcagaggaggcacagcctggtgtcctttgtggtgagaattgtgcccagcccagactggtttgtgggcgtggacagcctggacctgtgtgatggagaccgctggagggagcaggccgccctggacctgtacccctatgatgctggaacagattctggcttcaccttcagcagccccaactttgccaccatcccccaggacacagtgacagagatcaccagcagcagccccagccacccagccaacagcttctactacccccggctgaaggccctgccccccatcgcccgggtgaccctggtgcggctgcggcagagcccccgggccttcatccccccagcccctgtgctgcccagccgggacaatgaaattgtggacagcgcctctgtgcctgagacccccctggactgtgaggtgtccctgtggagctcctggggcctgtgtggcggccactgcggccgcctgggcaccaagagcaggacccgctacgtgcgggtgcagcctgccaacaacggcagcccctgcccagagctggaggaggaggccgagtgtgtgcctgacaactgtgtgtag

SEQ ID NO: 171547 - DNA, 996 bp, Artificial Sequence; identical to SEQ ID NO: 171546
  Description of Artificial Sequence: Synthetic coding sequence

SEQ ID NO: 171548 - DNA, 186 bp, Artificial Sequence
  Description of Artificial Sequence: Synthetic coding sequence
atggagaaccccagccctgctgctgccctgggcaaggccctgtgtgccctgctgctggccaccctgggcgctgctggccagcccctgggcggggagagcatctgcagcgcccgggccctggccaagtacagcatcaccttcaccgggaagtggagccagacagccttccccaagcagtacccctag

SEQ ID NO: 171549 - DNA, 327 bp, Artificial Sequence
  Description of Artificial Sequence: Synthetic coding sequence
atggagaaccccagccctgctgctgccctgggcaaggccctgtgtgccctgctgctggccaccctgggcgctgctggccagcccctgggcggggagagcatctgcagcgcccgggccctggccaagtacagcatcaccttcaccgggaagtggagccagacagccttccccaagcagtaccccctcttccggcccccagcccagtggagcagcctgctgggcgccgcccacagcagtgactacagcatgtggaggaagaaccagtatgtgtccaatggcctgcgggactttgctgagcggggggaggcctgggccctgatgaagtag

SEQ ID NO: 171550 - DNA, 54 bp, Artificial Sequence
  Description of Artificial Sequence: Synthetic coding sequence
atggagaaccccagccctgctgctgccctgggcaaggccctgtgtgccctgtag

SEQ ID NO: 171551 - DNA, 27 bp, Artificial Sequence
  Description of Artificial Sequence: Synthetic coding sequence
atggagaaccccagccctgctgcctag

SEQ ID NO: 171552 - DNA, 51 bp, Artificial Sequence
  Description of Artificial Sequence: Synthetic coding sequence
atggagaaccccagccctgctgctgccctgggcaaggccctgtgtgcctag

SEQ ID NO: 171553 - DNA, 75 bp, Artificial Sequence
  Description of Artificial Sequence: Synthetic coding sequence
atggagaaccccagccctgctgctgccctgggcaaggccctgtgtgccctgctgctggccaccctgggcgcctag

SEQ ID NO: 171554 - DNA, 195 bp, Artificial Sequence
  Description of Artificial Sequence: Synthetic coding sequence
atggagaaccccagccctgctgctgccctgggcaaggccctgtgtgccctgctgctggccaccctgggcgctgctggccagcccctgggcggggagagcatctgcagcgcccgggccctggccaagtacagcatcaccttcaccgggaagtggagccagacagccttccccaagcagtaccccctcttcagatag

SEQ ID NO: 171555 - DNA, 960 bp, Artificial Sequence
  Description of Artificial Sequence: Synthetic coding sequence
atggacccccagaaccagcacggcagcggcagcagcctggtggtgatccagcagcccagcctggacagccggcagaggctggactatgagcgggagatccagcccacagccatcctgagcctggaccagatcaaggccatccggggcagcaatgagtacacagagggccccagcgtggtgaagaggcctgcccccaggacagccccccggcaggagaagcatgagaggacccatgagatcatccccatcaacgtgaacaacaactatgagcaccgccacaccagccacctgggccatgctgtgctgcccagcaatgcccggggccccatcctgagccgcagcaccagcactggatctgctgccagcagcggcagcaacagcagcgccagcagcgagcagggcctgctgggccgcagcccccccaccaggcctgtgcccggccacaggtctgagcgggccatccgcacccagcccaagcagctgattgtggatgacctgaagggcagcctgaaggaggacctgacccagcacaagttcatctgtgagcagtgtgggaagtgcaagtgtggagaatgtacagcccccaggaccctgcccagctgcctggcctgcaaccggcagtgcctgtgcagcgctgagagcatggtggagtatggcacctgcatgtgcctggtgaagggcatcttctaccactgcagcaatgatgatgaaggagacagctacagcgacaacccctgcagctgcagccagagccactgctgcagccgctacctgtgcatgggcgccatgagcctcttcctgccctgcctgctgtgctaccccccagccaagggctgcctgaagctgtgccgccgctgctatgactggatccacaggcctggctgccgctgcaagaacagcaacacagtgtactgcaagctggagagctgccccagccggggccagggcaagcccagctag

SEQ ID NO: 171556 - DNA, 960 bp, Artificial Sequence; identical to SEQ ID NO: 171555
  Description of Artificial Sequence: Synthetic coding sequence

SEQ ID NO: 171557 - DNA, 204 bp, Artificial Sequence
  Description of Artificial Sequence: Synthetic coding sequence
atggacccccagaaccagcacggcagcggcagcagcctggtggtgatccagcagcccagcctggacagccggcagaggctggactatgagcgggagatccagcccacagccatcctgagcctggaccagatcaaggccatccggggcagcaatgagtacacagagggccccagcgtggtgaagaggcctgcccccaggacatag

SEQ ID NO: 171558 - DNA, 630 bp, Artificial Sequence
  Description of Artificial Sequence: Synthetic coding sequence
atggacccccagaaccagcacggcagcggcagcagcctggtggtgatccagcagcccagcctggacagccggcagaggctggactatgagcgggagatccagcccacagccatcctgagcctggaccagatcaaggccatccggggcagcaatgagtacacagagggccccagcgtggtgaagaggcctgcccccaggacagccccccggcaggagaagcatgagaggacccatgagatcatccccatcaacgtgaacaacaactatgagcaccgccacaccagccacctgggccatgctgtgctgcccagcaatgcccggggccccatcctgagccgcagcaccagcactggatctgctgccagcagcggcagcaacagcagcgccagcagcgagcagggcctgctgggccgcagcccccccaccaggcctgtgcccggccacaggtctgagcgggccatccgcacccagcccaagcagctgattgtggatgacctgaagggcagcctgaaggaggacctgacccagcacaagttcatctgtgagcagtgtgggaagtgcaagtgtggagaatgtacagcccccaggaccctgcccagctgcctggcctgcaaccggcagtgcctgtag

SEQ ID NO: 171559 - DNA, 108 bp, Artificial Sequence
  Description of Artificial Sequence: Synthetic coding sequence
atggacccccagaaccagcacggcagcggcagcagcctggtggtgatccagcagcccagcctggacagccggcagaggctggactatgagcgggagatccagccctag

SEQ ID NO: 171560 - DNA, 948 bp, Artificial Sequence
  Description of Artificial Sequence: Synthetic coding sequence
atggaggcccgggcccagagcggaaatggcagccagcccctgctgcagaccccaagagatggcggccggcagagaggagagccagaccccagagatgccctgacccagcaggtgcacgtgctgagcctggaccagatccgggccatccggaacaccaatgagtacacagagggccccaccgtggtgcccaggcctggcctgaagccagccccccggcccagcacccagcacaagcatgagcggctgcacggcctgcctgagcaccggcagcccccccggctgcagcacagccaggtgcacagcagcgcccgggcccccctgagccgcagcatcagcacagtgagcagcggcagccgcagcagcaccaggaccagcaccagcagcagcagcagcgagcagaggctgctgggcagcagcttcagcagcggccctgtggctgatggcatcatccgggtgcagcccaagtctgagctgaagccaggagagctgaagcccctgagcaaagaagacctgggcctgcacgcctaccgctgtgaggactgtgggaagtgcaagtgcaaggagtgcacctacccccggcccctgcccagcgactggatctgtgacaagcagtgcctgtgcagcgcccagaatgtgattgattatggcacctgtgtgtgctgcgtgaagggcctcttctaccactgcagcaatgatgatgaggacaactgtgccgacaacccctgcagctgcagccagagccactgctgcacccgctggagcgccatgggcgtgatgagcctcttcctgccctgcctgtggtgctacctgcctgccaagggctgcctgaagctgtgccagggctgctatgacagagtgaacagacctggctgccgctgcaagaacagcaacacagtgtgctgcaaggtgcccaccgtgcccccaagaaactttgagaagcccacctag

SEQ ID NO: 171561 - DNA, 948 bp, Artificial Sequence; identical to SEQ ID NO: 171560
  Description of Artificial Sequence: Synthetic coding sequence

SEQ ID NO: 171562 - DNA, 948 bp, Artificial Sequence; identical to SEQ ID NO: 171560
  Description of Artificial Sequence: Synthetic coding sequence

SEQ ID NO: 171563 - DNA, 1062 bp, Artificial Sequence
  Description of Artificial Sequence: Synthetic coding sequence
atggaggcccgggcccagagcggaaatggcagccagcccctgctgcagaccccaagagatggcggccggcagagaggagagccagaccccagagatgccctgacccagcaggtgcacgtgctgagcctggaccagatccgggccatccggaacaccaatgagtacacagagggccccaccgtggtgcccaggcctggcctgaagccagccccccggcccagcacccagcacaagcatgagcggctgcacggcctgcctgagcaccggcagcccccccggctgcagcacagccaggtgcacagcagcgcccgggcccccctgagccgcagcatcagcacagtgagcagcggcagccgcagcagcaccaggaccagcaccagcagcagcagcagcgagcagaggctgctgggcagcagcttcagcagcggccctgtggctgatggcatcatccgggtgcagcccaagtctgagctgaagccaggagagctgaagcccctgagcaaagaagacctgggcctgcacgcctaccgctgtgaggactgtgggaagtgcaagtgcaaggagtgcacctacccccggcccctgcccagcgactggatctgtgacaagcagtgcctgtgcagcgcccagaatgtgattgattatggcacctgtgtgtgctgcgtgaagggcctcttctaccactgcagcaatgatgatgaggacaactgtgccgacaacccctgcagctgcagccagagccactgctgcacccgctggagcgccatgggcgtgatgagcctcttcctgccctgcctgtggtgctacctgcctgccaagggctgcctgaagctgtgccagggctgctatgacagagtgaacagacctggctgccgctgcaagaacagcaacacagtgtgctgcaaggtgcccaccgtgccccccaggaccctgaagaaccagcacagcatcatcaaccaggagtactacagcaatgaagacttcttcttcctgttcctgatccacatctgcaaccagctgaacagctacaacctgggcaccgtgaacaggaaggtgggctag

SEQ ID NO: 171564 - DNA, 867 bp, Artificial Sequence
  Description of Artificial Sequence: Synthetic coding sequence
atggatgctgctgtgacagatgacttccagcagatcctgcccatcgagcagctgcggagcacccacgccagcaatgactatgtggagcggcccccagccccctgcaagcaggccctgagcagccccagcctgattgtgcagacccacaagagtgactggagcctggccaccatgcccaccagcctgcccaggagcctgagccagtgccaccagctgcagcccctgccccagcacctgagccagagcagcatcgccagctccatgagccacagcaccacagccagtgaccagaggctgctggccagcatcacccccagccccagcggccagagcatcatccgcacccagcctggagctggggtgcaccccaaggcagatggagccctgaagggggaggccgagcagagcgctggccaccccagcgagcacctgttcatctgtgaagaatgtggccgctgcaagtgtgtgccctgcacagctgcccggcccctgcccagctgctggctgtgcaaccagcgctgcctgtgcagcgctgagagcctgctggactatggcacctgcctgtgctgcgtgaagggcctcttctaccactgcagcacagatgatgaggacaactgtgctgatgagccctgcagctgtggccccagcagctgctttgtgcgctgggccgccatgagcctcatcagcctcttcctgccctgcctgtgctgctacctgcccacccggggctgcctgcacctgtgccagcagggctatgacagcctgcggcggcccggctgccgctgcaagaggcacaccaacacagtgtgcaggaagatcagcagcggcagcgcccccttccccaaggcccaggagaagtctgtgtag

SEQ ID NO: 171565 - DNA, 378 bp, Artificial Sequence
  Description of Artificial Sequence: Synthetic coding sequence
atggatgctgctgtgacagatgacttccagcagatcctgcccatcgagcagctgcggagcacccacgccagcaatgactatgtggagcggcccccagccccctgcaagcaggccctgagcagccccagcctgattgtgcagacccacaagagtgactggagcctggccaccatgcccaccagcctgcccaggagcctgagccagtgccaccagctgcagcccctgccccagcacctgagccagagcagcatcgccagctccatgagccacagcaccacagccagcagcaccacagcccccctgatgatgaagaccaccgtgctgatgagccctgccctggtgggcctggtgctggccctgtctgctggccagccctag

SEQ ID NO: 171566 - DNA, 969 bp, Artificial Sequence
  Description of Artificial Sequence: Synthetic coding sequence
atgctgagccccctgcccaccggccccctggaggcctgcttctctgtgcagagcaggaccagcagccccatggagccccccatcccccagagcgcccccctgacccccaacagcgtgatggtgcagcccctgctggacagcaggatgagccacagccggctgcagcaccccctgaccatcctgcccatcgaccaggtgaagaccagccacgtggagaatgactacatcgacaaccccagcctggccctgaccaccggccccaagaggacccggggcggggcccctgagctggcccccaccccagcccgctgtgaccaggatgtgacccaccactggatctccttcagcggccggcccagctctgtgagcagcagcagcagcaccagcagtgaccagaggctgctggaccacatggcccctcctcctgtggccgaccaggccagccccagggctgtgcgcatccagcccaaggtggtgcactgccagcccctggacctgaagggccctgctgtgcccccagagctggacaagcacttcctgctgtgtgaggcctgtgggaagtgcaagtgcaaggaatgtgccagccccaggaccctgcccagctgctgggtgtgcaaccaggagtgcctgtgcagcgcccagaccctggtgaactacggcacctgcatgtgcctggtgcagggcatcttctaccactgcaccaatgaagatgatgagggcagctgtgccgaccacccctgcagctgcagccgcagcaactgctgtgcccgctggagcttcatgggcgccctgtctgtggtgctgccctgcctgctgtgctacctgcctgccaccggctgtgtgaagctggcccagaggggctatgaccggctgcggcggcccggctgccgctgcaagcacaccaacagcgtcatctgcaaggccgccagcggagatgccaagaccagcaggccagacaagcccttctag

SEQ ID NO: 171567 - DNA, 321 bp, Artificial Sequence
  Description of Artificial Sequence: Synthetic coding sequence
atggagccccccatcccccagagcgcccccctgacccccaacagcgtgatggtgcagcccctgctggacagcaggatgagccacagccggctgcagcaccccctgaccatcctgcccatcgaccaggtgaagaccagccacgtggagaatgactacatcgacaaccccagcctggccctgaccaccggccccaagaggacccggggcggggcccctgagctggcccccaccccagcccgctgtgaccaggatgtgacccaccactggatctccttcagcggccggccctgcagcgccacctgcctgcccccagctgcctag

SEQ ID NO: 171568 - DNA, 900 bp, Artificial Sequence
  Description of Artificial Sequence: Synthetic coding sequence
atggagccccccatcccccagagcgcccccctgacccccaacagcgtgatggtgcagcccctgctggacagcaggatgagccacagccggctgcagcaccccctgaccatcctgcccatcgaccaggtgaagaccagccacgtggagaatgactacatcgacaaccccagcctggccctgaccaccggccccaagaggacccggggcggggcccctgagctggcccccaccccagcccgctgtgaccaggatgtgacccaccactggatctccttcagcggccggcccagctctgtgagcagcagcagcagcaccagcagtgaccagaggctgctggaccacatggcccctcctcctgtggccgaccaggccagccccagggctgtgcgcatccagcccaaggtggtgcactgccagcccctggacctgaagggccctgctgtgcccccagagctggacaagcacttcctgctgtgtgaggcctgtgggaagtgcaagtgcaaggaatgtgccagccccaggaccctgcccagctgctgggtgtgcaaccaggagtgcctgtgcagcgcccagaccctggtgaactacggcacctgcatgtgcctggtgcagggcatcttctaccactgcaccaatgaagatgatgagggcagctgtgccgaccacccctgcagctgcagccgcagcaactgctgtgcccgctggagcttcatgggcgccctgtctgtggtgctgccctgcctgctgtgctacctgcctgccaccggctgtgtgaagctggcccagaggggctatgaccggctgcggcggcccggctgccgctgcaagcacaccaacagcgtcatctgcaaggccgccagcggagatgccaagaccagcaggccagacaagcccttctag

SEQ ID NO: 171569 - DNA, 153 bp, Artificial Sequence
  Description of Artificial Sequence: Synthetic coding sequence
atggagccccccatcccccagagcgcccccctgacccccaacagcgtgatggtgcagcccctgctggacagcaggatgagccacagccggctgcagcaccccctgaccatcctgcccatcgaccaggtgaagaccagccacgtggagaactag

SEQ ID NO: 171570 - DNA, 1335 bp, Artificial Sequence
  Description of Artificial Sequence: Synthetic coding sequence
atgtctgaggagacagccaccagtgacaatgacaacagctatgcccgggtgcgggctgtggtgatgaccagagatgacagcagcggcggctggctgcccctgggcggcagcggcctgagctctgtgacagtgttcaaggtgccccaccaggaggagaatggctgtgccgacttcttcatccggggggagcggctgcgggacaagatggtggtgctggagtgcatgctgaagaaggacctgatctacaacaaggtgacccccaccttccaccactggaagattgatgacaagaagtttggcctgaccttccagagccctgcagatgcccgggcctttgaccggggcatcagaagagccatcgaggacatcagccagggctgcccagagagcaagaatgaggccgagggcgcagatgacctgcaggccaatgaggaggacagcagcagcagcctggtgaaggaccacctgttccagcaggagaccgtggtgaccagcgagccctaccgcagcagcaacatccggcccagcccctttgaggacctgaatgcccggcgggtgtacatgcagagccaggccaaccagatcaccttcggccagcccggcctggacatccagagccgctccatggagtatgtgcagaggcagatcagcaaagaatgtggcagcctgaagagccagaacagagtgcccctgaagagcatccgccacgtgtccttccaggatgaagatgaaattgtgcgcatcaacccccgggacatcctgatccgccgctatgctgactaccgccacccagacatgtggaagaatgacctggagagagatgatgctgacagcagcatccagttcagcaagccagacagcaagaagagtgactacctgtacagctgtggagatgagaccaagctgagcagccccaaggacagcgtggtgttcaagacccagcccagcagcctgaagatcaagaagagcaagaggaggaaggaggatggagagaggagccgctgtgtgtactgccaggagcgcttcaaccacgaggagaatgtgcggggcaagtgccaggatgccccagaccccatcaagcgctgcatctaccaggtgtcctgcatgctgtgtgccgagagcatgctgtaccactgcatgtctgattctgagggggacttcagtgacccctgcagctgtgacaccagtgatgacaagttctgcctgcgctggctggccctggtggccctgtccttcatcgtgccctgcatgtgctgctacgtgcccctgaggatgtgccaccgctgtggggaggcctgtggctgctgcggcggcaagcacaaggctgctggatag

SEQ ID NO: 171571 - DNA, 1257 bp, Artificial Sequence
  Description of Artificial Sequence: Synthetic coding sequence
atgacagaggagacccacccagatgatgacagctacatcgtgcgggtgaaggctgtggtgatgaccagagatgacagcagcggcggctggttcccccaggagggcggcggcatcagccgggtgggcgtgtgcaaggtgatgcaccctgagggcaatggccgcagcggcttcctgatccacggggagcggcagaaggacaagctggtggtgctggagtgctacgtgaggaaggacctggtgtacaccaaggccaaccccaccttccaccactggaaggtggacaacaggaagtttggcctgaccttccagagccctgcagatgcccgggcctttgaccggggcgtgaggaaggccatcgaggacctgattgagggcagcaccaccagcagcagcaccatccacaatgaagctgagctgggagatgatgatgtgttcaccacagccacagacagcagcagcaacagcagccagaagcgggagcagcccaccaggaccatcagcagccccaccagctgtgagcaccggcgcatctacaccctgggccacctgcatgacagctaccccacagaccactaccacctggaccagcccatgccccggccctaccggcaggtgtccttcccagatgatgatgaggagatcgtgcgcatcaacccccgggagaagatctggatgacaggctatgaggactacagacatgcccctgtgcggggcaagtacccagaccccagtgaagatgctgacagcagctatgtgcgctttgccaagggggaggtgcccaagcatgactacaactacccctacgtggacagcagtgactttggcctgggggaggaccccaagggccggggcggcagcgtcatcaagacccagcccagccggggcaagagcagaagaaggaaggaggatggagagaggagccgctgtgtgtactgccgggacatgttcaaccacgaggagaacagaagaggccactgccaggatgccccagacagcgtgaggacctgcatccggcgggtgtcctgcatgtggtgtgccgacagcatgctgtaccactgcatgtctgaccctgagggggactacacagacccctgcagctgtgacaccagtgatgagaagttctgcctgcgctggatggccctgattgccctgtccttcctggccccctgcatgtgctgctacctgcccctgcgggcctgctaccactgcggcgtgatgtgccgctgctgcggcggcaagcacaaggctgctgcctag

SEQ ID NO: 171572 - DNA, 351 bp, Artificial Sequence
  Description of Artificial Sequence: Synthetic coding sequence
atgacagaggagacccacccagatgatgacagctacatcgtgcgggtgaaggctgtggtgatgaccagagatgacagcagcggcggctggttcccccaggagggcggcggcatcagccgggtgggcgtgtgcaaggtgatgcaccctgagggcaatggccgcagcggcttcctgatccacggggagcggcagaaggacaagctggtggtgctggagtgctacgtgaggaaggacctggtgtacaccaaggccaaccccaccttccaccactggaaggtggacaacaggaagtttggcctgaccttccagagccctgcagatgcccgggcctttgaccggggcgtgaggtag

SEQ ID NO: 171573 - DNA, 1248 bp, Artificial Sequence
  Description of Artificial Sequence: Synthetic coding sequence
atggccagccctggcagtgacagctacatcgtgcgggtgaaggctgtggtgatgaccagagatgacagcagcggcggctggttcccccaggagggcggcggcatcagccgggtgggcgtgtgcaaggtgatgcaccctgagggcaatggccgcagcggcttcctgattcatggagagcggcagaaggacaagctggtggtgctggagtgctacgtgaggaaggacctggtgtacaccaaggccaaccccaccttccaccactggaaggtggacaacaggaagtttggcctgaccttccagagccctgcagatgcccgggcctttgacagaggagtgaggaaggccattgaagatctcatcgagggcagcaccaccagcagcagcaccatccacaatgaggccgagctgggagatgatgatgtgttcaccacagccacagacagcagcagcaacagcagccagaagcgggagcagcccaccaggaccatcagcagccccaccagctgtgagcaccggcgcatctacaccctgggccacctgcatgacagctaccccacagaccactaccacctggaccagcccatgccccggccctaccggcaggtgtccttcccagatgatgatgaggagatcgtgcgcatcaacccccgggagaagatctggatgacaggctatgaggactacagacatgcccctgtgcggggcaagtacccagaccccagtgaagatgctgacagcagctatgtgcgctttgccaagggggaggtgcccaagcatgactacaactacccctacgtggacagcagtgactttggcctgggggaggaccccaagggccggggcggcagcgtcatcaagacccagcccagccggggcaagagcagaagaagaaaagaagatggagagaggagccgctgtgtgtactgccgggacatgttcaaccatgaagaaaatagaagaggccactgccaggatgccccagattctgtgaggacctgcatcagaagagtgtcctgcatgtggtgtgccgacagcatgctgtaccactgcatgtctgaccctgagggggactacacagacccctgcagctgtgacaccagtgatgagaagttctgcctgcgctggatggccctgattgccctgtccttcctggccccctgcatgtgctgctacctgcccctgcgggcctgctaccactgcggcgtgatgtgccgctgctgcggcggcaagcacaaggccgccgcctag

SEQ ID NO: 171574 - DNA, 1233 bp, Artificial Sequence
  Description of Artificial Sequence: Synthetic coding sequence
atggtgcgggtgcgggctgtggtgatggccagagatgacagcagcggcggctggctgcctgtgggcggcggcggcctgagccaggtgtctgtgtgccgggtgcggggggcccggcctgagggcggggcccggcagggccactacgtgattcatggagagcggctgcgggaccagaagaccaccctggagtgcaccctgaagccaggcctggtgtacaacaaggtgaaccccatcttccaccactggagcctgggggactgcaagtttggcctgaccttccagagccctgctgaggctgatgagttccagaagagcctgctggccgccctggccgccctgggccggggcagcctgacccccagcagcagcagcagcagcagcagccccagccaggacacagctgagaccccctgccccctgaccagccacgtggacagcgacagcagcagcagccacagccggcaggagaccccacccagcgctgctgctgcccccatcatcaccatggagagcgccagcggcttcggccccaccaccccaccccagaggcggcgcagcagcgcccagagctacccacccctgctgcccttcaccggcatccctgagcccagcgagcccctggccggggccggcggcctgggctggggcggccggggctatgaggactaccgccgcagcggccccccagcccccctggccctgagcacctgtgtggtgcgctttgccaagacaggagccctgcggggggccgccctgggccccccagctgccctgcctgcccccctgacagaagctgcccccccagcccccccagcccggcccccacctggccctggccccagcagcgccccagccaaggccagccctgaggccgaggaggccgcccgctgtgtgcactgccgggccctcttcagaagaagagcagatggccggggcggccgctgtgccgaggccccagaccccggccgcctgctggtgcggcggctgagctgcctgtggtgtgccgagagcctgctgtaccactgcctgagtgatgctgagggggacttcagtgacccctgtgcctgtgagcccggccaccccaggcctgctgcccgctgggccgccctggccgccctgagcctggccgtgccctgcctgtgctgctacgcccccctgcgggcctgccactgggtggccgcccgctgtggctgtgccggctgcggcggcagacatgaggaggccgccaggtag

SEQ ID NO: 171575 - DNA, 459 bp, Artificial Sequence
  Description of Artificial Sequence: Synthetic coding sequence
atggtgcgggtgcgggctgtggtgatggccagagatgacagcagcggcggctggctgcctgtgggcggcggcggcctgagccaggtgtctgtgtgccgggtgcggggggcccggcctgagggcggggcccggcagggccactacgtgattcatggagagcggctgcgggaccagaagaccaccctggagtgcaccctgaagccaggcctggtgtacaacaaggtgaaccccatcttccaccactggagcctgggggactgcaagtttggcctgaccttccagagccctgctgaggctgatgagttccagaagagcctgctggccgccctggccgccctgggccggggcagcctgacccccagcagcagcagcagcagcagcagccccagccaggacacagctgagaccccctgccccctgaccctgagccagtacttccgccacatgctgtgcccctag

SEQ ID NO: 171576 - DNA, 1725 bp, Artificial Sequence
  Description of Artificial Sequence: Synthetic coding sequence
atgtggaccttcctgggcatcgccaccttcacctacttctacaagaagtttggagacttcatcaccctggccaaccgggaggtgctgctgtgtgtgctggtgttcctgagcctgggcctggtgctgagctaccgctgccgccacagaaatggaggcctgctgggccggcagcagagcggcagccagtttgccctcttcagtgacatcctgagcggcctgcccttcatcggcttcttctgggccaagagccccccagagagcgagaacaaggagcagctggaggccaggagaagaaggaagggcaccaacatcagcgagaccagcctcatcggcacagctgcctgcaccagcaccagcagccagaatgaccctgaggtgatcatcgtgggcgccggcgtgctgggcagcgccctggccgctgtgctgagcagagatggcaggaaggtgaccgtcatcgagcgggacctgaaggagccagaccgcatcgtgggggagttcctgcagcccggcggctaccacgtgctgaaggacctgggcctgggggacacagtggagggcctggatgcccaggtggtgaatggctacatgattcatgaccaggagagcaagtctgaggtgcagatcccctaccccctgtctgagaacaaccaggtgcagagcggccgggccttccaccacggccgcttcatcatgagcctgaggaaggccgccatggccgagcccaatgccaagttcatcgagggcgtggtgctgcagctgctggaggaggatgatgtggtgatgggcgtgcagtacaaggacaaggagaccggggacatcaaggagctgcacgcccccctgactgtggtggctgatggcctcttcagcaagttcaggaagagcctggtgagcaacaaggtgtctgtgagcagccactttgtgggcttcctgatgaagaatgccccccagttcaaggccaaccacgccgagctgatcctggccaaccccagccctgtgctgatctaccagatcagcagcagcgagaccagggtgctggtggacatccggggggagatgcccaggaacctgcgggagtacatggtggagaagatctacccccagatcccagaccacctgaaggagcccttcctggaggccacagacaacagccacctgcgctccatgcctgccagcttcctgccccccagctctgtgaagaagaggggcgtgctgctgctgggagatgcctacaacatgaggcaccccctgactggaggcggcatgacagtggccttcaaggacatcaagctgtggaggaagctgctgaagggcatcccagacctgtatgatgatgctgccatctttgaggccaagaagagcttctactgggccaggaagaccagccacagctttgtggtgaacatcctggcccaggccctgtatgagctgttcagcgccacagatgacagcctgcaccagctgaggaaggcctgcttcctgtacttcaagctgggcggggagtgtgtggccggccctgtgggcctgctgtctgtgctgagccccaaccccctggtgctgattggccacttctttgctgtggccatctatgctgtgtacttctgcttcaagtctgagccctggatcaccaagccccgggccctgctgagcagcggggctgtgctgtacaaggcctgcagcgtcatcttccccctcatctacagcgagatgaagtacatggtgcactag

SEQ ID NO: 171577 - DNA, 1440 bp, Artificial Sequence
  Description of Artificial Sequence: Synthetic coding sequence
atgctgcggaggaagggcaccaacatcagcgagaccagcctgattggaacagctgcctgcaccagcaccagcagccagaatgaccctgaggtgatcatcgtgggcgctggggtgctgggcagcgccctggccgctgtgctgagcagagatggcaggaaggtgacagtgattgagcgggacctgaaggagccagacagaattgtgggggagttcctgcagcccggcggctaccacgtgctgaaggacctgggcctgggggacacagtggagggcctggatgcccaggtggtgaatggctacatgattcatgaccaggagagcaagtctgaggtgcagatcccctaccccctgtctgagaacaaccaggtgcagagcggccgggccttccaccacggccgcttcatcatgagcctgaggaaggccgccatggccgagcccaatgccaagttcattgaaggagtggtgctgcagctgctggaggaggatgatgtggtgatgggcgtgcagtacaaggacaaggagactggagacatcaaggagctgcacgcccccctgactgtggtggctgatggcctcttcagcaagttcaggaagagcctggtgagcaacaaggtgtctgtgagcagccactttgtgggcttcctgatgaagaatgccccccagttcaaggccaaccacgccgagctgatcctggccaaccccagccctgtgctgatctaccagatcagcagcagcgagaccagggtgctggtggacatccggggggagatgcccaggaacctgcgggagtacatggtggagaagatctacccccagatcccagaccacctgaaggagcccttcctggaggccacagacaacagccacctgcgctccatgcctgccagcttcctgccccccagctctgtgaagaagaggggcgtgctgctgctgggagatgcctacaacatgaggcaccccctgaccggcggcggcatgacagtggccttcaaggacatcaagctgtggaggaagctgctgaagggcatcccagacctgtatgatgatgctgccatctttgaggccaagaagagcttctactgggccaggaagaccagccacagctttgtggtgaacatcctggcccaggccctgtatgagctgttcagcgccacagatgacagcctgcaccagctgaggaaggcctgcttcctgtacttcaagctgggcggagaatgtgtggccggccctgtgggcctgctgtctgtgctgagccccaaccccctggtgctgattggccacttctttgctgtggccatctatgctgtgtacttctgcttcaagtctgagccctggatcaccaagccccgggccctgctgagcagtggagctgtgctgtacaaggcctgcagcgtcatcttccccctcatctacagcgagatgaagtacatggtgcactag

SEQ ID NO: 171578 - DNA, 1140 bp, Artificial Sequence
  Description of Artificial Sequence: Synthetic coding sequence
atgattcatgaccaggagagcaagtctgaggtgcagatcccctaccccctgtctgagaacaaccaggtgcagagcggccgggccttccaccacggccgcttcatcatgagcctgaggaaggccgccatggccgagcccaatgccaagttcattgaaggagtggtgctgcagctgctggaggaggatgatgtggtgatgggcgtgcagtacaaggacaaggagactggagacatcaaggagctgcacgcccccctgactgtggtggctgatggcctcttcagcaagttcaggaagagcctggtgagcaacaaggtgtctgtgagcagccactttgtgggcttcctgatgaagaatgccccccagttcaaggccaaccacgccgagctgatcctggccaaccccagccctgtgctgatctaccagatcagcagcagcgagaccagggtgctggtggacatccggggggagatgcccaggaacctgcgggagtacatggtggagaagatctacccccagatcccagaccacctgaaggagcccttcctggaggccacagacaacagccacctgcgctccatgcctgccagcttcctgccccccagctctgtgaagaagaggggcgtgctgctgctgggagatgcctacaacatgaggcaccccctgaccggcggcggcatgacagtggccttcaaggacatcaagctgtggaggaagctgctgaagggcatcccagacctgtatgatgatgctgccatctttgaggccaagaagagcttctactgggccaggaagaccagccacagctttgtggtgaacatcctggcccaggccctgtatgagctgttcagcgccacagatgacagcctgcaccagctgaggaaggcctgcttcctgtacttcaagctgggcggagaatgtgtggccggccctgtgggcctgctgtctgtgctgagccccaaccccctggtgctgattggccacttctttgctgtggccatctatgctgtgtacttctgcttcaagtctgagccctggatcaccaagccccgggccctgctgagcagtggagctgtgctgtacaaggcctgcagcgtcatcttccccctcatctacagcgagatgaagtacatggtgcactag

SEQ ID NO: 171579 - DNA, 822 bp, Artificial Sequence
  Description of Artificial Sequence: Synthetic coding sequence
atgaagaagacccagacctggatcctgacctgcatctacctgcagctgctgctcttcaaccccctggtgaagacagagggcatctgcaggaacagagtgaccaacaacgtgaaggatgtgaccaagctggtggccaacctgcccaaggactacatgatcaccctgaagtatgtgcccggcatggatgtgctgcccagccactgctggatcagcgagatggtggtgcagctgagtgacagcctgacagacctgctggacaagttcagcaacatcagcgagggcctgagcaactacagcatcatcgacaagctggtgaacatcgtggatgacctggtggagtgtgtgaaggagaacagcagcaaggacctgaagaagagcttcaagagccctgagcccaggctcttcaccccagaggagttcttccgcatcttcaacagaagcattgatgccttcaaggactttgtggtggccagcgagaccagtgactgtgtggtgagcagcaccctgagccctgagaaggacagccgggtgtctgtgaccaagcccttcatgctgccccctgtggccgccagcagcctgagaaatgacagcagcagcagcaacaggaaggccaagaaccccccaggggacagcagcctgcactgggccgccatggccctgcctgccctcttcagcctcatcatcggctttgccttcggggccctgtactggaagaagaggcagcccagcctgaccagggctgtggagaacatccagatcaatgaggaggacaatgagatctccatgctgcaggagaaggagcgggagttccaggaggtgtag

SEQ ID NO: 171580 - DNA, 2100 bp, Artificial Sequence
  Description of Artificial Sequence: Synthetic coding sequence
atgaggctgcggcggctgggccagggcggccgctgctaccggggcctgtggcccctgcggcacacccggccctggagcagccctggagaatatgagtgggagtatgatgaggaggaggagaagaaccagctggagattgaaaggctggaggagcagctgagcatcaacgtgtatgactacaactgccacgtggacctgatccggctgctgcggctggagggggagctgaccaaggtgaggatggcccggcagaagatgtctgagatcttccccctgacagaggagctgtggctggagtggctgcatgatgagatctccatggcccaggacggcctggaccgggagcacgtgtatgacctgtttgagaaggctgtgaaggactacatctgccccaacatctggctggagtatggccagtacagcgtgggcggcatcggccagaagggcggcctggagaaggtgcgctctgtgtttgagcgggccctgagctctgtgggcctgcacatgaccaagggcctggccctgtgggaggcctaccgggagtttgagagcgccatcgtggaggccgcccggctggagaaggtgcacagcctcttccggcggcagctggccatccccctgtatgacatggaggccacctttgctgaatatgaggagtggagcgaggaccccatccctgagagcgtcatccagaactacaacaaggccctgcagcagctggagaagtacaagccctatgaggaggccctgctgcaggccgaggccccccggctggccgagtaccaggcctacatcgactttgagatgaagattggagaccctgcccgcatccagctgatctttgagcgggccctggtggagaactgcctggtgcctgacctgtggatccgctacagccagtacctggaccggcagctgaaggtgaaggacctggtgctgtctgtgcacaacagagccatccggaactgcccctggacagtggccctgtggagccgctacctgctggccatggagagacatggagtggaccaccaggtgatctctgtgacctttgagaaggccctgaatgccggcttcatccaggccacagattatgtggagatctggcaggcctacctggactacctgcggcggcgggtggacttcaagcaggacagcagcaaggagctggaggagctgcgggccgccttcacccgggccctggagtacctgaagcaggaggtggaggagcgcttcaatgaaagtggggaccccagctgtgtgatcatgcagaactgggccagaattgaggcccggctgtgcaacaacatgcagaaggcccgggagctgtgggacagcatcatgaccagaggaaatgccaagtatgccaacatgtggctggagtactacaacctggagcgggcccatggagacacccagcactgcaggaaggccctgcacagagctgtgcagtgcaccagtgactacccagagcacgtgtgtgaggtgctgctgaccatggagaggacagagggcagcctggaggactgggacattgctgtgcagaagacagagacccggctggcccgggtgaatgagcagaggatgaaggctgctgagaaggaggccgccctggtgcagcaggaggaggagaaggccgagcagaggaagagggcccgggcagagaagaaggccctgaagaagaagaagaagatccggggccctgagaagagaggagcagatgaagatgatgagaaggagtggggagatgatgaggaggccttccagacccagaagggccgggagcagcacccctgctcctggaggaacaccaagtgccgcagcagcagccgggcccgctgggagatgtgctgcagaagatgtggggccccctttgaagctgagggggagggcagcctgcctgaggagggccacgcccagggcgccgcccggcagcagcagggccagcaccaccggctgtgccagcagcctgccctgcagcacgccggggccggccacgaggcccaggccaccctgcggggcctgtggggcggcggccctgaccccacccacctgcagcagccctggggcttcccccggctgctgctgcggggcgtgtag

SEQ ID NO: 171581 - DNA, 2784 bp, Artificial Sequence
  Description of Artificial Sequence: Synthetic coding sequence
atggccacagctgctgagaccagcgccagcgagcctgaggccgagagcaaggccggccccaaggcagatggagaggaggatgaggtgaaggccgcccggaccaggaggaaggtgctgagcagagctgtggccgccgccacctacaagaccatgggccctgcctgggaccagcaggaggagggcgtgtctgagagtgatggagatgaatatgccatggccagcagcgctgagagcagccctggagaatatgagtgggagtatgatgaggaggaggagaagaaccagctggagattgaaaggctggaggagcagctgagcatcaacgtgtatgactacaactgccacgtggacctgatccggctgctgcggctggagggggagctgaccaaggtgaggatggcccggcagaagatgtctgagatcttccccctgacagaggagctgtggctggagtggctgcatgatgagatctccatggcccaggacggcctggaccgggagcacgtgtatgacctgtttgagaaggctgtgaaggactacatctgccccaacatctggctggagtatggccagtacagcgtgggcggcatcggccagaagggcggcctggagaaggtgcgctctgtgtttgagcgggccctgagctctgtgggcctgcacatgaccaagggcctggccctgtgggaggcctaccgggagtttgagagcgccatcgtggaggccgcccggctggagaaggtgcacagcctcttccggcggcagctggccatccccctgtatgacatggaggccacctttgctgaatatgaggagtggagcgaggaccccatccctgagagcgtcatccagaactacaacaaggccctgcagcagctggagaagtacaagccctatgaggaggccctgctgcaggccgaggccccccggctggccgagtaccaggcctacatcgactttgagatgaagattggagaccctgcccgcatccagctgatctttgagcgggccctggtggagaactgcctggtgcctgacctgtggatccgctacagccagtacctggaccggcagctgaaggtgaaggacctggtgctgtctgtgcacaacagagccatccggaactgcccctggacagtggccctgtggagccgctacctgctggccatggagagacatggagtggaccaccaggtgatcagtgacagcagcaaggagctggaggagctgcgggccgccttcacccgggccctggagtacctgaagcaggaggtggaggagcgcttcaatgaaagtggggaccccagctgtgtgatcatgcagaactgggccagaattgaggcccggctgtgcaacaacatgcagaaggcccgggagctgtgggacagcatcatgaccagaggaaatgccaagtatgccaacatgtggctggagtactacaacctggagcgggcccatggagacacccagcactgcaggaaggccctgcacagagctgtgcagtgcaccagtgactacccagagcacgtgtgtgaggtgctgctgaccatggagaggacagagggcagcctggaggactgggacattgctgtgcagaagacagagacccggctggcccgggtgaatgagcagaggatgaaggctgctgagaaggaggccgccctggtgcagcaggaggaggagaaggccgagcagaggaagagggcccgggcagagaagaaggccctgaagaagaagaagaagatccggggccctgagaagagaggagcagatgaagatgatgagaaggagtggggagatgatgaggaggagcagcccagcaagagaagaagagtggagaacagcatcccagctgctggggagacccagaatgtggaggtggccgccggccctgctggaaaatgtgccgctgtggatgtggagccccccagcaagcagaaggagaaggccgccagcctgaagagggacatgcccaaggtgctgcatgacagcagcaaggacagcatcaccgtgtttgtgagcaacctgccctacagcatgcaggagccagacaccaagctgcggcccctgtttgaggcctgtggggaggtggtgcagatccggcccatcttcagcaacagaggagacttccggggctactgctacgtggagttcaaggaggagaagagcgccctgcaggccctggagatggacaggaagtctgtggagggccggcccatgtttgtgagcccctgtgtggacaagagcaagaacccagacttcaaggtgttccgctacagcaccagcctggagaagcacaagctgttcatcagcggcctgcccttcagctgcaccaaggaggagctggaggagatctgcaaggcccacggcaccgtgaaggacctgcggctggtgaccaacagagctgggaagcccaagggcctggcctacgtggagtatgaaaatgaaagccaggccagccaggccgtgatgaagatggatggcatgaccatcaaggagaacatcatcaaggtggccatcagcaaccccccccagaggaaggtgcctgagaagccagagaccaggaaggcccctgggggccccatgctgctgccccagacctatggagcccggggcaagggccgcacccagctgagcctgctgccccgggccctgcagaggcccagcgctgctgccccccaggctgaaaatggacctgctgctgccccagctgtggccgccccagctgccacagaggcccccaagatgagcaatgctgactttgccaagctgttcctgaggaagtag

SEQ ID NO: 171582 - DNA, 1587 bp, Artificial Sequence
  Description of Artificial Sequence: Synthetic coding sequence
atggagagacatggagtggaccaccaggtgatcagtgacagcagcaaggagctggaggagctgcgggccgccttcacccgggccctggagtacctgaagcaggaggtggaggagcgcttcaatgaaagtggggaccccagctgtgtgatcatgcagaactgggccagaattgaggcccggctgtgcaacaacatgcagaaggcccgggagctgtgggacagcatcatgaccagaggaaatgccaagtatgccaacatgtggctggagtactacaacctggagcgggcccatggagacacccagcactgcaggaaggccctgcacagagctgtgcagtgcaccagtgactacccagagcacgtgtgtgaggtgctgctgaccatggagaggacagagggcagcctggaggactgggacattgctgtgcagaagacagagacccggctggcccgggtgaatgagcagaggatgaaggctgctgagaaggaggccgccctggtgcagcaggaggaggagaaggccgagcagaggaagagggcccgggcagagaagaaggccctgaagaagaagaagaagatccggggccctgagaagagaggagcagatgaagatgatgagaaggagtggggagatgatgaggaggagcagcccagcaagagaagaagagtggagaacagcatcccagctgctggggagacccagaatgtggaggtggccgccggccctgctggaaaatgtgccgctgtggatgtggagccccccagcaagcagaaggagaaggccgccagcctgaagagggacatgcccaaggtgctgcatgacagcagcaaggacagcatgcaggagccagacaccaagctgcggcccctgtttgaggcctgtggggaggtggtgcagatccggcccatcttcagcaacagaggagacttccggggctactgctacgtggagttcaaggaggagaagagcgccctgcaggccctggagatggacaggaagtctgtggagggccggcccatgtttgtgagcccctgtgtggacaagagcaagaacccagacttcaaggtgttccgctacagcaccagcctggagaagcacaagctgttcatcagcggcctgcccttcagctgcaccaaggaggagctggaggagatctgcaaggcccatggaacagtgaaggacctgcggctggtgaccaacagagctgggaagcccaagggcctggcctacgtggagtatgaaaatgaaagccaggccagccaggccgtgatgaagatggatggcatgaccatcaaggagaacatcatcaaggtggccatcagcaaccccccccagaggaaggtgcctgagaagccagagaccaggaaggcccctgggggccccatgctgctgccccagacctacggggcccggggcaaaggaagaacccagctgagcctgctgccccgggccctgcagaggccttctgctgctgccccccaggccgagaatggacctgctgctgccccagctgtggccgccccagctgccacagaggcccccaagatgagcaatgctgactttgccaagctgttcctgaggaagtag

SEQ ID NO: 171583 - DNA, 390 bp, Artificial Sequence
  Description of Artificial Sequence: Synthetic coding sequence
atggccacagctgctgagaccagcgccagcgagcctgaggccgagagcaaggccggccccaaggcagatggagaggaggatgaggtgaaggccgcccggaccaggaggaaggtgctgagcagagctgtggccgccgccacctacaagaccatgggccctgcctgggaccagcaggaggagggcgtgtctgagagtgatggagatgaatatgccatggccagcagcgctgagagcagccctggagaatatgagtgggagtatgatgaggaggaggagaagaaccagctggagattgaaaggctggaggagcaggtgggccctggggtgggcagcggccacctgcctgtgttccaggtgctgggcagcccctgccccggccccccaccctag

SEQ ID NO: 171584 - DNA, 330 bp, Artificial Sequence
  Description of Artificial Sequence: Synthetic coding sequence
atggccgccagcgctgcccggggagctgctgccctgcggcgcagcatcaaccagcctgtggcctttgtgcggcgcatcccctggacagctgccagcagccagctgaaggagcactttgcccagtttggccacgtgcggcgctgcatcctgccctttgacaaggagaccggcttccaccggggcctgggctgggtgcagttcagcagcgaggagggcctgagaaatgccctgcagcaggagaaccacatcattgatggagtgaaggtgcaggtgcacacccggcggcccaagctgccccagaccagtgatgatgagaagaaggacttctag

SEQ ID NO: 171585 - DNA, 894 bp, Artificial Sequence
  Description of Artificial Sequence: Synthetic coding sequence
atggccaagtggctgaacaagtacttcagcctgggcaacagcaagaccaagagccccccccagccccccaggccagactaccgggagcagaggcggcggggggagcggcccagccagcccccccaggccgtgccccaggccagcagcgctgccagcgccagctgtggccctgccacagccagctgcttcagcgccagcagcggcagcctgcctgatgacagcggcagcaccagtgacctgatccgggcctaccgggcccagaaggagcgggactttgaggacccctacaatggacctggcagcagcctgaggaagctgcgggccatgtgccgcctggactactgcggcggcagcggggagcctggaggagtgcagagggccttcagcgccagcagcgccagcggggctgctggctgctgctgtgccagcagcggggccggggctgctgccagcagcagcagcagcagcggcagcccccacctgtaccgcagcagcagcgagcggcggcctgccaccccagctgaggtgcgctacatcagccccaagcacaggctcatcaaggtggagagcgctgctgggggcggggccggggaccccctgggcggggcctgtgccggcggccgcacctggagccccacagcctgtggcggcaagaagctgctgaacaagtgtgccgccagcgctgctgaggagagcggggccggcaagaaggacaaggtgaccatcgcagatgactacagcgacccctttgatgccaagaatgacctgaagagcaaggccggcaagggggagagcgctggctacatggagccctatgaggcccagaggatcatgacaggcctgcaggaggcctggaggcacagccccagcggctgcttccctgtgggcccctag

SEQ ID NO: 171586 - DNA, 1530 bp, Artificial Sequence
  Description of Artificial Sequence: Synthetic coding sequence
atggccaagtggctgaacaagtacttcagcctgggcaacagcaagaccaagagccccccccagccccccaggccagactaccgggagcagaggcggcggggggagcggcccagccagcccccccaggccgtgccccaggccagcagcgctgccagcgccagctgtggccctgccacagccagctgcttcagcgccagcagcggcagcctgcctgatgacagcggcagcaccagtgacctgatccgggcctaccgggcccagaaggagcgggactttgaggacccctacaatggacctggcagcagcctgaggaagctgcgggccatgtgccgcctggactactgcggcggcagcggggagcctggaggagtgcagagggccttcagcgccagcagcgccagcggggctgctggctgctgctgtgccagcagcggggccggggctgctgccagcagcagcagcagcagcggcagcccccacctgtaccgcagcagcagcgagcggcggcctgccaccccagctgaggtgcgctacatcagccccaagcacaggctcatcaaggtggagagcgctgctgggggcggggccggggaccccctgggcggggcctgtgccggcggccgcacctggagccccacagcctgtggcggcaagaagctgctgaacaagtgtgccgccagcgctgctgaggagagcggggccggcaagaaggacaaggtgaccatcgcagatgactacagcgacccctttgatgccaagaatgacctgaagagcaaggccggcaagggggagagcgctggctacatggagccctatgaggcccagaggatcatgacagagttccagaggcaggagagcgtgcgcagccagcacaagggcatccagctgtatgacaccccctatgagcctgagggccagagcgtggacagcgacagcgagagcacagtgagcccccggctgcgggagagcaagctgccccaggatgatgacaggcctgcagatgaatatgaccagccctgggagtggaacagagtgaccatcccagccctggccgcccagttcaatggaaatgagaagaggcagagcagccccagccccagccgggacagaagacggcagctgcgggcccctgggggcggcttcaagcccatcaagcacggcagccctgagttctgtggcatcctgggggagcgggtggaccctgctgtgcccctggagaagcagatctggtaccacggggccatcagcagaggagatgctgagaacctgctgcggctgtgcaaggaatgttcctacctggtgaggaacagccagaccagcaagcatgactacagcctgagcctgcggagcaaccagggcttcatgcacatgaagctggccaagaccaaggagaagtatgtgctgggccagaacagccccccatttgattctgtgcctgaggtgatccactactacaccaccaggaagctgcccatcaagggagctgagcacctgagcctgctgtaccctgtggccgtgaggaccctgtag

SEQ ID NO: 171587 - DNA, 1080 bp, Artificial Sequence
  Description of Artificial Sequence: Synthetic coding sequence
atgcaggccgccgccctgcctgaggagatccgctggctgctggaggatgctgaggagttcctggccgagggcctgagaaatgaaaacctgtctgctgtggcccgggaccaccgggaccacatcctgcggggcttccagcagatcaaggcccgctactactgggacttccagccccagggcggggacatcggccaggacagcagtgatgacaaccacagcggcaccctgggcctgagcctgaccagtgatgcccccttcctgagtgactaccaggatgagggcatggaggacatcgtgaagggggcccaggagctggacaacgtcatcaagcagggctacctggagaagaagagcaaggaccacagcttcttcggcagcgagtggcagaagcgctggtgtgtggtgtcccggggcctcttctactactatgccaatgagaagagcaagcagcccaagggcaccttcctgatcaagggctacggcgtgaggatggccccccacctgcggcgggacagcaagaaggagagctgctttgagctgaccagccaggacagaagaagctatgagttcaccgccaccagccctgctgaggcccgggactgggtggaccagatctccttcctgctgaaggacctgagcagcctgaccatcccctatgaagaagatgaggaggaggaggagaaggaggagacctatgatgacattgatggctttgacagccccagctgtggcagccagtgccggcccaccatcctgcccggctctgtgggcatcaaggagcccacagaggagaaggaggaggaggacatctatgaggtgctgcctgatgaggagcatgacctggaggaggatgagagcggcaccaggaggaaaggagtggactatgccagctactaccagggcctgtgggactgccacggggaccagccagatgagctgtccttccagagaggagacctgatccgcatcctgagcaaggagtacaacatgtatggctggtgggtgggggagctgaacagcctggtgggcatcgtgcccaaggagtacctgaccacagcctttgaggtggaggagaggtag

SEQ ID NO: 171588 - DNA, 831 bp, Artificial Sequence
  Description of Artificial Sequence: Synthetic coding sequence
atgggcaacagcatgaagagcaccccagccccagctgagcggcccctgcccaaccctgagggcctggacagcgacttcctggccgtgctgagtgactaccccagcccagacatcagcccccccatcttccggcggggggagaagctgcgggtcatcagtgatgagggcggctggtggaaggccatcagcctgagcacaggccgggagagctacatccctggcatctgtgtggcccgggtgtaccacggctggctgtttgagggcctgggccgggacaaggccgaggagctgctgcagctgcctgacaccaaggtgggcagcttcatgatccgggagagcgagaccaagaagggcttctacagcctgtctgtgcgccaccggcaggtgaagcactaccgcatcttccggctgcccaacaactggtactacatcagcccccggctgaccttccagtgcctggaggacctggtgaaccactacagcgaggtggctgatggcctgtgctgcgtgctgaccaccccctgcctgacccagagcacagctgccccagctgtgcgggccagcagcagccctgtgaccctgcggcagaagacagtggactggaggagagtgtcccggctgcaggaggaccctgagggcacagagaaccccctgggcgtggatgagagcctcttctcctatggcctgcgggagagcatcgccagctacctgagcctgaccagcgaggacaacaccagctttgacaggaagaagaagagcatcagcctgatgtatggaggcagcaagaggaagagcagcttcttcagcagccccccctactttgaagattag

SEQ ID NO: 171589 - DNA, 882 bp, Artificial Sequence
  Description of Artificial Sequence: Synthetic coding sequence
atgctgcaccggctgtgggccagccctgctgcccctgggaagaagaaggagatgggcaacagcatgaagagcaccccagccccagctgagcggcccctgcccaaccctgagggcctggacagcgacttcctggccgtgctgagtgactaccccagcccagacatcagcccccccatcttcagaagaggagagaagctgcgggtcatcagtgatgaaggaggctggtggaaggccatcagcctgagcacaggccgggagagctacatccctggcatctgtgtggcccgggtgtaccacggctggctgtttgagggcctgggccgggacaaggccgaggagctgctgcagctgcctgacaccaaggtgggcagcttcatgatccgggagagcgagaccaagaagggcttctacagcctgtctgtgcgccaccggcaggtgaagcactaccgcatcttccggctgcccaacaactggtactacatcagcccccggctgaccttccagtgcctggaggacctggtgaaccactacagcgaggtggctgatggcctgtgctgcgtgctgaccaccccctgcctgacccagagcacagctgccccagctgtgcgggccagcagcagccctgtgaccctgcggcagaagacagtggactggaggagagtgtcccggctgcaggaggaccctgagggcacagagaaccccctgggcgtggatgagagcctcttctcctatggcctgcgggagagcatcgccagctacctgagcctgaccagcgaggacaacaccagctttgacaggaagaagaagagcatcagcctgatgtatggaggcagcaagaggaagagcagcttcttcagcagccccccctactttgaggactag

SEQ ID NO: 171590 - DNA, 951 bp, Artificial Sequence
  Description of Artificial Sequence: Synthetic coding sequence
atgctgagcaagctgggccacagccccctgggcggcctgcgggcccggctgaccttccctgtgtgcctgctgtaccaccggctgtgggccagccctgctgcccctgggaagaagaaggagatgggcaacagcatgaagagcaccccagccccagctgagcggcccctgcccaaccctgagggcctggacagcgacttcctggccgtgctgagtgactaccccagcccagacatcagcccccccatcttccggcggggggagaagctgcgggtcatcagtgatgagggcggctggtggaaggccatcagcctgagcacaggccgggagagctacatccctggcatctgtgtggcccgggtgtaccacggctggctgtttgagggcctgggccgggacaaggccgaggagctgctgcagctgcctgacaccaaggtgggcagcttcatgatccgggagagcgagaccaagaagggcttctacagcctgtctgtgcgccaccggcaggtgaagcactaccgcatcttccggctgcccaacaactggtactacatcagcccccggctgaccttccagtgcctggaggacctggtgaaccactacagcgaggtggctgatggcctgtgctgcgtgctgaccaccccctgcctgacccagagcacagctgccccagctgtgcgggccagcagcagccctgtgaccctgcggcagaagacagtggactggaggagagtgtcccggctgcaggaggaccctgagggcacagagaaccccctgggcgtggatgagagcctcttctcctatggcctgcgggagagcatcgccagctacctgagcctgaccagcgaggacaacaccagctttgacaggaagaagaagagcatcagcctgatgtatggaggcagcaagaggaagagcagcttcttcagcagccccccctactttgaagattag

SEQ ID NO: 171591 - DNA, 276 bp, Artificial Sequence
  Description of Artificial Sequence: Synthetic coding sequence
atgggcaacagcatgaagagcaccccagccccagctgagcggcccctgcccaaccctgagggcctggacagcgacttcctggccgtgctgagtgactaccccagcccagacatcagcccccccatcttccggcggggggagaagctgcgggtcatcagtgatgagggcggctggtggaaggccatcagcctgagcacaggccgggagagctacatccctggcatctgtgtggcccgggtgtaccacggctggctgtttgagggcctgggccgctag

SEQ ID NO: 171592 - DNA, 45 bp, Artificial Sequence
  Description of Artificial Sequence: Synthetic coding sequence
atgggcaacagcatgaagagcaccccagccccagctgagaggtag

SEQ ID NO: 171593 - DNA, 150 bp, Artificial Sequence
  Description of Artificial Sequence: Synthetic coding sequence
atgggcaacagcatgaagagcaccccagccccagctgagcggcccctgcccaaccctgagggcctggacagcgacttcctggccgtgctgagtgactaccccagcccagacatcagcccccccatcttccggcggggggagaagctgtag

SEQ ID NO: 171594 - DNA, 477 bp, Artificial Sequence
  Description of Artificial Sequence: Synthetic coding sequence
atgggcaacagcatgaagagcaccccagccccagctgagcggcccctgcccaaccctgagggcctggacagcgacttcctggccgtgctgagtgactaccccagcccagacatcagcccccccatcttccggcggggggagaagctgcgggtcatcagtgatgagggcggctggtggaaggccatcagcctgagcacaggccgggagagctacatccctggcatctgtgtggcccgggtgtaccacggctggctgtttgagggcctgggccgggacaaggccgaggagctgctgcagctgcctgacaccaaggtgggcagcttcatgatccgggagagcgagaccaagaagggcttctacagcctgtctgtgcgccaccggcaggtgaagcactaccgcatcttccggctgcccaacaactggtactacatcagcccccggctgaccttccagtgcctggaggacctggtgaactag

SEQ ID NO: 171595 - DNA, 123 bp, Artificial Sequence
  Description of Artificial Sequence: Synthetic coding sequence
atgggcaacagcatgaagagcaccccagccccagctgagcggcccctgcccaaccctgagggcctggacagcgacttcctggccgtgctgagtgactaccccagcccagacatcagcccctag

SEQ ID NO: 171596 - DNA, 786 bp, Artificial Sequence
  Description of Artificial Sequence: Synthetic coding sequence
atgggcagcctgcccagcaggaggaagagcctgcccagccccagcctgagcagctctgtgcagggccagggccctgtgaccatggaggccgagaggagcaaggccacagctgtggccctgggcagcttccctgctgggggccctgctgagctgagcctgcggctgggggagcccctgaccatcgtgtctgaagatggagactggtggacagtgctgtctgaggtgtctggccgggagtacaacatccccagcgtgcacgtggccaaggtgagccacggctggctgtatgagggcctgagccgggagaaggccgaggagctgctgctgctgcccggcaaccctgggggcgccttcctgatccgggagagccagacccggcggggcagctacagcctgtctgtgcggctgagcaggcctgcctcctgggaccgcatccgccactaccgcatccactgcctggacaatggctggctgtacatcagcccccggctgaccttccccagcctgcaggccctggtggaccactacagcgagctggctgatgacatctgctgcctgctgaaggagccctgtgtgctgcagagagctggccccctgcccgggaaggacatccccctgcctgtgacagtgcagaggacccccctgaactggaaggagctggacagcagcctgctcttcagcgaggccgccactggagaggagagcctgctgtctgagggcctgcgggagagcctgtccttctacatcagcctgaatgatgaagctgtgtccctggatgatgcctag

SEQ ID NO: 171597 - DNA, 633 bp, Artificial Sequence
  Description of Artificial Sequence: Synthetic coding sequence
atgggcagcctgcccagcaggaggaagagcctgcccagccccagcctgagcagctctgtgcagggccagggccctgtgaccatggaggccgagaggagcaaggccacagctgtggccctgggcagcttccctgctgggggccctgctgagctgagcctgcggctgggggagcccctgaccatcgtgtctgaagatggagactggtggacagtgctgtctgaggtgtctggccgggagtacaacatccccagcgtgcacgtggccaaggtgagccacggctggctgtatgagggcctgagccgggagaaggccgaggagctgctgctgctgcccggcaaccctgggggcgccttcctgatccgggagagccagacccggcggggcagctacagcctgtctgtgcggctgagcaggcctgcctcctgggaccgcatccgccactaccgcatccactgcctggacaatggctggctgtacatcagcccccggctgaccttccccagcctgcaggccctggtggaccactacagcgagggctggccagccccctggcagggctacacccccacctgtgactgtgccgaggacaccacccagctggagagagctggccagctgccccctgtgttctag

SEQ ID NO: 171598 - DNA, 3840 bp, Artificial Sequence
  Description of Artificial Sequence: Synthetic coding sequence
atgaccctgacagagcggctgcgggagaagatcagccgggccttctacaaccacggcctgctgtgtgccagctaccccatccccatcatcctcttcaccggcttctgcatcctggcctgctgctaccccctgctgaagctgcccctgcccggcaccggccctgtggagttcaccacccctgtgaaggactacagccccccacctgtggacagcgacaggaagcagggcgagcccacagagcagcctgagtggtacgtgggcgcccctgtggcctacgtgcagcagatctttgtgaagagctctgtgttcccctggcacaagaacctgctggccgtggatgtgttccgcagccccctgagccgggccttccagctggtggaggagatccggaaccacgtgctgcgggacagcagcggcatccgcagcctggaggagctgtgcctgcaggtgacagacctgctgcccggcctgaggaagctgaggaacctgctgcctgagcacggctgcctgctgctgagccctggcaacttctggcagaatgactgggagcgcttccacgccgaccctgacatcatcggcaccatccaccagcacgagcccaagaccctgcagaccagcgccaccctgaaggacctgctgtttggagtgcctgggaagtacagcggcgtgtccctgtacaccaggaagaggatggtgtcctacaccatcaccctggtgttccagcactaccacgccaagttcctgggcagcctgcgggcccggctgatgctgctgcaccccagccccaactgcagcctgcgggcagagagcctggtgcacgtgcacttcaaggaggagattggagtggccgagctgatccccctggtgaccacctacatcatcctgtttgcctacatctacttcagcaccaggaagattgacatggtgaagagcaagtggggcctggccctggccgctgtggtgacagtgctgagcagcctgctgatgtctgtgggcctgtgcaccctgtttggcctgacccccaccctgaatggaggagagatcttcccctacctggtggtggtgattggcctggagaatgtgctggtgctgaccaagtctgtggtgtccacccctgtggacctggaggtgaagctgagaattgcccagggcctgagcagcgagagctggagcatcatgaagaacatggccacagagctgggcatcatcctgattggctacttcaccctggtgcctgccatccaggagttctgcctgtttgctgtggtgggcctggtgtctgacttcttcctgcagatgctgttcttcaccaccgtgctgagcattgacatccggaggatggagctggccgacctgaacaagaggctgcccccagaggcctgcctgcccagcgccaagcctgtgggccagcccaccaggtatgaaaggcagctggccgtgcggcccagcaccccccacaccatcaccctgcagcccagcagcttcaggaacctgcggctgcccaagaggctgcgggtggtgtacttcctggcccggacccggctggcccagaggctcatcatggccggcaccgtggtgtggattggcatcctggtgtacacagatcctgctggcctgaggaactacctggccgcccaggtgacagagcagagccccctgggggagggcgccctggcccccatgcctgtgcccagcggcatgctgccccccagccacccagaccctgccttcagcatcttccccccagatgcccccaagctgcctgagaaccagaccagccctggagagagccctgagcggggcggccctgctgaggtggtgcatgacagccctgtgcctgaggtgacctggggcccagaagatgaggagctgtggaggaagctgtccttccgccactggcccaccctcttctcctactacaacatcaccctggccaagcgctacatcagcctgctgcctgtgattcctgtgaccctgcggctgaacccccgggaggccctggagggccgccacccccaggacggccgcagcgcctggcccccacctggccccatcccagctggccactgggaggccggccccaagggccctggaggagtgcaggcccatggagatgtgaccctgtacaaggtggccgccctgggcctggccaccggcatcgtgctggtgctgctgctgctgtgcctgtacagagtgctgtgccccaggaactacggccagctgggcggcggccctggaagaagaagaagaggagagctgccctgtgatgattatggctacgcccctcctgagacagaaattgtgcccctggtgctgcggggccacctgatggacatcgagtgcctggccagtgatggcatgctgctggtgtcctgctgcctggccggccacgtgtgtgtgtgggatgcccagacaggagactgcctgacccgcatccccaggcctggccggcagaggcgggacagcggcgtgggcagcggcctggaggcccaggagagctgggagcggctgagtgatggcggcaaggccggccctgaggagcccggggacagcccccccctgcggcaccggccccggggccccccaccacccagcctgtttggagaccagcctgacctgacctgcctgattgacaccaacttcagcgcccagcccaggagcagccagcccacccagcctgagcccaggcacagagctgtgtgtggccgcagccgggacagccctggctatgacttcagctgcctggtgcagagggtgtaccaggaggagggcctggccgctgtgtgcaccccagccctgcggccccccagccctggccctgtgctgagccaggccccagaagatgagggcggcagccctgagaagggcagccccagcctggcctgggcccccagcgctgagggcagcatctggagcctggagctgcagggcaacctgattgtggtgggccgcagcagcggccgcctggaggtgtgggatgccattgaaggagtgctgtgctgcagcagcgaggaggtgagcagcggcatcacagccctggtgttcctggacaagagaattgtggccgcccggctgaatggcagcctggacttcttcagcctggagacccacacagccctgagccccctgcagttccggggcaccccaggccggggcagcagccctgccagccctgtgtacagcagcagtgacacagtggcctgccacctgacccacacagtgccctgtgcccaccagaagcccatcacagccctgaaggctgctgctggccgcctggtgacaggcagccaggaccacaccctgcgggtcttccggctggaggacagctgctgcctcttcaccctgcagggccacagcggggccatcaccaccgtgtacatcgaccagaccatggtgctggccagcggcggccaggatggagccatctgcctgtgggatgtgctgaccggcagccgggtgagccacgtgtttgcccacagaggagatgtgaccagcctgacctgcaccaccagctgtgtgatcagcagcggcctggatgacctgatcagcatctgggacaggagcacaggcatcaagttctacagcatccagcaggacctgggctgtggggccagcctgggcgtcatcagtgacaacctgctggtgactggaggccagggctgtgtgtccttctgggacctgaactatggagacctgctgcagacagtgtacctgggcaagaacagcgaggcccagcctgcccggcagatcctggtgctggacaatgctgccatcgtgtgcaactttggcagcgagctgagcctggtgtatgtgcccagcgtgctggagaagctggactag

SEQ ID NO: 171599 - DNA, 2316 bp, Artificial Sequence
  Description of Artificial Sequence: Synthetic coding sequence
atgaccctgacagagcggctgcgggagaagatcagccgggccttctacaaccacggcctgctgtgtgccagctaccccatccccatcatcctcttcaccggcttctgcatcctggcctgctgctaccccctgctgaagctgcccctgcccggcaccggccctgtggagttcaccacccctgtgaaggactacagccccccacctgtggacagcgacaggaagcagggcgagcccacagagcagcctgagtggtacgtgggcgcccctgtggcctacgtgcagcagatctttgtgaagagctctgtgttcccctggcacaagaacctgctggccgtggatgtgttccgcagccccctgagccgggccttccagctggtggaggagatccggaaccacgtgctgcgggacagcagcggcatccgcagcctggaggagctgtgcctgcaggtgacagacctgctgcccggcctgaggaagctgaggaacctgctgcctgagcacggctgcctgctgctgagccctggcaacttctggcagaatgactgggagcgcttccacgccgaccctgacatcatcggcaccatccaccagcacgagcccaagaccctgcagaccagcgccaccctgaaggacctgctgtttggagtgcctgggaagtacagcggcgtgtccctgtacaccaggaagaggatggtgtcctacaccatcaccctggtgttccagcactaccacgccaagttcctgggcagcctgcgggcccggctgatgctgctgcaccccagccccaactgcagcctgcgggcagagagcctggtgcacgtgcacttcaaggaggagattggagtggccgagctgatccccctggtgaccacctacatcatcctgtttgcctacatctacttcagcaccaggaagattgacatggtgaagagcaagtggggcctggccctggccgctgtggtgacagtgctgagcagcctgctgatgtctgtgggcctgtgcaccctgtttggcctgacccccaccctgaatggaggagagatcttcccctacctggtggtggtgattggcctggagaatgtgctggtgctgaccaagtctgtggtgtccacccctgtggacctggaggtgaagctgagaattgcccagggcctgagcagcgagagctggagcatcatgaagaacatggccacagagctgggcatcatcctgattggctacttcaccctggtgcctgccatccaggagttctgcctgtttgctgtggtgggcctggtgtctgacttcttcctgcagatgctgttcttcaccaccgtgctgagcattgacatccggaggatggagctggccgacctgaacaagaggctgcccccagaggcctgcctgcccagcgccaagcctgtgggccagcccaccaggtatgaaagaagcagcggccgcctggaggtgtgggatgccattgaaggagtgctgtgctgcagcagcgaggaggtgagcagcggcatcacagccctggtgttcctggacaagagaattgtggccgcccggctgaatggcagcctggacttcttcagcctggagacccacacagccctgagccccctgcagttccggggcaccccaggccggggcagcagccctgccagccctgtgtacagcagcagtgacacagtggcctgccacctgacccacacagtgccctgtgcccaccagaagcccatcacagccctgaaggctgctgctggccgcctggtgacaggcagccaggaccacaccctgcgggtcttccggctggaggacagctgctgcctcttcaccctgcagggccacagcggggccatcaccaccgtgtacatcgaccagaccatggtgctggccagcggcggccaggatggagccatctgcctgtgggatgtgctgaccggcagccgggtgagccacgtgtttgcccacagaggagatgtgaccagcctgacctgcaccaccagctgtgtgatcagcagcggcctggatgacctgatcagcatctgggacaggagcacaggcatcaagttctacagcatccagcaggacctgggctgtggggccagcctgggcgtcatcagtgacaacctgctggtgactggaggccagggctgtgtgtccttctgggacctgaactatggagacctgctgcagacagtgtacctgggcaagaacagcgaggcccagcctgcccggcagatcctggtgctggacaatgctgccatcgtgtgcaactttggcagcgagctgagcctggtgtatgtgcccagcgtgctggagaagctggactag

SEQ ID NO: 171600 - DNA, 2718 bp, Artificial Sequence
  Description of Artificial Sequence: Synthetic coding sequence
atgaccctgacagagcggctgcgggagaagatcagccgggccttctacaaccacggcctgctgtgtgccagctaccccatccccatcatcctgattggctacttcaccctggtgcctgccatccaggagttctgcctgtttgctgtggtgggcctggtgtctgacttcttcctgcagatgctgttcttcaccaccgtgctgagcattgacatccggaggatggagctggccgacctgaacaagaggctgcccccagaggcctgcctgcccagcgccaagcctgtgggccagcccaccaggtatgagcggcagctggccgtgcggcccagcaccccccacaccatcaccctgcagcccagcagcttcaggaacctgcggctgcccaagaggctgcgggtggtgtacttcctggcccggacccggctggcccagaggctcatcatggccggcaccgtggtgtggattggcatcctggtgtacacagatcctgctggcctgaggaactacctggccgcccaggtgacagagcagagccccctgggggagggcgccctggcccccatgcctgtgcccagcggcatgctgccccccagccacccagaccctgccttcagcatcttccccccagatgcccccaagctgcctgagaaccagaccagccctggagagagccctgagcggggcggccctgctgaggtggtgcatgacagccctgtgcctgaggtgacctggggcccagaagatgaggagctgtggaggaagctgtccttccgccactggcccaccctcttctcctactacaacatcaccctggccaagcgctacatcagcctgctgcccgtcatccctgtgaccctgcggctgaacccccgggaggccctggagggccgccacccccaggacggccgcagcgcctggcccccacctggccccatcccagctggccactgggaggccggccccaagggccctgggggcgtgcaggcccatggagatgtgaccctgtacaaggtggccgccctgggcctggccactggaattgtgctggtgctgctgctgctgtgcctgtacagagtgctgtgccccagaaattatggccagctgggcggcggccctggaagaagaagaagaggagagctgccctgtgatgattatggctacgcccctcctgagacagagatcgtgcccctggtgctgcggggccacctgatggacattgaatgtctggccagtgatggcatgctgctggtgtcctgctgcctggccggccacgtgtgtgtgtgggatgcccagacaggagactgcctgacccgcatcccccggcccggccagaggcgggacagcggcgtgggcagcggcctggaggcccaggagagctgggagcggctgagtgatggcggcaaggccggccctgaggagcccggggacagcccccccctgcggcaccggccccggggccccccaccacccagcctgtttggagaccagcctgacctgacctgcctgattgacaccaacttcagcgcccagcccaggagcagccagcccacccagcctgagcccaggcacagagctgtgtgtggccgcagccgggacagccctggctatgacttcagctgcctggtgcagagggtgtaccaggaggagggcctggccgctgtgtgcaccccagccctgcggccccccagccctggccctgtgctgagccaggccccagaagatgagggcggcagccctgagaagggcagccccagcctggcctgggcccccagcgctgagggcagcatctggagcctggagctgcagggcaacctgattgtggtgggccgcagcagcggccgcctggaggtgtgggatgccattgaaggagtgctgtgctgcagcagcgaggaggtgagcagcggcatcacagccctggtgttcctggacaagagaattgtggccgcccggctgaatggcagcctggacttcttcagcctggagacccacacagccctgagccccctgcagttccggggcaccccaggccggggcagcagccctgccagccctgtgtacagcagcagtgacacagtggcctgccacctgacccacacagtgccctgtgcccaccagaagcccatcacagccctgaaggctgctgctggccgcctggtgacaggcagccaggaccacaccctgcgggtcttccggctggaggacagctgctgcctcttcaccctgcagggccacagcggggccatcaccaccgtgtacatcgaccagaccatggtgctggccagcggcggccaggatggagccatctgcctgtgggatgtgctgaccggcagccgggtgagccacgtgtttgcccacagaggagatgtgaccagcctgacctgcaccaccagctgtgtgatcagcagcggcctggatgacctgatcagcatctgggacaggagcacaggcatcaagttctacagcatccagcaggacctgggctgtggggccagcctgggcgtcatcagtgacaacctgctggtgactggaggccagggctgtgtgtccttctgggacctgaactatggagacctgctgcagacagtgtacctgggcaagaacagcgaggcccagcctgcccggcagatcctggtgctggacaatgctgccatcgtgtgcaactttggcagcgagctgagcctggtgtatgtgcccagcgtgctggagaagctggactag

SEQ ID NO: 171601 - DNA, 1059 bp, Artificial Sequence
  Description of Artificial Sequence: Synthetic coding sequence
atggtgaagagcaagtggggcctggccctggccgctgtggtgacagtgctgagcagcctgctgatgtctgtgggcctgtgcaccctgtttggcctgacccccaccctgaatggaggagagatcttcccctacctggtggtggtgattggcctggagaatgtgctggtgctgaccaagtctgtggtgtccacccctgtggacctggaggtgaagctgcgcatcgcccagggcctgagcagcgagagctggagcatcatgaagaacatggccacagagctgggcatcatcctgattggctacttcaccctggtgcctgccatccaggagttctgcctgtttgctgtggtgggcctggtgtctgacttcttcctgcagatgctgttcttcaccaccgtgctgagcattgacatccggaggatggagctggccgacctgaacaagaggctgcccccagaggcctgcctgcccagcgccaagcctgtgggccagcccaccaggtatgagcggcagctggccgtgcggcccagcaccccccacaccatcaccctgcagcccagcagcttcaggaacctgcggctgcccaagaggctgcgggtggtgtacttcctggcccccaccggggcccacacctgctgggccctgggcagcaggacccagggcccccgctggggcgccggcccctggaggagacatgctgtgcagggcggcggggccggccctggccaccgccaccggctgggcgctgctgctgccctgcccctgccccgggccatgcctgcccagctgcgggctgctggctggtgggcccgggctgctgaggcccggggagctgccctgcggcggctgcggctgtgtgccaccagagatggagacagagctgcctgtgccgcccggccccctcatggccaccgggtgcccggccagaggagacatgctgctggggagctgctgcccggccggccccggctgcgggtgggccgggctgaccggggcctgcccaatgcccacagcgccccccggcaggccgcccctggccagtggaggggccagagggcctag

SEQ ID NO: 171602 - DNA, 411 bp, Artificial Sequence
  Description of Artificial Sequence: Synthetic coding sequence
atgaccctgacagagcggctgcgggagaagatcagccgggccttctacaaccacggcctgctgtgtgccagctaccccatccccatcatcctcttcaccggcttctgcatcctggcctgctgctaccccctgctgaagctgcccctgcccggcaccggccctgtggagttcaccacccctgtgaaggactacagccccccacctgtggacagcgacaggaagcagggcgagcccacagagcagcctgagtggtacgtgggcgcccctgtggcctacgtgcagcagatctttgtgaagagctctgtgttcccctggcacaagaacctgctggccgtggatgtgttccgcagccccctgagccgggccttccagctggtggaggagatccggaaccacgtgctgcgggactag

SEQ ID NO: 171603 - DNA, 3072 bp, Artificial Sequence
  Description of Artificial Sequence: Synthetic coding sequence
atgctgctgcaccccagccccaactgcagcctgcgggcagagagcctggtgcacgtgcacttcaaggaggagattggagtggccgagctgatccccctggtgaccacctacatcatcctgtttgcctacatctacttcagcaccaggaagattgacatggtgaagagcaagtggggcctggccctggccgctgtggtgacagtgctgagcagcctgctgatgtctgtgggcctgtgcaccctgtttggcctgacccccaccctgaatggaggagagatcttcccctacctggtggtggtgattggcctggagaatgtgctggtgctgaccaagtctgtggtgtccacccctgtggacctggaggtgaagctgcgcatcgcccagggcctgagcagcgagagctggagcatcatgaagaacatggccacagagctgggcatcatcctgattggctacttcaccctggtgcctgccatccaggagttctgcctgtttgctgtggtgggcctggtgtctgacttcttcctgcagatgctgttcttcaccaccgtgctgagcattgacatccggaggatggagctggccgacctgaacaagaggctgcccccagaggcctgcctgcccagcgccaagcctgtgggccagcccaccaggtatgagcggcagctggccgtgcggcccagcaccccccacaccatcaccctgcagcccagcagcttcaggaacctgcggctgcccaagaggctgcgggtggtgtacttcctggcccggacccggctggcccagaggctcatcatggccggcaccgtggtgtggattggcatcctggtgtacacagatcctgctggcctgaggaactacctggccgcccaggtgacagagcagagccccctgggggagggcgccctggcccccatgcctgtgcccagcggcatgctgccccccagccacccagaccctgccttcagcatcttccccccagatgcccccaagctgcctgagaaccagaccagccctggagagagccctgagcggggcggccctgctgaggtggtgcatgacagccctgtgcctgaggtgacctggggcccagaagatgaggagctgtggaggaagctgtccttccgccactggcccaccctcttctcctactacaacatcaccctggccaagcgctacatcagcctgctgcccgtcatccctgtgaccctgcggctgaacccccgggaggccctggagggccgccacccccaggacggccgcagcgcctggcccccacctggccccatcccagctggccactgggaggccggccccaagggccctgggggcgtgcaggcccatggagatgtgaccctgtacaaggtggccgccctgggcctggccactggaattgtgctggtgctgctgctgctgtgcctgtacagagtgctgtgccccagaaattatggccagctgggcggcggccctggaagaagaagaagaggagagctgccctgtgatgattatggctacgcccctcctgagacagagatcgtgcccctggtgctgcggggccacctgatggacattgaatgtctggccagtgatggcatgctgctggtgtcctgctgcctggccggccacgtgtgtgtgtgggatgcccagacaggagactgcctgacccgcatcccccggcccggccagaggcgggacagcggcgtgggcagcggcctggaggcccaggagagctgggagcggctgagtgatggcggcaaggccggccctgaggagcccggggacagcccccccctgcggcaccggccccggggccccccaccacccagcctgtttggagaccagcctgacctgacctgcctgattgacaccaacttcagcgcccagcccaggagcagccagcccacccagcctgagcccaggcacagagctgtgtgtggccgcagccgggacagccctggctatgacttcagctgcctggtgcagagggtgtaccaggaggagggcctggccgctgtgtgcaccccagccctgcggccccccagccctggccctgtgctgagccaggccccagaagatgagggcggcagccctgagaagggcagccccagcctggcctgggcccccagcgctgagggcagcatctggagcctggagctgcagggcaacctgattgtggtgggccgcagcagcggccgcctggaggtgtgggatgccattgaaggagtgctgtgctgcagcagcgaggaggtgagcagcggcatcacagccctggtgttcctggacaagagaattgtggccgcccggctgaatggcagcctggacttcttcagcctggagacccacacagccctgagccccctgcagttccggggcaccccaggccggggcagcagccctgccagccctgtgtacagcagcagtgacacagtggcctgccacctgacccacacagtgccctgtgcccaccagaagcccatcacagccctgaaggctgctgctggccgcctggtgacaggcagccaggaccacaccctgcgggtcttccggctggaggacagctgctgcctcttcaccctgcagggccacagcggggccatcaccaccgtgtacatcgaccagaccatggtgctggccagcggcggccaggatggagccatctgcctgtgggatgtgctgaccggcagccgggtgagccacgtgtttgcccacagaggagatgtgaccagcctgacctgcaccaccagctgtgtgatcagcagcggcctggatgacctgatcagcatctgggacaggagcacaggcatcaagttctacagcatccagcaggacctgggctgtggggccagcctgggcgtcatcagtgacaacctgctggtgactggaggccagggctgtgtgtccttctgggacctgaactatggagacctgctgcagacagtgtacctgggcaagaacagcgaggcccagcctgcccggcagatcctggtgctggacaatgctgccatcgtgtgcaactttggcagcgagctgagcctggtgtatgtgcccagcgtgctggagaagctggactag

SEQ ID NO: 171604 - DNA, 267 bp, Artificial Sequence
  Description of Artificial Sequence: Synthetic coding sequence
atgaccctgacagagcggctgcgggagaagatcagccgggccttctacaaccacggcctgctgtgtgccagctaccccatccccatcatcctcttcaccggcttctgcatcctggcctgctgctaccccctgctgaagctgcccctgcccggcaccggccctgtggagttcaccacccctgtgaaggactacagccccccacctgtggacagcgacaggaagcagggcgagcccacagagcagcctgagtgggtgggcaccaggtag

SEQ ID NO: 171605 - DNA, 399 bp, Artificial Sequence
  Description of Artificial Sequence: Synthetic coding sequence
atgaccctgacagagcggctgcgggagaagatcagccgggccttctacaaccacggcctgctgtgtgccagctaccccatccccatcatcctcttcaccggcttctgcatcctggcctgctgctaccccctgctgaagctgcccctgcccggcaccggccctgtggagttcaccacccctgtgaaggactacagccccccacctgtggacagcgacaggaagcagggcgagcccacagagcagcctgagtggtacgtgggcgcccctgtggcctacgtgcagcagatctttgtgaagagctctgtgttcccctggcacaagaacctgctggccgtggatgtgttccgcagccccctgagccgggccttccagctggtggaggagatccggaaccactag

SEQ ID NO: 171606 - DNA, 2661 bp, Artificial Sequence
  Description of Artificial Sequence: Synthetic coding sequence
atgaagaacatggccacagagctgggcatcatcctgattggctacttcaccctggtgcctgccatccaggagttctgcctgtttgctgtggtgggcctggtgtctgacttcttcctgcagatgctgttcttcaccaccgtgctgagcattgacatccggaggatggagctggccgacctgaacaagaggctgcccccagaggcctgcctgcccagcgccaagcctgtgggccagcccaccaggtatgaaaggcagctggccgtgcggcccagcaccccccacaccatcaccctgcagcccagcagcttcaggaacctgcggctgcccaagaggctgcgggtggtgtacttcctggcccggacccggctggcccagaggctcatcatggccggcaccgtggtgtggattggcatcctggtgtacacagatcctgctggcctgaggaactacctggccgcccaggtgacagagcagagccccctgggggagggcgccctggcccccatgcctgtgcccagcggcatgctgccccccagccacccagaccctgccttcagcatcttccccccagatgcccccaagctgcctgagaaccagaccagccctggagagagccctgagcggggcggccctgctgaggtggtgcatgacagccctgtgcctgaggtgacctggggcccagaagatgaggagctgtggaggaagctgtccttccgccactggcccaccctcttctcctactacaacatcaccctggccaagcgctacatcagcctgctgcctgtgattcctgtgaccctgcggctgaacccccgggaggccctggagggccgccacccccaggacggccgcagcgcctggcccccacctggccccatcccagctggccactgggaggccggccccaagggccctggaggagtgcaggcccatggagatgtgaccctgtacaaggtggccgccctgggcctggccaccggcatcgtgctggtgctgctgctgctgtgcctgtacagagtgctgtgccccaggaactacggccagctgggcggcggccctggaagaagaagaagaggagagctgccctgtgatgattatggctacgcccctcctgagacagaaattgtgcccctggtgctgcggggccacctgatggacatcgagtgcctggccagtgatggcatgctgctggtgtcctgctgcctggccggccacgtgtgtgtgtgggatgcccagacaggagactgcctgacccgcatccccaggcctggccagaggcgggacagcggcgtgggcagcggcctggaggcccaggagagctgggagcggctgagtgatggcggcaaggccggccctgaggagcccggggacagcccccccctgcggcaccggccccggggccccccaccacccagcctgtttggagaccagcctgacctgacctgcctgattgacaccaacttcagcgcccagcccaggagcagccagcccacccagcctgagcccaggcacagagctgtgtgtggccgcagccgggacagccctggctatgacttcagctgcctggtgcagagggtgtaccaggaggagggcctggccgctgtgtgcaccccagccctgcggccccccagccctggccctgtgctgagccaggccccagaagatgaaggaggcagccctgagaagggcagccccagcctggcctgggcccccagcgctgagggcagcatctggagcctggagctgcagggcaacctgattgtggtgggccgcagcagcggccgcctggaggtgtgggatgccatcgagggcgtgctgtgctgcagcagcgaggaggtgagcagcggcatcacagccctggtgttcctggacaagagaattgtggccgcccggctgaatggcagcctggacttcttcagcctggagacccacacagccctgagccccctgcagttccggggcaccccaggccggggcagcagccctgccagccctgtgtacagcagcagtgacacagtggcctgccacctgacccacacagtgccctgtgcccaccagaagcccatcacagccctgaaggctgctgctggccgcctggtgacaggcagccaggaccacaccctgcgggtcttccggctggaggacagctgctgcctcttcaccctgcagggccacagcggggccatcaccaccgtgtacatcgaccagaccatggtgctggccagcggcggccaggatggagccatctgcctgtgggatgtgctgaccggcagccgggtgagccacgtgtttgcccacagaggagatgtgaccagcctgacctgcaccaccagctgtgtgatcagcagcggcctggatgacctgatcagcatctgggacaggagcacaggcatcaagttctacagcatccagcaggacctgggctgtggggccagcctgggcgtcatcagtgacaacctgctggtgactggaggccagggctgtgtgtccttctgggacctgaactacggggacctgctgcagacagtgtacctgggcaagaacagcgaggcccagcctgcccggcagatcctggtgctggacaatgctgccatcgtgtgcaactttggaagtgagctgagcctggtgtatgtgcccagcgtgctggagaagctggactag

SEQ ID NO: 171607 - DNA, 792 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaatggccacctgtaccgggaggaccagaccagccctgcccctggcctgcgctgcctgaactggctggatgcccagagcggcctggccagcgcccctgtgtctggggccggcaaccacagctactgcagaaatccagatgaggacccccggggcccctggtgctacgtgtctggagaggccggcgtgcctgagaagaggccctgtgaggacctgcgctgcccagagaccaccagccaggccctgcctgccttcaccacagagatccaggaggccagcgagggccctggagcagatgaggtgcaggtgtttgccccagccaatgccctgcctgcccggtctgaggccgctgctgtgcagcccgtcatcggcatcagccagagggtgaggatgaacagcaaggagaagaaggacctgggcaccctgggctacgtgctgggcatcaccatgatggtgatcatcatcgccatcggggccggcatcatcctgggctacagctacaagaggggcaaggacctgaaggagcagcacgaccagaaggtgtgtgagcgggagatgcagaggatcaccctgcccctgagcgccttcaccaaccccacctgtgagatcgtggatgagaagacagtggtggtgcacaccagccagacccctgtggacccccaggagggcaccacccccctgatgggccaggccggcacccctggggcctag

SEQ ID NO: 171608 - DNA, 1176 bp, Artificial Sequence
  Description of Artificial Sequence: Synthetic coding sequence
atgtacagcatgatgatggagacagacctgcacagccctggaggagcccaggcccccaccaacctgagcggccctgctggggccggcggcggcggcggcggcggcggcggcggcggcggcggcggcggggccaaggccaaccaggacagagtgaagaggcccatgaatgccttcatggtgtggagccggggccagaggaggaagatggcccaggagaaccccaagatgcacaacagcgagatcagcaagaggctgggcgctgagtggaaggtgatgtctgaggccgagaagaggcccttcattgatgaggccaagaggctgcgggccctgcacatgaaggagcacccagactacaagtaccggcccaggaggaagaccaagaccctgctgaagaaggacaagtacagcctggccggcggcctgctggccgccggggccggcggcggcggcgctgctgtggccatgggcgtgggcgtgggcgtgggcgctgctgctgtgggccagaggctggagagccctggaggagctgctgggggcggctacgcccacgtgaatggctgggccaatggagcctacccaggctctgtggccgctgctgctgctgctgctgccatgatgcaggaggcccagctggcctacggccagcaccctggagctggaggagcccacccccacgcccacccagcccacccccacccccaccacccccacgcccacccccacaacccccagcccatgcacagatatgacatgggcgccctgcagtacagccccatcagcaacagccagggctacatgtctgccagccccagcggctatggaggcctgccctacggggctgctgctgctgctgctgctgctgctgggggcgcccaccagaacagcgctgtggccgctgctgctgctgctgctgctgccagcagcggggccctgggcgccctgggcagcctggtgaagtctgagcccagcggcagccccccagccccagcccacagccgggccccctgccctggggacctgcgggagatgatctccatgtacctgcctgctggggagggcggggaccctgctgctgctgctgctgctgctgcccagagccggctgcacagcctgccccagcactaccagggcgctggggccggcgtgaatggaacagtgcccctgacccacatctag

SEQ ID NO: 171609 - DNA, 1326 bp, Artificial Sequence
  Description of Artificial Sequence: Synthetic coding sequence
atggtgcagcaggccgagagcctggaggccgagagcaacctgccccgggaggccctggacacagaggagggggagttcatggcctgcagccctgtggccctggatgaaagtgaccctgactggtgcaagacagccagcggccacatcaagaggcccatgaatgccttcatggtgtggagcaagattgaaagaaggaagatcatggagcagagcccagacatgcacaatgctgagatcagcaagaggctgggcaagcgctggaagatgctgaaggacagcgagaagatccccttcatccgggaggccgagcggctgcggctgaagcacatggctgactacccagactacaagtaccggcccaggaagaagcccaagatggaccccagcgccaagcccagcgccagccagagccctgagaagtctgctgctgggggcggcggcggcagcgctgggggcggggccggcggggccaagaccagcaagggcagcagcaagaagtgtgggaagctgaaggccccagctgctgctggggccaaggccggggccggcaaggccgcccagagcggggactatggaggagctggagatgattatgtgctgggcagcctgcgggtgtctggcagcggcggcggcggggccggcaagacagtgaagtgtgtgttcctggatgaagatgatgatgatgatgatgatgatgatgagctgcagctgcagatcaagcaggagccagatgaggaggatgaggagcccccccaccagcagctgctgcagcccccaggccagcagcccagccagctgctgcggcgctacaacgtggccaaggtgcctgccagccccaccctgagcagcagcgctgagagccctgagggcgccagcctgtatgatgaggtgcgggccggggccaccagcggggccggcggcggcagccggctgtactacagcttcaagaacatcaccaagcagcaccccccacccctggcccagcctgccctgagccctgccagcagccgctctgtgtccaccagcagcagcagcagcagcggcagcagcagcggcagcagcggggaggatgctgatgacctgatgtttgacctgagcctgaacttcagccagagcgcccacagcgccagcgagcagcagctgggcggcggcgctgctgctggcaacctgagcctgagcctggtggacaaggacctggacagcttcagcgagggcagcctgggcagccactttgagttcccagactactgcaccccagagctgtctgagatgattgctggggactggctggaggccaacttcagtgacctggtgttcacctactag

SEQ ID NO: 171610 - DNA, 948 bp, Artificial Sequence
  Description of Artificial Sequence: Synthetic coding sequence
atggtgcagcagagaggagcccgggccaagagagatggcggccccccacctcctggccctggccctgctgaggagggcgcccgggagcccggctggtgcaagaccccatctggccacatcaagaggcccatgaatgccttcatggtgtggagccagcatgaaagaaggaagatcatggaccagtggccagacatgcacaatgctgagatcagcaagaggctgggccgccgctggcagctgctgcaggacagcgagaagatcccctttgtgcgggaggccgagcggctgcggctgaagcacatggctgactacccagactacaagtaccggcccaggaagaagagcaagggggccccagccaaggcccggccccggcccccaggcggcagcggcggcggcagccggctgaagccaggcccccagctgcccggccggggcggccggcgggctgctgggggccccctgggcggcggggccgccgccccagaagatgatgatgaagatgatgatgaggagctgctggaggtgcggctggtggagaccccaggccgggagctgtggaggatggtgcctgctggccgggccgcccggggccaggccgagcgggcccagggccccagcggggagggcgctgctgctgctgctgctgccagccccacccccagtgaagatgaggagcctgaggaggaggaggaggaggccgctgctgctgaggagggggaggaggagaccgtggccagcggggaggagagcctgggcttcctgagccggctgcccccaggccctgctggcctggactgcagcgccctggaccgggaccctgacctgcagccccccagcggcaccagccactttgagttcccagactactgcaccccagaggtgacagagatgattgctggggactggaggcccagcagcattgctgacctggtgttcacctactag

SEQ ID NO: 171611 - DNA, 948 bp, Artificial Sequence; identical to SEQ ID NO: 171610
  Description of Artificial Sequence: Synthetic coding sequence

SEQ ID NO: 171612 - DNA, 1869 bp, Artificial Sequence
  Description of Artificial Sequence: Synthetic coding sequence
atgtccatgaggagccccatcagcgcccagctggccctggatggagtgggcaccatggtgaactgcaccatcaagtctgaggagaagaaggagccctgccacgaggccccccagggcagcgccacagctgctgagccccagcccggggaccctgcccgggccagccaggacagcgctgacccccaggccccagcccagggcaacttccggggctcctgggactgcagcagccctgagggcaatggcagccctgagcccaagaggcctggggtgtctgaggccgccagcggcagccaggagaagctggacttcaacagaaacctgaaggaggtggtgcctgccatcgagaagctgctgagcagtgactggaaggagcgcttcctgggcaggaacagcatggaggccaaggatgtgaagggcacccaggagagcctggccgagaaggagctgcagctgctggtgatgatccaccagctgagcaccctgcgggaccagctgctgacagcccacagcgagcagaagaacatggccgccatgctgtttgagaagcagcagcagcagatggagctggcccggcagcagcaggagcagatcgccaagcagcagcagcagctgatccagcagcagcacaagatcaacctgctgcagcagcagatccagcaggtgaacatgccctacgtgatgatcccagccttcccccccagccaccagcccctgcctgtgaccccagacagccagctggccctgcccatccagcccatcccctgcaagcctgtggagtaccccctgcagctgctgcacagccccccagcccctgtggtgaagaggcctggggccatggccacccaccaccccctgcaggagcccagccagcccctgaacctgacagccaagcccaaggcccctgagctgcccaacaccagcagcagccccagcctgaagatgagcagctgtgtgccccggccccccagccatggaggccccacccgggacctgcagagcagcccccccagcctgcccctgggcttcctgggggagggagatgctgtgaccaaggccatccaggatgcccggcagctgctgcacagccacagcggggccctggatggcagccccaacacccccttcaggaaggacctgatcagcctggacagcagccctgccaaggagcggctggaggatggctgtgtgcaccccctggaggaggccatgctgagctgtgacatggatggcagccgccacttccctgagagcaggaacagcagccacatcaagaggcccatgaatgccttcatggtgtgggccaaggatgaaagaaggaagatcctgcaggccttcccagacatgcacaacagcagcatcagcaagatcctgggcagccgctggaagtccatgaccaaccaggagaagcagccctactatgaggagcaggcccggctgagccggcagcacctggagaagtacccagactacaagtacaagccccggcccaagaggacctgcatcgtggagggcaagaggctgcgggtgggggagtacaaggccctgatgaggacccggcggcaggatgcccggcagagctatgtgattcctccccaggccggccaggtgcagatgagcagcagtgatgtgctgtaccccagggctgctggcatgcccctggcccagcccctggtggagcactacgtgcccaggagcctggaccccaacatgcctgtgattgtgaacacctgcagcctgcgggaggagggggagggcacagatgacagacacagcgtggctgatggagagatgtaccgctacagtgaagatgaagattctgagggggaggagaagagtgatggagagctggtggtgctgacagactag

SEQ ID NO: 171613 - DNA, 174 bp, Artificial Sequence
  Description of Artificial Sequence: Synthetic coding sequence
atgtccatgaggagccccatcagcgcccagctggccctggatggagtgggcaccatggtgaactgcaccatcaagtctgaggagaagaaggagccctgccacgaggccccccagggcagcgccacagctgctgagccccagcccggggaccctgcccgggccagccaggactag

SEQ ID NO: 171614 - DNA, 543 bp, Artificial Sequence
  Description of Artificial Sequence: Synthetic coding sequence
atgtccatgaggagccccatcagcgcccagctggccctggatggagtgggcaccatggtgaactgcaccatcaagtctgaggagaagaaggagccctgccacgaggccccccagggcagcgccacagctgctgagccccagcccggggaccctgcccgggccagccaggacagcgctgacccccaggccccagcccagggcaacttccggggctcctgggactgcagcagccctgagggcaatggcagccctgagcccaagaggcctggggtgtctgaggccgccagcggcagccaggagaagctggacttcaacagaaacctgaaggaggtggtgcctgccatcgagaagctgctgagcagtgactggaaggagcgcttcctgggcaggaacagcatggaggccaaggatgtgaagggcacccaggagagcctggccgagaaggagctgcagctgctggtgatgatccaccagctgagcaccctgcgggaccagctgctgacagcccacagcgagcagaagaacatggccgccatgctgtag

SEQ ID NO: 171615 - DNA, 723 bp, Artificial Sequence
  Description of Artificial Sequence: Synthetic coding sequence
atgagcaagcccagcgaccacatcaagaggcccatgaatgccttcatggtgtggagccggggccagaggaggaagatggcccaggagaaccccaagatgcacaacagcgagatcagcaagaggctgggcgctgagtggaagctgctgtctgaggccgagaagaggccctacattgatgaggccaagaggctgcgggcccagcacatgaaggagcacccagactacaagtaccggcccaggaggaagcccaagaacctgctgaagaaggaccgctacgtgttccccctgccctacctgggggacacagaccccctgaaggccgccggcctgcctgtgggcgccagtgatggcctgctgagcgcccctgagaaggcccgggccttcctgcccccagccagcgccccctacagcctgctggaccctgcccagttcagcagcagcgccatccagaagatgggagaggtgccccacaccctggccactggagccctgccctatgccagcaccctgggctaccagaatggagccttcggcagcctgagctgccccagccagcacacccacacccaccccagccccaccaaccctggctacgtggtgccctgcaactgcacagcctggagcgccagcaccctgcagccccctgtggcctacatcctcttccctggcatgaccaagacaggaattgacccctacagcagcgcccacgccacagccatgtag

SEQ ID NO: 171616 - DNA, 702 bp, Artificial Sequence
  Description of Artificial Sequence: Synthetic coding sequence
atggccctgcccggcagcagccaggaccaggcctggagcctggagcccccagctgccacagctgctgccagcagcagcagcggcccccaggagcgggagggcgccggcagccctgctgcccctggcaccctgcccctggagaaggtgaagaggcccatgaatgccttcatggtgtggagcagcgcccagaggcggcagatggcccagcagaaccccaagatgcacaacagcgagatcagcaagaggctgggcgcccagtggaagctgctggatgaagatgagaagaggccctttgtggaggaggccaagaggctgcgggcccggcacctgcgggactacccagactacaagtaccggcccaggaggaaggccaagagcagtggagctggccccagccgctgtggccagggccggggcaacctggccagcggcggccccctgtggggccctggctacgccaccacccagcccagccggggcttcggctacagacctccttcctacagcacagcctacctgcccggcagctatggcagcagccactgcaagctggaggcccccagcccctgcagcctgccccagagcgacccccggctgcagggcgagctgctgcccacctacacccactacctgcccccaggcagccccaccccctacaacccccccctggccggggcccccatgcccctgacccacctgtag

SEQ ID NO: 171617 - DNA, 702 bp, Artificial Sequence; identical to SEQ ID NO: 171616
  Description of Artificial Sequence: Synthetic coding sequence

SEQ ID NO: 171618 - DNA, 1245 bp, Artificial Sequence
  Description of Artificial Sequence: Synthetic coding sequence
atgagcagcccagatgctggctacgccagtgatgaccagagccagacccagagcgccctgcctgctgtgatggccggcctgggcccctgcccctgggccgagagcctgagccccatcggggacatgaaggtgaagggggaggccccagccaacagcggggccccagctggagctgctggccgggccaagggggagagccgcatcagaagacccatgaatgccttcatggtgtgggccaaggatgagaggaagaggctggcccagcagaacccagacctgcacaatgctgagctgagcaagatgctgggcaagtcctggaaggccctgaccctggccgagaagaggccctttgtggaggaggccgagcggctgcgggtgcagcacatgcaggaccaccccaactacaagtaccggcccaggaggaggaagcaggtgaagaggctgaagagggtggagggcggcttcctgcacggcctggccgagccccaggccgccgccctgggccctgagggcggccgggtggccatggatggcctgggcctgcagtttcctgagcagggcttccctgctggcccccccctgctgcccccccacatgggcggccactacagagactgccagagcctgggcgccccacccctggatggctaccccctgcccaccccagacaccagccccctggatggagtggaccctgaccctgccttctttgctgcccccatgcctggggactgcccagctgctggcacctacagctatgcccaggtgtctgactatgccggccccccagagcccccagctggccccatgcacccccggctgggccctgagcctgctggccccagcatccctggcctgctggcccctccttctgccctgcacgtgtactatggagccatgggcagccctggagctgggggcggccggggcttccagatgcagccccagcaccagcaccagcaccagcaccagcaccaccccccaggccctggccagcccagccccccacctgaggccctgccctgcagagatggaacagaccccagccagcctgctgagctgctgggggaggtggacagaacagaatttgagcagtacctgcactttgtgtgcaagccagagatgggcctgccctaccagggccatgacagcggcgtgaacctgcctgacagccacggggccatcagctctgtggtgtctgatgccagcagcgctgtgtactactgcaactacccagatgtgtag

SEQ ID NO: 171619 - DNA, 1155 bp, Artificial Sequence
  Description of Artificial Sequence: Synthetic coding sequence
atgcagaggagccccccaggctacggggcccaggatgaccccccagcccggcgggactgtgcctgggcccctggccacggggctgctgctgacacccggggcctggccgccggccctgctgccctggccgccccagctgccccagccagcccccccagcccccagaggagcccccccaggagccctgagcccggccgctatggcctgagccctgctggccgcggggagcggcaggccgcagatgagagccgcatccggcggcccatgaatgccttcatggtgtgggccaaggatgagaggaagaggctggcccagcagaacccagacctgcacaatgctgtgctgagcaagatgctgggcaaggcctggaaggagctgaatgctgctgagaagaggccctttgtggaggaggccgagcggctgcgggtgcagcacctgcgggaccaccccaactacaagtaccggcccaggaggaagaagcaggccaggaaggcccggcggctggagcccggcctgctgctgcccggcctggccccaccccagcccccacctgagcccttccctgctgccagcggcagcgcccgggccttccgggagctgccccccctgggcgctgagtttgatggcctgggcctgcccaccccagagaggagccccctggatggcctggagcctggagaggccgccttcttccccccacctgctgcccctgaggactgtgccctgcggcccttccgggccccctatgcccccacagagctgagccgggaccccggcggctgctacggggcccccctggccgaggccctgaggacagcccccccagctgcccccctggccggcctgtactacggcaccctgggcaccccaggcccctacccaggccccctgagccccccacctgaggccccacccctggagagcgctgagcccctgggccctgctgctgacctgtgggcagatgtggacctgacagaatttgaccagtacctgaactgcagcaggaccaggccagatgcccctggcctgccctaccacgtggccctggccaagctgggcccccgggccatgagctgcccagaggagagcagcctcatcagcgccctgagtgatgccagcagcgctgtgtactacagcgcctgcatctctggatag

SEQ ID NO: 171620 - DNA, 831 bp, Artificial Sequence
  Description of Artificial Sequence: Synthetic coding sequence
atgagcaagcctgtggaccacgtgaagaggcccatgaatgccttcatggtgtggagccgggcccagaggaggaagatggcccaggagaaccccaagatgcacaacagcgagatcagcaagaggctgggcgctgagtggaagctgctgacagagagcgagaagaggcccttcattgatgaggccaagaggctgcgggccatgcacatgaaggagcacccagactacaagtaccggcccaggaggaagcccaagaccctgctgaagaaggacaagtttgccttccctgtgccctacggcctgggcggcgtggctgatgctgagcacccagccctgaaggccggggccggcctgcatgctggagctgggggcggcctggtgcctgagagcctgctggccaaccctgagaaggctgctgctgctgctgctgctgctgctgcccgggtcttcttcccccagagcgctgctgctgctgctgctgctgctgctgctgctgctgctggcagcccctacagcctgctggacctgggcagcaagatggccgagatcagcagcagcagcagcggcctgccctatgccagcagcctgggctaccccacagctggggccggggccttccacggggctgctgctgctgctgctgctgctgctgctgctgctgggggccacacccacagccaccccagccctggcaaccctggctacatgatcccctgcaactgcagcgcctggcccagccctggcctgcagccccccctggcctacatcctgctgcccggcatgggcaagccccagctggacccctacccagctgcctatgctgctgccctgtag

SEQ ID NO: 171621 - DNA, 1341 bp, Artificial Sequence
  Description of Artificial Sequence: Synthetic coding sequence
atgaggcctgtgcgggagaacagcagcggggcccggagcccccgggtgcctgctgacctggcccggagcatcctgatcagcctgcccttccccccagacagcctggcccacaggcctcccagcagcgcccccacagagagccagggcctcttcaccgtggccgccccagcccctggggcccccagccccccagccaccctggcccacctgctgcctgccccagccatgtacagcctgctggagacagagctgaagaaccctgtgggcacccccacccaggccgccggcactggaggccctgctgcccctggaggagctgggaagagcagcgccaatgctgctgggggcgccaacagcggcggcggcagcagcggcggggccagcggcggcggcggcggcacagaccaggacagagtgaagaggcccatgaatgccttcatggtgtggagccggggccagaggaggaagatggccctggagaaccccaagatgcacaacagcgagatcagcaagaggctgggcgctgactggaagctgctgacagatgctgagaagaggcccttcattgatgaggccaagaggctgcgggctgtgcacatgaaggagtacccagactacaagtaccggcccaggaggaagaccaagaccctgctgaagaaggacaagtacagcctgcccagcggcctgctgcccccaggagctgctgctgctgctgctgctgctgctgctgctgctgctgctgccagcagccctgtgggcgtgggccagaggctggacacctacacccacgtgaatggctgggccaatggagcctacagcctggtgcaggagcagctgggctacgcccagccccccagcatgagcagccccccacctcctccagccctgccccccatgcacagatatgacatggccggcctgcagtacagccccatgatgcctcctggggcccagagctacatgaatgtggccgctgctgctgctgctgccagcggctatggaggcatggcccccagcgccacagctgctgctgctgctgcctacggccagcagcctgccacagctgctgctgctgctgctgctgctgctgccatgagcctgggccccatgggctctgtggtgaagtctgagcccagcagccccccaccagccatcgccagccacagccagagggcctgcctgggggacctgcgggacatgatctccatgtacctgcccccaggaggagatgctgctgatgctgccagccccctgcccggcggccgcctgcacggcgtgcaccagcactaccagggcgccggcacagctgtgaatggcaccgtgcccctgacccacatctag

SEQ ID NO: 171622 - DNA, 2253 bp, Artificial Sequence
  Description of Artificial Sequence: Synthetic coding sequence
atgagcagcaagaggcctgccagcccctacggggaggctgatggagaggtggccatggtgaccagccggcagaaggtggaggaggaggagagtgatggcctgcctgccttccacctgcccctgcacgtgtccttccccaacaagccccacagcgaggagttccagcctgtgtccctgctgacccaggagacctgtggccacaggacccccaccagccagcacaacaccatggaggtggatggcaacaaggtgatgagcagctttgccccccacaacagcagcaccagcccccagaaggccgaggagggcggccggcagagcggggagagcctgagcagcacagccctgggcaccccagagaggaggaagggcagcctggctgatgtggtggacaccctgaagcagaggaagatggaggagctgatcaagaatgaacctgaggagacccccagcattgagaagctgctgagcaaggactggaaggacaagctgctggccatgggcagcggcaactttggagagatcaagggcaccccagagagcctggccgagaaggagcggcagctgatgggcatgatcaaccagctgaccagcctgcgggagcagctgctggccgcccatgatgagcagaagaagctggccgccagccagatcgagaagcagaggcagcagatggagctggccaagcagcagcaggagcagatcgcccggcagcagcagcagctgctgcagcagcagcacaagatcaacctgctgcagcagcagatccaggtgcagggccagctgccccccctgatgatccctgtgtttcctccagaccagaggaccctggccgccgccgcccagcagggcttcctgctgcccccaggcttctcctacaaggccggctgcagcgacccctaccctgtgcagctgatccccaccaccatggctgctgctgctgctgccaccccaggcctgggccccctgcagctgcagcagctgtatgctgcccagctggccgccatgcaggtgtcccctgggggcaagctgcccggcatcccccagggcaacctgggcgctgctgtgagccccaccagcatccacacagacaagagcaccaacagccccccacccaagagcaaggatgaggtggcccagcccctgaacctgagcgccaagcccaagaccagtgatggcaagagccccaccagccccaccagcccccacatgcctgccctgcgcatcaacagcggggccggccccctgaaggcctctgtgcctgctgccctggccagccccagcgcccgggtgtccaccatcggctacctgaatgaccatgatgctgtgaccaaggccatccaggaggcccggcagatgaaggagcagctgcggcgggagcagcaggtgctggatggcaaggtggccgtggtgaacagcctgggcctgaacaactgcaggacagagaaggagaagaccaccctggagagcctgacccagcagctggccgtgaagcagaatgaggagggcaagttcagccacgccatgatggacttcaacctgagcggggacagtgatggcagcgctggggtgtctgagagccgcatctaccgggagagccggggccggggcagcaatgagccccacatcaagaggcccatgaatgccttcatggtgtgggccaaggatgagaggaggaagatcctgcaggccttcccagacatgcacaacagcaacatcagcaagatcctgggcagccgctggaaggccatgaccaacctggagaagcagccctactatgaggagcaggcccggctgagcaagcagcacctggagaagtacccagactacaagtacaagccccggcccaagaggacctgcctggtggatggcaagaagctgagaattggagagtacaaggccatcatgaggaacagacggcaggagatgaggcagtacttcaacgtgggccagcaggcccagatccccatcgccacagctggggtggtgtacccaggggccatcgccatggccggcatgcccagcccccacctgcccagcgagcacagctctgtgagcagcagccctgagcccggcatgcctgtgatccagagcacctacggcgtgaagggggaggagccccacatcaaggaggagatccaggccgaggacatcaatggagagatctatgatgaatatgatgaggaggaggatgatcctgatgtggactatggcagtgacagcgagaaccacatcgccggccaggccaactag

SEQ ID NO: 171623 - DNA, 1929 bp, Artificial Sequence
  Description of Artificial Sequence: Synthetic coding sequence
atgagcagcaagaggcctgccagcccctacggggaggctgatggagaggtggccatggtgaccagccggcagaaggtggaggaggaggagagtgatggcctgcctgccttccacctgcccctgcacgtgtccttccccaacaagccccacagcgaggagttccagcctgtgtccctgctgacccaggagacctgtggccacaggacccccaccagccagcacaacaccatggaggtggatggcaacaaggtgatgagcagctttgccccccacaacagcagcaccagcccccagaaggccgaggagggcggccggcagagcggggagagcctgagcagcacagccctgggcaccccagagaggaggaagggcagcctggctgatgtggtggacaccctgaagcagaggaagatggaggagctgatcaagaatgaacctgaggagacccccagcattgagaagctgctgagcaaggactggaaggacaagctgctggccatgggcagcggcaactttggagagatcaagggcaccccagagagcctggccgagaaggagcggcagctgatgggcatgatcaaccagctgaccagcctgcgggagcagctgctggccgcccatgatgagcagaagaagctggccgccagccagatcgagaagcagaggcagcagatggagctggccaagcagcagcaggagcagatcgcccggcagcagcagcagctgctgcagcagcagcacaagatcaacctgctgcagcagcagatccaggtgcagggccagctgccccccctgatgatccctgtgtttcctccagaccagaggaccctggccgccgccgcccagcagggcttcctgctgcccccaggcttctcctacaaggccggctgcagcgacccctaccctgtgcagctgatccccaccaccatggctgctgctgctgctgccaccccaggcctgggccccctgcagctgcagcagctgtatgctgcccagctggccgccatgcaggtgtcccctgggggcaagctgcccggcatcccccagggcaacctgggcgctgctgtgagccccaccagcatccacacagacaagagcaccaacagccccccacccaagagcaaggagaagaccaccctggagagcctgacccagcagctggccgtgaagcagaatgaggagggcaagttcagccacgccatgatggacttcaacctgagcggggacagtgatggcagcgctggggtgtctgagagccgcatctaccgggagagccggggccggggcagcaatgagccccacatcaagaggcccatgaatgccttcatggtgtgggccaaggatgagaggaggaagatcctgcaggccttcccagacatgcacaacagcaacatcagcaagatcctgggcagccgctggaaggccatgaccaacctggagaagcagccctactatgaggagcaggcccggctgagcaagcagcacctggagaagtacccagactacaagtacaagccccggcccaagaggacctgcctggtggatggcaagaagctgagaattggagagtacaaggccatcatgaggaacagacggcaggagatgaggcagtacttcaacgtgggccagcaggcccagatccccatcgccacagctggggtggtgtacccaggggccatcgccatggccggcatgcccagcccccacctgcccagcgagcacagctctgtgagcagcagccctgagcccggcatgcctgtgatccagagcacctacggcgtgaagggggaggagccccacatcaaggaggagatccaggccgaggacatcaatggagagatctatgatgaatatgatgaggaggaggatgatcctgatgtggactatggcagtgacagcgagaaccacatcgccggccaggccaactag

SEQ ID NO: 171624 - DNA, 1134 bp, Artificial Sequence
  Description of Artificial Sequence: Synthetic coding sequence
atgcatgatgaggtggcccagcccctgaacctgagcgccaagcccaagaccagtgatggcaagagccccaccagccccaccagcccccacatgcctgccctgcgcatcaacagcggggccggccccctgaaggcctctgtgcctgctgccctggccagccccagcgcccgggtgtccaccatcggctacctgaatgaccatgatgctgtgaccaaggccatccaggaggcccggcagatgaaggagcagctgcggcgggagcagcaggtgctggatggcaaggtggccgtggtgaacagcctgggcctgaacaactgcaggacagagaaggagaagaccaccctggagagcctgacccagcagctggccgtgaagcagaatgaggagggcaagttcagccacgccatgatggacttcaacctgagcggggacagtgatggcagcgctggggtgtctgagagccgcatctaccgggagagccggggccggggcagcaatgagccccacatcaagaggcccatgaatgccttcatggtgtgggccaaggatgaaagaaggaagatcctgcaggccttcccagacatgcacaacagcaacatcagcaagatcctgggcagccgctggaaggccatgaccaacctggagaagcagccctactatgaggagcaggcccggctgagcaagcagcacctggagaagtacccagactacaagtacaagccccggcccaagaggacctgcctggtggatggcaagaagctgcgcatcggggagtacaaggccatcatgaggaacagacggcaggagatgaggcagtacttcaacgtgggccagcaggcccagatccccatcgccacagctggggtggtgtacccaggggccatcgccatggccggcatgcccagcccccacctgcccagcgagcacagctctgtgagcagcagccctgagcccggcatgcctgtgatccagagcacctatggagtgaagggggaggagccccacatcaaggaggagatccaggccgaggacatcaacggggagatctatgatgaatatgatgaggaggaggatgatcctgatgtggactatggcagtgacagcgagaaccacatcgccggccaggccaactag

SEQ ID NO: 171625 - DNA, 1764 bp, Artificial Sequence
  Description of Artificial Sequence: Synthetic coding sequence
atgagcagcaagaggcctgccagcccctacggggaggctgatggagaggtggccatggtgaccagccggcagaaggtggaggaggaggagagtgatggcctgcctgccttccacctgcccctgcacgaggtggatggcaacaaggtgatgagcagctttgccccccacaacagcagcaccagcccccagaaggccgaggagggcggccggcagagcggggagagcctgagcagcacagccctgggcaccccagagaggaggaagggcagcctggctgatgtggtggacaccctgaagcagaggaagatggaggagctgatcaagaatgaacctgaggagacccccagcattgagaagctgctgagcaaggactggaaggacaagctgctggccatgggcagcggcaactttggagagatcaagggcaccccagagagcctggccgagaaggagcggcagctgatgggcatgatcaaccagctgaccagcctgcgggagcagctgctggccgcccatgatgagcagaagaagctggccgccagccagatcgagaagcagaggcagcagatggagctggccaagcagcagcaggagcagatcgcccggcagcagcagcagctgctgcagcagcagcacaagatcaacctgctgcagcagcagatccaggtgcagggccagctgccccccctgatgatccctgtgttccccccagaccagaggaccctggccgctgctgcccagcagggcttcctgctgcccccaggcttctcctacaaggccggctgcagcgacccctaccctgtgcagctgatccccaccaccatggctgctgctgctgctgccaccccaggcctgggccccctgcagctgcagcagctgtatgctgcccagctggccgccatgcaggtgtccccaggcggcaagctgcccggcatcccccagggcaacctgggcgctgctgtgagccccaccagcatccacacagacaagagcaccaacagccccccacccaagagcaaggatgaggtggcccagcccctgaacctgagcgccaagcccaagaccagtgatggcaagagccccaccagccccaccagcccccacatgcctgccctgcgcatcaacagcggggccggccccctgaaggcctctgtgcctgctgccctggccagccccagcgcccgggtgtccaccatcggctacctgaatgaccatgatgctgtgaccaaggccatccaggaggcccggcagatgaaggagcagctgcggcgggagcagcaggtgctggatggcaaggtggccgtggtgaacagcctgggcctgaacaactgcaggacagagaaggagaagaccaccctggagagcctgacccagcagctggccgtgaagcagaatgaggagggcaagttcagccacgccatgatggacttcaacctgagcggggacagtgatggcagcgctggggtgtctgagagccgcatctaccgggagagccggggccggggcagcaatgagccccacatcaagaggcccatgaatgccttcatggtgtgggccaaggatgaaagaaggaagatcctgcaggccttcccagacctgggcttcctgtgtgtgtgcatgtatgtgatcatggtgctgatcatcggcatcaccctggaccactgtgagctgaacccccacctgggcatgaagagccacatcctgcccagcgactggagcaggaacaacctggacctggactttgccctgcagatgaccacctag

SEQ ID NO: 171626 - DNA, 2292 bp, Artificial Sequence
  Description of Artificial Sequence: Synthetic coding sequence
atgctgacagatcctgacctgccccaggagtttgagaggatgagcagcaagaggcctgccagcccctatggagaggctgatggagaggtggccatggtgaccagccggcagaaggtggaggaggaggagagtgatggcctgcctgccttccacctgcccctgcacgtgtccttccccaacaagccccacagcgaggagttccagcctgtgtccctgctgacccaggagacctgtggccacaggacccccaccagccagcacaacaccatggaggtggatggcaacaaggtgatgagcagctttgccccccacaacagcagcaccagcccccagaaggccgaggagggcggccggcagagcggggagagcctgagcagcacagccctgggcaccccagagaggaggaagggcagcctggctgatgtggtggacaccctgaagcagaggaagatggaggagctgatcaagaatgaacctgaggagacccccagcattgagaagctgctgagcaaggactggaaggacaagctgctggccatgggcagcggcaactttggagagatcaagggcaccccagagagcctggccgagaaggagcggcagctgatgggcatgatcaaccagctgaccagcctgcgggagcagctgctggccgcccatgatgagcagaagaagctggccgccagccagatcgagaagcagaggcagcagatggagctggccaagcagcagcaggagcagatcgcccggcagcagcagcagctgctgcagcagcagcacaagatcaacctgctgcagcagcagatccaggtgcagggccagctgccccccctgatgatccctgtgttccccccagaccagaggaccctggccgctgctgcccagcagggcttcctgctgcccccaggcttctcctacaaggccggctgcagcgacccctaccctgtgcagctgatccccaccaccatggctgctgctgctgctgccaccccaggcctgggccccctgcagctgcagcagctgtatgctgcccagctggccgccatgcaggtgtccccaggcggcaagctgcccggcatcccccagggcaacctgggcgctgctgtgagccccaccagcatccacacagacaagagcaccaacagccccccacccaagagcaaggatgaggtggcccagcccctgaacctgagcgccaagcccaagaccagtgatggcaagagccccaccagccccaccagcccccacatgcctgccctgcgcatcaacagcggggccggccccctgaaggcctctgtgcctgctgccctggccagccccagcgcccgggtgtccaccatcggctacctgaatgaccatgatgctgtgaccaaggccatccaggaggcccggcagatgaaggagcagctgcggcgggagcagcaggtgctggatggcaaggtggccgtggtgaacagcctgggcctgaacaactgcaggacagagaaggagaagaccaccctggagagcctgacccagcagctggccgtgaagcagaatgaggagggcaagttcagccacgccatgatggacttcaacctgagcggggacagtgatggcagcgctggggtgtctgagagccgcatctaccgggagagccggggccggggcagcaatgagccccacatcaagaggcccatgaatgccttcatggtgtgggccaaggatgaaagaaggaagatcctgcaggccttcccagacatgcacaacagcaacatcagcaagatcctgggcagccgctggaaggccatgaccaacctggagaagcagccctactatgaggagcaggcccggctgagcaagcagcacctggagaagtacccagactacaagtacaagccccggcccaagaggacctgcctggtggatggcaagaagctgcgcatcggggagtacaaggccatcatgaggaacagacggcaggagatgaggcagtacttcaacgtgggccagcaggcccagatccccatcgccacagctggggtggtgtacccaggggccatcgccatggccggcatgcccagcccccacctgcccagcgagcacagctctgtgagcagcagccctgagcccggcatgcctgtgatccagagcacctatggagtgaagggggaggagccccacatcaaggaggagatccaggccgaggacatcaacggggagatctatgatgaatatgatgaggaggaggatgatcctgatgtggactatggcagtgacagcgagaaccacatcgccggccaggccaactag

SEQ ID NO: 171627 - DNA, 1929 bp, Artificial Sequence; identical to SEQ ID NO: 171623
  Description of Artificial Sequence: Synthetic coding sequence

SEQ ID NO: 171628 - DNA, 2253 bp, Artificial Sequence; identical to SEQ ID NO: 171622
  Description of Artificial Sequence: Synthetic coding sequence

SEQ ID NO: 171629 - DNA, 2427 bp, Artificial Sequence
  Description of Artificial Sequence: Synthetic coding sequence
atgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatggagagcgagaacaacaagctgtgcagcctgtacagcttcaggaacaccagcaccagcccccacaagccagatgagggcagccgggaccgggagatcatgacctctgtgaccttcggcaccccagagaggaggaagggcagcctggctgatgtggtggacaccctgaagcagaagaagctggaggagatgaccaggacagagcaggaggacagcagctgcatggagaagctgctgagcaaggactggaaggagaagatggagcggctgaacaccagcgagctgctgggggagatcaagggcaccccagagagcctggccgagaaggagcggcagctgagcaccatgatcacccagctgatcagcctgcgggagcagctgctggccgcccatgatgagcagaagaagctggccgccagccagatcgagaagcagaggcagcagatggacctggcccggcagcagcaggagcagatcgcccggcagcagcagcagctgctgcagcagcagcacaagatcaacctgctgcagcagcagatccaggtgcagggccacatgccacccctgatgatccccatcttcccccatgaccagaggaccctggccgctgctgctgctgcccagcagggcttcctgttccccccaggcatcacctacaagccaggggacaactaccctgtgcagttcatccccagcaccatggctgctgctgctgccagcggcctgagccccctgcagctgcagaagggccacgtgagccacccccagatcaaccagaggctgaagggcctgagtgaccgcttcggcaggaacctggacacctttgaacatggaggcggccacagctacaaccacaagcagatcgagcagctgtatgctgcccagctggcctccatgcaggtgtcccctggggccaagatgcccagcaccccccagccccccaacacagctggcaccgtgagccccaccggcatcaagaatgagaagaggggcaccagccctgtgacccaggtgaaggatgaggccgccgcccagcccctgaacctgagcagccggcccaagacagctgagcctgtgaagagccccaccagccccacccagaacctcttccctgccagcaagaccagccctgtgaacctgcccaacaagagcagcatccccagccccatcggcggcagcctgggccggggcagcagcctggacatcctgagcagcctgaacagccctgccctgtttggagaccaggacacagtgatgaaggccatccaggaggccaggaagatgagggagcagatccagcgggagcagcagcagcagcagccccacggcgtggatggcaagctgagcagcatcaacaacatgggcctgaacagctgcagaaatgagaaggagaggaccaggtttgagaacctgggcccccagctgaccgggaagagcaatgaagatggcaagctgggccctggggtcatcgacctgaccaggccagaagatgctgagggcggggccaccgtggccgaggcccgggtgtacagagatgcccggggccgggccagcagcgagccccacatcaagaggcccatgaatgccttcatggtgtgggccaaggatgagaggaggaagatcctgcaggccttcccagacatgcacaacagcaacatcagcaagatcctgggcagccgctggaagtccatgagcaaccaggagaagcagccctactatgaggagcaggcccggctgagcaagatccacctggagaagtaccccaactacaagtacaagccccggcccaagaggacctgcatcgtggatggcaagaagctgagaattggagagtacaagcagctgatgaggagccggcggcaggagatgaggcagttcttcaccgtgggccagcagccccagatccccatcaccactggaactggagtggtgtacccaggggccatcaccatggccaccaccacccccagcccccagatgaccagtgactgcagcagcaccagcgccagccctgagcccagcctgcccgtcatccagagcacctacggcatgaagacagatggcggcagcctggccggaaatgagatgatcaacggggaggatgagatggagatgtatgatgattatgaagatgaccccaagagtgactacagcagtgaaaatgaggcccctgaggccgtgtctgccaactag

SEQ ID NO: 171630 - DNA, 2487 bp, Artificial Sequence
  Description of Artificial Sequence: Synthetic coding sequence
atgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatggagagcgagaacaacaagctgtgcagcctgtacagcttcaggaacaccagcaccagcccccacaagccagatgagggcagccgggaccgggagatcatgacctctgtgaccttcggcaccccagagaggaggaagggcagcctggctgatgtggtggacaccctgaagcagaagaagctggaggagatgaccaggacagagcaggaggacagcagctgcatggagaagctgctgagcaaggactggaaggagaagatggagcggctgaacaccagcgagctgctgggggagatcaagggcaccccagagagcctggccgagaaggagcggcagctgagcaccatgatcacccagctgatcagcctgcgggagcagctgctggccgcccatgatgagcagaagaagctggccgccagccagatcgagaagcagaggcagcagatggacctggcccggcagcagcaggagcagatcgcccggcagcagcagcagctgctgcagcagcagcacaagatcaacctgctgcagcagcagatccaggtgcagggccacatgccacccctgatgatccccatcttcccccatgaccagaggaccctggccgctgctgctgctgcccagcagggcttcctgttccccccaggcatcacctacaagccaggggacaactaccctgtgcagttcatccccagcaccatggctgctgctgctgccagcggcctgagccccctgcagctgcagaagggccacgtgagccacccccagatcaaccagaggctgaagggcctgagtgaccgcttcggcaggaacctggacacctttgaacatggaggcggccacagctacaaccacaagcagatcgagcagctgtatgctgcccagctggcctccatgcaggtgtcccctggggccaagatgcccagcaccccccagccccccaacacagctggcaccgtgagccccaccggcatcaagaatgagaagaggggcaccagccctgtgacccaggtgaaggatgaggccgccgcccagcccctgaacctgagcagccggcccaagacagctgagcctgtgaagagccccaccagccccacccagaacctcttccctgccagcaagaccagccctgtgaacctgcccaacaagagcagcatccccagccccatcggcggcagcctgggccggggcagcagcctggacatcctgagcagcctgaacagccctgccctgtttggagaccaggacacagtgatgaaggccatccaggaggccaggaagatgagggagcagatccagcgggagcagcagcagcagcagccccacggcgtggatggcaagctgagcagcatcaacaacatgggcctgaacagctgcagaaatgagaaggagaggaccaggtttgagaacctgggcccccagctgaccgggaagagcaatgaagatggcaagctgggccctggggtcatcgacctgaccaggccagaagatgctgagggcagcaaggccatgaatggatctgctgccaagctgcagcagtactactgctggcccactggaggagccaccgtggccgaggcccgggtgtacagagatgcccggggccgggccagcagcgagccccacatcaagaggcccatgaatgccttcatggtgtgggccaaggatgagaggaggaagatcctgcaggccttcccagacatgcacaacagcaacatcagcaagatcctgggcagccgctggaagtccatgagcaaccaggagaagcagccctactatgaggagcaggcccggctgagcaagatccacctggagaagtaccccaactacaagtacaagccccggcccaagaggacctgcatcgtggatggcaagaagctgagaattggagagtacaagcagctgatgaggagccggcggcaggagatgaggcagttcttcaccgtgggccagcagccccagatccccatcaccactggaactggagtggtgtacccaggggccatcaccatggccaccaccacccccagcccccagatgaccagtgactgcagcagcaccagcgccagccctgagcccagcctgcccgtcatccagagcacctacggcatgaagacagatggcggcagcctggccggaaatgagatgatcaacggggaggatgagatggagatgtatgatgattatgaagatgaccccaagagtgactacagcagtgaaaatgaggcccctgaggccgtgtctgccaactag

SEQ ID NO: 171631 - DNA, 2427 bp, Artificial Sequence; identical to SEQ ID NO: 171629
  Description of Artificial Sequence: Synthetic coding sequence

SEQ ID NO: 171632 - DNA, 420 bp, Artificial Sequence
  Description of Artificial Sequence: Synthetic coding sequence
atgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatggagagcgagaacaacaagctgtgcagcctgtacagcttcaggaacaccagcaccagcccccacaagccagatgagggcagccgggaccgggagatcatgacctctgtgaccttcggcaccccagagaggaggaagggcagcctggctgatgtggtggacaccctgaagcagaagaagctgtag

SEQ ID NO: 171633 - DNA, 2406 bp, Artificial Sequence
  Description of Artificial Sequence: Synthetic coding sequence
atgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatggagagcgagaacaacaagctgtgcagcctgtacagcttcaggaacaccagcaccagcccccacaagccagatgagggcagccgggaccgggagatcatgacctctgtgaccttcggcaccccagagaggaggaagggcagcctggctgatgtggtggacaccctgaagcagaagaagctggaggagatgaccaggacagagcaggaggacagcagctgcatggagaagctgctgagcaaggactggaaggagaagatggagcggctgaacaccagcgagctgctgggggagatcaagggcaccccagagagcctggccgagaaggagcggcagctgagcaccatgatcacccagctgatcagcctgcgggagcagctgctggccgcccatgatgagcagaagaagctggccgccagccagatcgagaagcagaggcagcagatggacctggcccggcagcagcaggagcagatcgcccggcagcagcagcagctgctgcagcagcagcacaagatcaacctgctgcagcagcagatccaggtgcagggccacatgccacccctgatgatccccatcttcccccatgaccagaggaccctggccgctgctgctgctgcccagcagggcttcctgttccccccaggcatcacctacaagccaggggacaactaccctgtgcagttcatccccagcaccatggctgctgctgctgccagcggcctgagccccctgcagctgcagcagctgtatgctgcccagctggcctccatgcaggtgtcccctggggccaagatgcccagcaccccccagccccccaacacagctggcaccgtgagccccaccggcatcaagaatgagaagaggggcaccagccctgtgacccaggtgaaggatgaagctgctgcccagcccctgaacctgagcagccggcccaagacagctgagcctgtgaagagccccaccagccccacccagaacctcttccctgccagcaagaccagccctgtgaacctgcccaacaagagcagcatccccagccccatcggcggcagcctgggccggggcagcagcctgggcaagtggaagagccagcaccaggaggagacctatgagctggacatcctgagcagcctgaacagccctgccctgtttggagaccaggacacagtgatgaaggccatccaggaggccaggaagatgagggagcagatccagcgggagcagcagcagcagcagccccatggagtggatggcaagctgagcagcatcaacaacatgggcctgaacagctgcagaaatgagaaggagaggaccaggtttgagaacctgggcccccagctgaccgggaagagcaatgaagatggcaagctgggccctggggtgattgacctgaccaggccagaagatgctgagggcagcaaggccatgaatggcagcgctgccaagctgcagcagtactactgctggcccaccggcggggccaccgtggccgaggcccgggtgtacagagatgcccggggccgggccagcagcgagccccacatcaagaggcccatgaatgccttcatggtgtgggccaaggatgaaagaaggaagatcctgcaggccttcccagacatgcacaacagcaacatcagcaagatcctgggcagccgctggaagtccatgagcaaccaggagaagcagccctactatgaggagcaggcccggctgagcaagatccacctggagaagtaccccaactacaagtacaagccccggcccaagaggacctgcatcgtggatggcaagaagctgcgcatcggggagtacaagcagctgatgaggagccggcggcaggagatgaggcagttcttcaccgtgggccagcagccccagatccccatcaccaccggcaccggggtggtgtacccaggggccatcaccatggccaccaccacccccagcccccagatgaccagtgactgcagcagcaccagcgccagccctgagcccagcctgcctgtgatccagagcacctacggcatgaagacagatggcggcagcctggccggaaatgagatgatcaatggagaagatgagatggagatgtatgatgattatgaagatgaccccaagagtgactacagcagtgaaaatgaggcccctgaggccgtgtctgccaactag

SEQ ID NO: 171634 - DNA, 2487 bp, Artificial Sequence; identical to SEQ ID NO: 171630
  Description of Artificial Sequence: Synthetic coding sequence

SEQ ID NO: 171635 - DNA, 240 bp, Artificial Sequence
  Description of Artificial Sequence: Synthetic coding sequence
atgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatgtag

SEQ ID NO: 171636 - DNA, 480 bp, Artificial Sequence
  Description of Artificial Sequence: Synthetic coding sequence
atgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatggagagcgagaacaacaagctgtgcagcctgtacagcttcaggaacaccagcaccagcccccacaagccagatgagggcagccgggaccgggagatcatgacctctgtgaccttcggcaccccagagaggaggaagggcagcctggctgatgtggtggacaccctgaagcagaagaagctggaggagatgaccaggacagagcaggaggacagcagctgcatggagaagctgctgagcaagtag

SEQ ID NO: 171637 - DNA, 2415 bp, Artificial Sequence
  Description of Artificial Sequence: Synthetic coding sequence
atgggccgcatgagcagcaagcaggccaccagcccctttgcctgtgccgcagatggagaagatgccatgacccaggacctgaccagccgggagaaggaggagggcagtgaccagcacgtggccagccacctgcccctgcaccccatcatgcacaacaagccccacagcgaggagctgcccaccctggtgtccaccatccagcaggatgctgactgggacagcgtgctgagcagccagcagaggatggagagcgagaacaacaagctgtgcagcctgtacagcttcaggaacaccagcaccagcccccacaagccagatgagggcagccgggaccgggagatcatgacctctgtgaccttcggcaccccagagaggaggaagggcagcctggctgatgtggtggacaccctgaagcagaagaagctggaggagatgaccaggacagagcaggaggacagcagctgcatggagaagctgctgagcaaggactggaaggagaagatggagcggctgaacaccagcgagctgctgggggagatcaagggcaccccagagagcctggccgagaaggagcggcagctgagcaccatgatcacccagctgatcagcctgcgggagcagctgctggccgcccatgatgagcagaagaagctggccgccagccagatcgagaagcagaggcagcagatggacctggcccggcagcagcaggagcagatcgcccggcagcagcagcagctgctgcagcagcagcacaagatcaacctgctgcagcagcagatccaggtgcagggccacatgccacccctgatgatccccatcttcccccatgaccagaggaccctggccgctgctgctgctgcccagcagggcttcctgtttcctcctggcatcacctacaagccaggggacaactaccctgtgcagttcatccccagcaccatggctgctgctgctgccagcggcctgagccccctgcagctgcagcagctgtatgctgcccagctggcctccatgcaggtgtcccctggggccaagatgcccagcaccccccagccccccaacacagctggcaccgtgagccccaccggcatcaagaatgagaagaggggcaccagccctgtgacccaggtgaaggatgaggccgccgcccagcccctgaacctgagcagccggcccaagacagctgagcctgtgaagagccccaccagccccacccagaacctcttccctgccagcaagaccagccctgtgaacctgcccaacaagagcagcatccccagccccatcggcggcagcctgggccggggcagcagcctgggcaagtggaagagccagcaccaggaggagacctatgagctggacatcctgagcagcctgaacagccctgccctgtttggagaccaggacacagtgatgaaggccatccaggaggccaggaagatgagggagcagatccagcgggagcagcagcagcagcagccccacggcgtggatggcaagctgagcagcatcaacaacatgggcctgaacagctgcagaaatgagaaggagaggaccaggtttgagaacctgggcccccagctgaccgggaagagcaatgaagatggcaagctgggccctggggtcatcgacctgaccaggccagaagatgctgagggcagcaaggccatgaatggatctgctgccaagctgcagcagtactactgctggcccactggaggagccaccgtggccgaggcccgggtgtacagagatgcccggggccgggccagcagcgagccccacatcaagaggcccatgaatgccttcatggtgtgggccaaggatgagaggaggaagatcctgcaggccttcccagacatgcacaacagcaacatcagcaagatcctgggcagccgctggaagtccatgagcaaccaggagaagcagccctactatgaggagcaggcccggctgagcaagatccacctggagaagtaccccaactacaagtacaagccccggcccaagaggacctgcatcgtggatggcaagaagctgagaattggagagtacaagcagctgatgaggagccggcggcaggagatgaggcagttcttcaccgtgggccagcagccccagatccccatcaccactggaactggagtggtgtacccaggggccatcaccatggccaccaccacccccagcccccagatgaccagtgactgcagcagcaccagcgccagccctgagcccagcctgcccgtcatccagagcacctacggcatgaagacagatggcggcagcctggccggaaatgagatgatcaacggggaggatgagatggagatgtatgatgattatgaagatgaccccaagagtgactacagcagtgaaaatgaggcccctgaggccgtgtctgccaactag

SEQ ID NO: 171638 - DNA, 1167 bp, Artificial Sequence
  Description of Artificial Sequence: Synthetic coding sequence
atggccagcctgctgggcgcctacccctggccagagggcctggagtgcccagccctggatgctgagctgagtgatggccagagccccccagctgtgcccaggcctcctggggacaagggcagcgagagccgcatccggcggcccatgaatgccttcatggtgtgggccaaggatgagaggaagaggctggccgtgcagaacccagacctgcacaatgctgagctgagcaagatgctgggcaagtcctggaaggccctgaccctgagccagaagaggccctacgtggatgaggccgagcggctgcggctgcagcacatgcaggactaccccaactacaagtaccggcccaggaggaagaagcaggccaagaggctgtgcaagagggtggaccccggcttcctgctgagcagcctgagccgggaccagaatgccctgcctgagaagaggagcggcagcagaggagccctgggggagaaggaggacagaggagagtacagccctggaacagccctgcccagcctgcggggctgctaccacgagggccctgctgggggcggcggcggcggcacccccagctctgtggacacctacccctacggcctgcccaccccacctgagatgagccccctggatgtgctggagcctgagcagaccttcttcagcagcccctgccaggaggagcacggccacccccggcgcatcccccacctgcccggccacccctacagcccagaatatgcccccagccccctgcactgcagccaccccctgggcagcctggccctgggccagagccctggggtgtccatgatgagccctgtgcccggctgcccccccagccctgcctactacagccctgccacctaccaccccctgcacagcaacctgcaggcccacctgggccagctgagccccccacctgagcaccctggctttgatgccctggaccagctgagccaggtggagctgctgggggacatggacagaaatgaatttgaccagtacctgaacaccccaggccacccagacagcgccaccggggccatggccctgagcggccacgtgcctgtgtcccaggtgacccccaccggccccacagagaccagcctcatctctgtgctggctgatgccacagccacctactacaacagctacagcgtgtcctag

SEQ ID NO: 171639 - DNA, 1323 bp, Artificial Sequence
  Description of Artificial Sequence: Synthetic coding sequence
atgtccatgctggccgagaggaggaggaagcagaagtgggccgtggacccccagaacacagcctggagcaatgatgacagcaagtttggccagaggatgctggagaagatgggctggagcaagggcaagggcctgggcgcccaggagcagggcgccacagaccacatcaaggtgcaggtgaagaacaaccacctgggcctgggcgccaccatcaacaatgaagacaactggatcgcccaccaggatgacttcaaccagctgctggccgagctgaacacctgccacggccaggagaccacagacagcagtgacaagaaggagaagaagagcttcagcctggaggagaagagcaagatcagcaagaacagagtgcactacatgaagttcaccaagggcaagtcctggaaggccctgaccctgagccagaagaggccctacgtggatgaggccgagcggctgcggctgcagcacatgcaggactaccccaactacaagtaccggcccaggaggaagaagcaggccaagaggctgtgcaagagggtggaccccggcttcctgctgagcagcctgagccgggaccagaatgccctgcctgagaagaggagcggcagcagaggagccctgggggagaaggaggacagaggagagtacagccctggaacagccctgcccagcctgcggggctgctaccacgagggccctgctgggggcggcggcggcggcacccccagctctgtggacacctacccctacggcctgcccaccccacctgagatgagccccctggatgtgctggagcctgagcagaccttcttcagcagcccctgccaggaggagcacggccacccccggcgcatcccccacctgcccggccacccctacagcccagaatatgcccccagccccctgcactgcagccaccccctgggcagcctggccctgggccagagccctggggtgtccatgatgagccctgtgcccggctgcccccccagccctgcctactacagccctgccacctaccaccccctgcacagcaacctgcaggcccacctgggccagctgagccccccacctgagcaccctggctttgatgccctggaccagctgagccaggtggagctgctgggggacatggacagaaatgaatttgaccagtacctgaacaccccaggccacccagacagcgccaccggggccatggccctgagcggccacgtgcctgtgtcccaggtgacccccaccggccccacagagaccagcctcatctctgtgctggctgatgccacagccacctactacaacagctacagcgtgtcctag

SEQ ID NO: 171640 - DNA, 1341 bp, Artificial Sequence
  Description of Artificial Sequence: Synthetic coding sequence
atgctggacatgtctgaggcccggagccagcccccctgcagccccagcggcacagccagctccatgagccacgtggaggacagcgacagtgatgccccacccagccctgctggcagcgagggcctgggccgggccggcgtggccgtgggcggggcccggggggaccctgctgaggccgcagatgagcgcttccctgcctgcatcagagatgctgtgtcccaggtgctgaagggctatgactggagcctggtgcccatgcctgtgcggggcggcggcggcggggccctgaaggccaagccccacgtgaagaggcccatgaatgccttcatggtgtgggcccaggccgcccggaggaagctggccgaccagtacccccacctgcacaatgctgagctgagcaagaccctgggcaagctgtggaggctgctgtctgagagcgagaagaggccctttgtggaggaggccgagcggctgcgggtgcagcacaagaaggaccacccagactacaagtaccagcccaggaggaggaagagcgccaaggccggccacagcgacagcgacagcggggctgagctgggcccccaccctgggggcggcgctgtgtacaaggccgaggccggcctgggagatggccaccaccacggggaccacacaggccagacccacggcccccccaccccacccaccacccccaagacagagctgcagcaggccggggccaagccagagctgaagctggagggcagaagacctgtggacagcggccggcagaacatcgacttcagcaatgtggacatcagcgagctgagcagcgaggtgatgggcaccatggatgcctttgatgtgcatgaatttgaccagtacctgcccctgggcggccctgcccctcctgagcccggccaggcctatggaggagcctacttccacgccggggccagccctgtgtgggcccacaagagcgcccccagcgccagcgccagccccacagaaacaggccccccccggccccacatcaagacagagcagcccagccctggccactacggggaccagccccggggcagcccagactatggcagctgcagcggccagagcagcgccaccccagctgccccagctggcccctttgctggcagccagggcgactatggagacctgcaggccagcagctactacggggcctacccaggctacgcccctggcctgtaccagtacccctgcttccacagcccccggcggccctatgccagccccctgctgaatggcctggccctgcccccagcccacagccccaccagccactgggaccagcctgtgtacaccaccctgacccggccctag

SEQ ID NO: 171641 - DNA, 1530 bp, Artificial Sequence
  Description of Artificial Sequence: Synthetic coding sequence
atgaacctgctggaccccttcatgaagatgacagatgagcaggagaagggcctgagcggggcccccagccccaccatgtctgaggacagcgctggcagcccctgccccagcggcagcggcagtgacacagagaacacccggccccaggagaacaccttccccaagggggagccagacctgaagaaggagagcgaggaggacaagtttcctgtgtgcatccgggaggccgtgtcccaggtgctgaagggctatgactggaccctggtgcccatgcctgtgcgggtgaatggcagcagcaagaacaagccccacgtgaagaggcccatgaatgccttcatggtgtgggcccaggccgcccggaggaagctggccgaccagtacccccacctgcacaatgctgagctgagcaagaccctgggcaagctgtggaggctgctgaatgaaagtgagaagaggccctttgtggaggaggccgagcggctgcgggtgcagcacaagaaggaccacccagactacaagtaccagcccaggaggaggaagtctgtgaagaatggccaggccgaggccgaggaggccacagagcagacccacatcagccccaatgccatcttcaaggccctgcaggccgacagcccccacagcagcagcggcatgtctgaggtgcacagccctggagagcacagcggccagagccagggcccccccaccccacccaccacccccaagacagatgtgcagcccgggaaggctgacctgaagcgggagggccggcccctgcctgagggcggccggcagccccccatcgacttcagagatgtggacattggagagctgagcagtgatgtgatcagcaacatcgagacctttgatgtgaatgaatttgaccagtacctgcccccaaatggccaccctggggtgcctgccacccacggccaggtgacctacacaggcagctatggcatcagcagcacagctgccaccccagccagcgctggccacgtgtggatgagcaagcagcaggcccctcctcctccaccccagcagcccccccaggcccccccagccccccaggccccaccccagccccaggccgccccaccccagcagcctgctgccccaccccagcagccccaggcccacaccctgaccaccctgagcagcgagcccggccagagccagaggacccacatcaagacagagcagctgagccccagccactacagcgagcagcagcagcacagcccccagcagatcgcctacagccccttcaacctgccccactacagccccagctacccacccatcaccaggagccagtatgactacacagaccaccagaacagcagcagctactacagccatgctgctggccagggcaccggcctgtacagcaccttcacctacatgaacccagcccagaggcccatgtacacccccatcgctgacaccagcggcgtgcccagcatcccccagacccacagcccccagcactgggagcagcctgtgtacacccagctgacccggccctag

SEQ ID NO: 171642 - DNA, 1338 bp, Artificial Sequence
  Description of Artificial Sequence: Synthetic coding sequence
atgaacctgctggaccccttcatgaagatgacagatgagcaggagaagggcctgagcggggcccccagccccaccatgtctgaggacagcgctggcagcccctgccccagcggcagcggcagtgacacagagaacacccggccccaggagaacaccttccccaagggggagccagacctgaagaaggagagcgaggaggacaagtttcctgtgtgcatccgggaggccgtgtcccaggtgctgaagggctatgactggaccctggtgcccatgcctgtgcgggtgaatggcagcagcaagaacaagccccacgtgaagaggcccatgaatgccttcatggtgtgggcccaggccgcccggaggaagctggccgaccagtacccccacctgcacaatgctgagctgagcaagaccctgggcaagctgtggaggctgctgaatgaaagtgagaagaggccctttgtggaggaggccgagcggctgcgggtgcagcacaagaaggaccacccagactacaagtaccagcccaggaggaggaagtctgtgaagaatggccaggccgaggccgaggaggccacagagcagacccacatcagccccaatgccatcttcaaggccctgcaggccgacagcccccacagcagcagcggcatgtctgaggtgcacagccctggagagcacagcggccagagccagggcccccccaccccacccaccacccccaagacagatgtgcagcccgggaaggctgacctgaagcgggagggccggcccctgcctgagggcggccggcagccccccatcgacttcagagatgtggacattggagagctgagcagtgatgtgatcagcaacatcgagacctttgatgtgaatgaatttgaccagtacctgcccccaaatggccaccctggggtgcctgccacccacggccaggtgacctacacaggcagctatggcatcagcagcacagctgccaccccagccagcgctggccacgtgtggatgagcaagcagcaggcccctcctcctccaccccagcagcacagcccccagcagatcgcctacagccccttcaacctgccccactacagccccagctacccacccatcaccaggagccagtatgactacacagaccaccagaacagcagcagctactacagccatgctgctggccagggcaccggcctgtacagcaccttcacctacatgaacccagcccagaggcccatgtacacccccatcgctgacaccagcggcgtgcccagcatcccccagacccacagcccccagcactgggagcagcctgtgtacacccagctgacccggccctag

SEQ ID NO: 171643 - DNA, 273 bp, Artificial Sequence
  Description of Artificial Sequence: Synthetic coding sequence
atgaggggctacctggtggccatcttcctgtctgctgtgttcctgtactacgtgctgcactgcatcctgtggggcaccaacgtgtactgggtggcccctgtggagatgaagagaagaaacaagatccagccctgcctgagcaagccagcctttgccagcctgctgagccagagcagcgcctacatcctgaggaaaggaattgaggagctgaaccagaccagcatcctcttcacccaggtgtcctctgtgagccccttctctgtgtgtggctag

SEQ ID NO: 171644 - DNA, 273 bp, Artificial Sequence; identical to SEQ ID NO: 171643
  Description of Artificial Sequence: Synthetic coding sequence

SEQ ID NO: 171645 - DNA, 1335 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcagcaagtacagccacagcagcagcccccaggagaagcctgtggccgacagcgtggtgctgagctttgattctgctggccagaccctgggctctgaatatgaccggctgggcttcctgctgaacctggacagcaagctgagccccaggaccctgtgcaccgtggtgtttggcctggactgcatcctggagagccctggagagcccaagaagctgctgatgcctgccagccaccccctggagatcctgaagagcctgtctgaggacacagcctttgccctgggcttcctgaagctgcccaggcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgccccccttcggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgagcgggacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctcatcggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgaaacagtgaggatggccgccatcaaggagagctggacccacaacatccagcgggagaaggagttcctgaggaagctggtgaaggcccgggtcatcacagacctgagcagcggcatctag

SEQ ID NO: 171646 - DNA, 468 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggtgctggatgcccagtacccagcccgggagcgggtgtctgctgaggccggggagagcagccgccaccactag

SEQ ID NO: 171647 - DNA, 1035 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgttcagcaagccagcccccatgttcctggatgacagcttcaggaagtgggcccgcatccgggagtttgtgccccccttcggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgagcgggacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctcatcggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgaaacagtgaggatggccgccatcaaggagagctggacccacaacatccagcgggagaaggagttcctgaggaagctggtgaaggcccgggtcatcacagacctgagcagcggcatctag

SEQ ID NO: 171648 - DNA, 687 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcgggtgcacaggatggccagcggcaacctgtggcccctggagtgccccaggagccccctgcgctttgagagcagcacccacatcagcagccggcggccccccagccccagcctggcctgccccagcaccatggcctcctgggccggcggcaccagcctgcccctggccgtgtggcagtag

SEQ ID NO: 171649 - DNA, 1173 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcagcaagtacagccacagcagcagcccccaggagaagcctgtggccgacagcgtggtgctgagctttgattctgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgccccccttcggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgagcgggacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctcatcggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgaaacagtgaggatggccgccatcaaggagagctggacccacaacatccagcgggagaaggagttcctgaggaagctggtgaaggcccgggtcatcacagacctgagcagcggcatctag

SEQ ID NO: 171650 - DNA, 1242 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgagccccaggaccctgtgcaccgtggtgtttggcctggactgcatcctggagagccctggagagcccaagaagctgctgatgcctgccagccaccccctggagatcctgaagagcctgtctgaggacacagcctttgccctgggcttcctgaagctgcccaggcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctgattggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgagaccgtgaggatggccgccatcaaggagagctggacccacaacatccagcgggagaaggagttcctgaggaagctggtgaaggcccgggtcatcacagacctgagcagcggcatctag

SEQ ID NO: 171651 - DNA, 834 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtgtcctggacccacaacatccagcgggagaaggagttcctgaggaagctggtgaaggcccgggtcatcacagacctgagcagcggcatctag

SEQ ID NO: 171652 - DNA, 1128 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctgattggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgagaccgtgaggatggccgccatcaaggagagctggacccacaacatccagcgggagaaggagttcctgaggaagctggtgaaggcccgggtcatcacagacctgagcagcggcatctag

SEQ ID NO: 171653 - DNA, 1080 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctgattggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgagaccgtgaggatggccgccatcaaggagagctggacccacaacatccagcgggagaaggagttcctgaggaagctggtgaaggcccgggtcatcacagacctgagcagcggcatctag

SEQ ID NO: 171654 - DNA, 1335 bp, Artificial Sequence; identical to SEQ ID NO: 171645
  Description of Artificial Sequence: Synthetic coding sequence

SEQ ID NO: 171655 - DNA, 513 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcagcaagtacagccacagcagcagcccccaggagaagcctgtggccgacagcgtggtgctgagctttgattctgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgccccccttcggcatcaagggccaggtgctggatgcccagtacccagcccgggagcgggtgtctgctgaggccggggagagcagccgccaccactag

SEQ ID NO: 171656 - DNA, 468 bp, Artificial Sequence; identical to SEQ ID NO: 171646
  Description of Artificial Sequence: Synthetic coding sequence

SEQ ID NO: 171657 - DNA, 561 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgaggtag

SEQ ID NO: 171658 - DNA, 558 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcagcaagtacagccacagcagcagcccccaggagaagcctgtggccgagtatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgccccccttcggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgaggtag

SEQ ID NO: 171659 - DNA, 606 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcagcaagtacagccacagcagcagcccccaggagaagcctgtggccgagtatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgccccccttcggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgtccccaggccgcaccatcagcagcgagaggaagagcttctgtggctcctggtag

SEQ ID NO: 171660 - DNA, 1290 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgagccccaggaccctgtgcaccgtggtgtttggcctggactgcatcctggagagccctggagagcccaagaagctgctgatgcctgccagccaccccctggagatcctgaagagcctgtctgaggacacagcctttgccctgggcttcctgaagctgcccaggcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtgtctgccagtgatggcttctggaagtctgtggccaccagggtgcccaaggagcccccagagatccgcatcctgaacccctacttcatccaggaggccgccttcaccctgattggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgagaccgtgaggatggccgccatcaaggagagctggacccacaacatccagcgggagaaggagttcctgaggaagctggtgaaggcccgggtcatcacagacctgagcagcggcatctag

SEQ ID NO: 171661 - DNA, 1038 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtggaggccgccttcaccctgattggcctgcccttcaacaacggcctgatgggccggggcaacatccccaccctgggctctgtggccgtgaccatggccctgcacggctgtgatgaggtggccgtggccggcttcggctatgacatgagcaccccaaatgcccccctgcactactatgagaccgtgaggatggccgccatcaaggagagctggacccacaacatccagcgggagaaggagttcctgaggaagctggtgaaggcccgggtcatcacagacctgagcagcggcatctag

SEQ ID NO: 171662 - DNA, 1242 bp, Artificial Sequence; identical to SEQ ID NO: 171650
  Description of Artificial Sequence: Synthetic coding sequence

SEQ ID NO: 171663 - DNA, 1035 bp, Artificial Sequence; identical to SEQ ID NO: 171647
  Description of Artificial Sequence: Synthetic coding sequence

SEQ ID NO: 171664 - DNA, 1290 bp, Artificial Sequence; identical to SEQ ID NO: 171660
  Description of Artificial Sequence: Synthetic coding sequence

SEQ ID NO: 171665 - DNA, 456 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaacagcgtggtgctgagctttgacagcgctggccagaccctgggctctgaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggagtgcatcggctggctgctggagatctgtggccacagcagcgcccagggcgccccctag

SEQ ID NO: 171666 - DNA, 561 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgtccccaggccgcaccatcagcagcgagaggaagagcttctgtggctcctggtag

SEQ ID NO: 171667 - DNA, 420 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggtgctggatgcccagtacccagcccgggagcgggtgtctgctgaggccggggagagcagccgccaccactag

SEQ ID NO: 171668 - DNA, 306 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgcctgctgagctggccaccaagtatgccaacttcagcgagggcgcctgcaagccaggctacgccagcgccctgatgacagccatcttcccccggcccggccgcaccatcagcagcgagaggaagagcttctgtggctcctggtag

SEQ ID NO: 171669 - DNA, 786 bp, Artificial Sequence
  Description of Artificial Sequence: Synthetic coding sequence
atgggcctgctggtgtttgtgaggaacctgctgctggccctgtgcctcttcctggtgctgggcttcctgtactacagcgcctggaagctgcacctgctgcagtgggaggaggacagcaaatatgaccggctgggcttcctgctgaacctggacagcaagctgcctgctgagctggccaccaagtatgccaacttcagcgagggcgcctgcaagccaggctacgccagcgccctgatgacagccatcttcccccgcttcagcaagccagcccccatgttcctggatgacagcttcaggaagtgggcccgcatccgggagtttgtgcccccatttggcatcaagggccaggacaacctgatcaaggccatcctgtctgtgaccaaggagtaccgcctgaccccagccctggacagcctgcgctgccgccgctgcatcatcgtgggcaatggaggagtgctggccaacaagagcctgggcagcagaattgatgattatgacatcgtggtgcggctgaacagcgcccctgtgaagggctttgagaaggatgtgggcagcaagaccaccctgcgcatcacctacccagagggcgccatgcagaggcctgagcagtatgaaagagacagcctgtttgtgctggccggcttcaagtggcaggacttcaagtggctgaagtacatcgtgtacaaggagcgggtgtcctggacccacaacatccagcgggagaaggagttcctgaggaagctggtgaaggcccgggtcatcacagacctgagcagcggcatctag

SEQ ID NO: 171670 - DNA, 834 bp, Artificial Sequence; identical to SEQ ID NO: 171651
  Description of Artificial Sequence: Synthetic coding sequence

SEQ ID NO: 171671 - DNA, 513 bp, Artificial Sequence; identical to SEQ ID NO: 171655
  Description of Artificial Sequence: Synthetic coding sequence

SEQ ID NO: 171672 - DNA, 642 bp, Artificial Sequence
  Description of Artificial Sequence: Synthetic coding sequence
atgaggaccagcgctgagtacttccggctggccctgagcaagctgcagagctgtgacctgtttgatgaatttgacaagatgaacaatggacctgtgctgggccacgaggaggaggtgggccgccgcaccaccttccgcctcttctacccagagagcgtcttcagtgaccccatccacaatgaccccaacaccaccgtcatcctgacagccttcaagccccatgacctgcgctggctgctggagctgctgatgggagacaagatcaacaccaacggcttctggaagaagccagccctgaacctgatctacaagccctaccagatccgcatcctggaccccttcatcatcagaacagctgcctatgagctgctgcacttccccaaggtgttccccaagaaccagaagcccaagcaccccaccaccggcatcatcgccatcaccctggccttctacatctgccacgaggtgcacctggccggcttcaagtacaacttcagtgacctgaagagccccctgcactactatggaaatgccaccatgagcctgatgaacaagaatgcctaccacaacgtgacagctgagcagctgttcctgaaggacatcatcgagaagaacctggtgatcaacctgacccaggactag

SEQ ID NO: 171673 - DNA, 996 bp, Artificial Sequence
  Description of Artificial Sequence: Synthetic coding sequence
atgaggggctacctggtggccatcttcctgtctgctgtgttcctgtactacgtgctgcactgcatcctgtggggcaccaacgtgtactgggtggcccctgtggagatgaagagaagaaacaagatccagccctgcctgagcaagccagcctttgccagcctgctgcgcttccaccagttccaccccttcctgtgtgccgctgacttcaggaagatcgccagcctgtatggcagtgacaagtttgacctgccctacggcatgaggaccagcgctgagtacttccggctggccctgagcaagctgcagagctgtgacctgtttgatgaatttgacaacatcccctgcaagaagtgtgtggtggtgggcaatggaggagtgctgaagaacaagaccctgggggagaagattgacagctatgatgtgatcatccgcatgaacaatggacctgtgctgggccacgaggaggaggtgggccgccgcaccaccttccgcctcttctacccagagagcgtcttcagtgaccccatccacaatgaccccaacaccaccgtcatcctgacagccttcaagccccatgacctgcgctggctgctggagctgctgatgggagacaagatcaacaccaacggcttctggaagaagccagccctgaacctgatctacaagccctaccagatccgcatcctggaccccttcatcatcagaacagctgcctatgagctgctgcacttccccaaggtgttccccaagaaccagaagcccaagcaccccaccaccggcatcatcgccatcaccctggccttctacatctgccacgaggtgcacctggccggcttcaagtacaacttcagtgacctgaagagccccctgcactactatggaaatgccaccatgagcctgatgaacaagaatgcctaccacaacgtgacagctgagcagctgttcctgaaggacatcatcgagaagaacctggtgatcaacctgacccaggactag

SEQ ID NO: 171674 - DNA, 996 bp, Artificial Sequence; identical to SEQ ID NO: 171673
  Description of Artificial Sequence: Synthetic coding sequence

SEQ ID NO: 171675 - DNA, 696 bp, Artificial Sequence
  Description of Artificial Sequence: Synthetic coding sequence
atgaggggctacctggtggccatcttcctgtctgctgtgttcctgtactacgtgctgcactgcatcctgtggggcaccaacgtgtactgggtggcccctgtggagatgaagagaagaaacaagatccagccctgcctgagcaagccagcctttgccagcctgctgcgcttccaccagttccaccccttcctgtgtgccgctgacttcaggaagatcgccagcctgtatggcagtgacaagtttgacctgccctacggcatgaggaccagcgctgagtacttccggctggccctgagcaagctgcagagctgtgacctgtttgatgaatttgacaacatcccctgcaagaagtgtgtggtggtgggcaatggaggagtgctgaagaacaagaccctgggggagaagattgacagctatgatgtgatcatccgcatgaacaatggacctgtgctgggccacgaggaggaggtgggccgccgcaccaccttccgcctcttctacccagagagcgtcttcagtgaccccatccacaatgaccccaacaccaccgtcatcctgacagccttcaagccccatgacctgcgctggctgctggagctgctgatgggagacaagatcaacaccaacggcttctggaagaagccagccctgaacctgatctacaagccctaccagatccgcatcctggacccctag

SEQ ID NO: 171676 - DNA, 741 bp, Artificial Sequence
  Description of Artificial Sequence: Synthetic coding sequence
atgcactgccgggactgtgccctggtgaccagcagcggccacctgctgcacagccggcagggcagccagattgaccagacagaatgtgtgatccgcatgaatgatgcccccacccggggctacggcagagatgtgggcaacagaaccagcctgcgggtcatcgcccacagcagcatccagaggatcctgaggaacagacatgacctgctgaatgtgtcccagggcaccgtcttcatcttctggggccccagcagctacatgagaagagatggcaagggccaggtgtacaacaacctgcacctgctgagccaggtgctgccccggctgaaggccttcatgatcaccaggcacaagatgctgcagtttgatgagctgttcaagcaggagaccgggaaggacaggaagatcagcaacacctggctgagcacaggctggttcaccatgaccatcgccctggagctgtgtgaccgcatcaacgtgtatggcatggtgcccccagacttctgccgggaccccaaccaccccagcgtgccctaccactactatgagccctttggaccagatgaatgtaccatgtacctgagccatgagcggggcaggaagggcagccaccaccgcttcatcacagagaagagggtcttcaagaactgggcccggaccttcaacatccacttcttccagcctgactggaagccagagagcctggccatcaaccaccctgagaacaagcctgtgttctag

SEQ ID NO: 171677 - DNA, 1011 bp, Artificial Sequence
  Description of Artificial Sequence: Synthetic coding sequence
atgaagaccctgatgagacatggcctggccgtgtgcctggccctgaccaccatgtgcaccagcctgctgctggtgtacagcagcctgggcggccagaaggagcggcccccccagcagcagcagcagcagcagcagcagcagcagcaggccagcgccaccggcagcagccagcctgctgctgagagcagcacccagcagaggcctggggtgcctgctggcccccggcccctggatggctacctgggcgtggccgaccacaagcccctgaagatgcactgccgggactgtgccctggtgaccagcagcggccacctgctgcacagccggcagggcagccagattgaccagacagaatgtgtgatccgcatgaatgatgcccccacccggggctacggcagagatgtgggcaacagaaccagcctgcgggtcatcgcccacagcagcatccagaggatcctgaggaacagacatgacctgctgaatgtgtcccagggcaccgtcttcatcttctggggccccagcagctacatgagaagagatggcaagggccaggtgtacaacaacctgcacctgctgagccaggtgctgccccggctgaaggccttcatgatcaccaggcacaagatgctgcagtttgatgagctgttcaagcaggagaccgggaaggacaggaagatcagcaacacctggctgagcacaggctggttcaccatgaccatcgccctggagctgtgtgaccgcatcaacgtgtatggcatggtgcccccagacttctgccgggaccccaaccaccccagcgtgccctaccactactatgagccctttggaccagatgaatgtaccatgtacctgagccatgagcggggcaggaagggcagccaccaccgcttcatcacagagaagagggtcttcaagaactgggcccggaccttcaacatccacttcttccagcctgactggaagccagagagcctggccatcaaccaccctgagaacaagcctgtgttctag

SEQ ID NO: 171678 - DNA, 1275 bp, Artificial Sequence
  Description of Artificial Sequence: Synthetic coding sequence
atgtctgaccatggagatgtgtccctgcccccagaggacagagtgcgggccctgagccagctgggcagcgctgtggaggtgaatgaagacatccccccccggcgctacttccgctctggagtggagatcatccgcatggccagcatctacagcgaggagggcaacatcgagcacgccttcatcctgtacaacaagtacatcaccctcttcatcgagaagctgcccaagcaccgggactacaagtctgctgtgattcctgagaagaaggacacagtgaagaagctgaaggagatcgccttccccaaggccgaggagctgaaggccgagctgctgaagcgctacaccaaggagtacacagagtacaatgaggagaagaagaaggaggccgaggagctggccaggaacatggccatccagcaggagctggagaaggagaagcagagggtggcccagcagaagcagcagcagctggagcaggagcagttccacgcctttgaggagatgatccggaaccaggagctggagaaggagcggctgaagatcgtgcaggagtttgggaaggtggaccccggcctgggcggccccctggtgcctgacctggagaagcccagcctggatgtgttccccaccctgactgtgagcagcatccagcccagcgactgccacaccaccgtgcggcctgccaagccccctgtggtggacaggagcctgaagccaggggccctgagcaacagcgagagcatccccaccattgatggcctgcggcacgtggtggtgcccggccgcctgtgcccccagttcctgcagctggccagcgccaacacagcccggggcgtggagacctgtggcatcctgtgtgggaagctgatgagaaatgagttcaccatcacccacgtgctgatccccaagcagagcgctggcagtgactactgcaacacagaaaatgaggaggagctgttcctgatccaggaccagcagggcctcatcaccctgggctggatccacacccaccccacccagacagccttcctgagctctgtggacctgcacacccactgcagctaccagatgatgctgcctgagagcgtggccatcgtgtgcagccccaagttccaggagaccggcttcttcaagctgacagaccacggcctggaggagatcagcagctgccggcagaagggcttccacccccacagcaaggaccccccactcttctgcagctgcagccacgtgacagtggtggacagagctgtgaccatcacagacctgaggtag

SEQ ID NO: 171679 - DNA, 1275 bp, Artificial Sequence; identical to SEQ ID NO: 171678
  Description of Artificial Sequence: Synthetic coding sequence

SEQ ID NO: 171680 - DNA, 1275 bp, Artificial Sequence; identical to SEQ ID NO: 171678
  Description of Artificial Sequence: Synthetic coding sequence

SEQ ID NO: 171681 - DNA, 1275 bp, Artificial Sequence; identical to SEQ ID NO: 171678
  Description of Artificial Sequence: Synthetic coding sequence

SEQ ID NO: 171682 - DNA, 492 bp, Artificial Sequence
  Description of Artificial Sequence: Synthetic coding sequence
atgtctgaccatggagatgtgtccctgcccccagaggacagagtgcgggccctgagccagctgggcagcgctgtggaggtgaatgaagacatccccccccggcgctacttccgctctggagtggagatcatccgcatggccagcatctacagcgaggagggcaacatcgagcacgccttcatcctgtacaacaagtacatcaccctcttcatcgagaagctgcccaagcaccgggactacaagtctgctgtgattcctgagaagaaggacacagtgaagaagctgaaggagatcgccttccccaaggccgaggagctgaaggccgagctgctgaagcgctacaccaaggagtacacagagtacaatgaggagaagaagaaggaggccgaggagctggccaggaacatggccatccagcaggagctggagaaggagaagcagagggtggcccagcagaagcagcagcagctggagcaggagcagttccactag

SEQ ID NO: 171683 - DNA, 957 bp, Artificial Sequence
  Description of Artificial Sequence: Synthetic coding sequence
atgtctgaccatggagatgtgtccctgcccccagaggacagagtgcgggccctgagccagctgggcagcgctgtggaggtgaatgaagacatccccccccggcgctacttccgctctggagtggagatcatccgcatggccagcatctacagcgaggagggcaacatcgagcacgccttcatcctgtacaacaagtacatcaccctcttcatcgagaagctgcccaagcaccgggactacaagtctgctgtgattcctgagaagaaggacacagtgaagaagctgaaggagatcgccttccccaaggccgaggagctgaaggccgagctgctgaagcgctacaccaaggagtacacagagtacaatgaggagaagaagaaggaggccgaggagctggccaggaacatggccatccagcaggagctggagaaggagaagcagagggtggcccagcagaagcagcagcagctggagcaggagcagttccacgcctttgaggagatgatccggaaccaggagctggagaaggagcggctgaagatcgtgcaggagtttgggaaggtggaccccggcctgggcggccccctggtgcctgacctggagaagcccagcctggatgtgttccccaccctgactgtgagcagcatccagcccagcgactgccacaccaccgtgcggcctgccaagccccctgtggtggacaggagcctgaagccaggggccctgagcaacagcgagagcatccccaccattgatggcctgcggcacgtggtggtgcccggccgcctgtgcccccagttcctgcagctggccagcgccaacacagcccggggcgtggagacctgtggcatcctgtgtgggaagctgatgagaaatgagttcaccatcacccacgtgctgatccccaagcagagcgctggcagtgactactgcaacacagaaaatgaggaggagtag

SEQ ID NO: 171684 - DNA, 414 bp, Artificial Sequence
  Description of Artificial Sequence: Synthetic coding sequence
atgtctgaccatggagatgtgtccctgcccccagaggacagagtgcgggccctgagccagctgggcagcgctgtggaggtgaatgaagacatccccccccggcgctacttccgctctggagtggagatcatccgcatggccagcatctacagcgaggagggcaacatcgagcacgccttcatcctgtacaacaagtacatcaccctcttcatcgagaagctgcccaagcaccgggactacaagtctgctgtgattcctgagaagaaggacacagtgaagaagctgaaggagatcgccttccccaaggccgaggagctgaaggccgagctgctgaagcgctacaccaaggagtacacagagtacaatgaggagaagaagaaggaggccgaggagctggccaggaacatggcctag

SEQ ID NO: 171685 - DNA, 1047 bp, Artificial Sequence
  Description of Artificial Sequence: Synthetic coding sequence
atgtctgaccatggagatgtgtccctgcccccagaggacagagtgcgggccctgagccagctgggcagcgctgtggaggtgaatgaagacatccccccccggcgctacttccgctctggagtggagatcatccgcatggccagcatctacagcgaggagggcaacatcgagcacgccttcatcctgtacaacaagtacatcaccctcttcatcgagaagctgcccaagcaccgggactacaagtctgctgtgattcctgagaagaaggacacagtgaagaagctgaaggagatcgccttccccaaggccgaggagctgaaggccgagctgctgaagcgctacaccaaggagtacacagagtacaatgaggagaagaagaaggaggccgaggagctggccaggaacatggccatccagcaggagctggagaaggagaagcagagggtggcccagcagaagcagcagcagctggagcaggagcagttccacgcctttgaggagatgatccggaaccaggagctggagaaggagcggctgaagatcgtgcaggagtttgggaaggtggaccccggcctgggcggccccctggtgcctgacctggagaagcccagcctggatgtgttccccaccctgactgtgagcagcatccagcccagcgactgccacaccaccgtgcggcctgccaagccccctgtggtggacaggagcctgaagccaggggccctgagcaacagcgagagcatccccaccattgatggcctgcggcacgtggtggtgcccggccgcctgtgcccccagttcctgcagctggccagcgccaacacagcccggggcgtggagacctgtggcatcctgtgtgggaagctgatgagaaatgagttcaccatcacccacgtgctgatccccaagcagagcgctggcagtgactactgcaacacagaaaatgaggaggagctgttcctgatccaggaccagcagggcctcatcaccctgggctggattcatgtggagaccctgtggagcctgaagagcctgcacgccccctag

SEQ ID NO: 171686 - DNA, 813 bp, Artificial Sequence
  Description of Artificial Sequence: Synthetic coding sequence
atgaggcagcagcagctggagagcgagcagttcctgttctttgaggaccagctgaagaagcaggagctggcccggggccagatgaggagccagcagaccagcggcctgtctgagcagattgatggcagcgccctgagctgcttcagcacccaccagaacaacagcctgctgaatgtgtttgctgaccagcccaacaagagtgatgccaccaactatgccagccacagcccccctgtgaacagagccctgaccccagctgccaccctgtctgctgtgcagaacctggtggtggagggcctgcgctgtgtggtgctgcctgaggacctgtgccacaagttcctgcagctggccgagagcaacacagtgcggggcatcgagacctgtggcatcctgtgtgggaagctgacccacaatgagttcaccatcacccacgtgattgtgcccaagcagagcgctggccctgactactgtgacatggagaatgtggaggagctgttcaacgtgcaggaccagcacgacctgctgaccctgggctggatccacacccaccccacccagacagccttcctgagctctgtggacctgcacacccactgcagctaccagctgatgctgcctgaggccatcgccatcgtgtgcagccccaagcacaaggacaccggcatcttccggctgaccaatgccggcatgctggaggtgtctgcctgcaagaagaagggcttccacccccacaccaaggagcccaggctcttcagcatctgcaagcacgtgctggtgaaggacatcaagatcatcgtgctggacctgaggtag

SEQ ID NO: 171687 - DNA, 1311 bp, Artificial Sequence
  Description of Artificial Sequence: Synthetic coding sequence
atggaccagcccttcaccgtgaacagcctgaagaagctggccgccatgccagaccacacagatgtgtccctgagccctgaggagcgggtgcgggccctgagcaagctgggctgcaacatcaccatcagcgaggacatcaccccccggcgctacttccgcagcggcgtggagatggagaggatggcctctgtgtacctggaggagggcaacctggagaatgcctttgtgctgtacaacaagttcatcaccctgtttgtggagaagctgcccaaccaccgggactaccagcagtgtgctgtgcctgagaagcaggacatcatgaagaagctgaaggagatcgccttccccaggacagatgagctgaagaatgacctgctgaagaagtacaacgtggagtaccaggagtacctgcagagcaagaacaagtacaaggccgagatcctgaagaagctggagcaccagaggctgattgaagctgagaggaagagaattgcccagatgaggcagcagcagctggagagcgagcagttcctgttctttgaggaccagctgaagaagcaggagctggcccggggccagatgaggagccagcagaccagcggcctgtctgagcagattgatggcagcgccctgagctgcttcagcacccaccagaacaacagcctgctgaatgtgtttgctgaccagcccaacaagagtgatgccaccaactatgccagccacagcccccctgtgaacagagccctgaccccagctgccaccctgtctgctgtgcagaacctggtggtggagggcctgcgctgtgtggtgctgcctgaggacctgtgccacaagttcctgcagctggccgagagcaacacagtgcggggcatcgagacctgtggcatcctgtgtgggaagctgacccacaatgagttcaccatcacccacgtgattgtgcccaagcagagcgctggccctgactactgtgacatggagaatgtggaggagctgttcaacgtgcaggaccagcacgacctgctgaccctgggctggatccacacccaccccacccagacagccttcctgagctctgtggacctgcacacccactgcagctaccagctgatgctgcctgaggccatcgccatcgtgtgcagccccaagcacaaggacaccggcatcttccggctgaccaatgccggcatgctggaggtgtctgcctgcaagaagaagggcttccacccccacaccaaggagcccaggctcttcagcatctgcaagcacgtgctggtgaaggacatcaagatcatcgtgctggacctgaggtag

SEQ ID NO: 171688 - DNA, 1311 bp, Artificial Sequence; identical to SEQ ID NO: 171687
  Description of Artificial Sequence: Synthetic coding sequence

SEQ ID NO: 171689 - DNA, 1386 bp, Artificial Sequence
  Description of Artificial Sequence: Synthetic coding sequence
atggaccagcccttcaccgtgaacagcctgaagaagctggccgccatgccagaccacacagatgtgtccctgagccctgaggagcgggtgcgggccctgagcaagctgggctgcaacatcaccatcagcgaggacatcaccccccggcgctacttccgcagcggcgtggagatggagaggatggcctctgtgtacctggaggagggcaacctggagaatgcctttgtgctgtacaacaagttcatcaccctgtttgtggagaagctgcccaaccaccgggactaccagcagtgtgctgtgcctgagaagcaggacatcatgaagaagctgaaggagatcgccttccccaggacagatgagctgaagaatgacctgctgaagaagtacaacgtggagtaccaggagtacctgcagagcaagaacaagtacaaggccgagatcctgaagaagctggagcaccagaggctgattgaagctgagaggaagagaattgcccagatgaggcagcagcagctggagagcgagcagttcctgttctttgaggaccagctgaagaagcaggagctggcccggggccagatgaggagccagcagaccagcggcctgtctgagcagattgatggcagcgccctgagctgcttcagcacccaccagaacaacagcctgctgaatgtgtttgctgaccagcccaacaagagtgatgccaccaactatgccagccacagcccccctgtgaacagagccctgaccccagctgccaccctgtctgctgtgcagaacctggtggtggagggcctgcgctgtgtggtgctgcctgaggacctgtgccacaagttcctgcagctggccgagagcaacacagtgcggggcatcgagacctgtggcatcctgtgtgggaagctgacccacaatgagttcaccatcacccacgtgattgtgcccaagcagagcgctggccctgactactgtgacatggagaatgtggaggagctgttcaacgtgcaggaccagcacgacctgctgaccctgggctggatccacacccaccccacccagacagccttcctgagctctgtggacctgcacacccactgcagctaccagctgatgctgcctgaggccatcgccatcgtgtgcagccccaagcacaaggacaccggcatcttccggctgaccaatgccggcatgctggaggtgtctgcctgcaagaagaagggcttccacccccacaccaaggagcccaggctcttcagcatccagaagttcctgagcggcatcatcagcggcacagccctggagatggagcccctgaagattggctacggccccaacggcttccccctgctgggcatcagccgcagcagcagccccagcgagcagctgtag

SEQ ID NO: 171690 - DNA, 267 bp, Artificial Sequence
  Description of Artificial Sequence: Synthetic coding sequence
atgagcatcatggaccacagccccaccaccggggtggtgaccgtcatcgtcatcctgattgccatcgccgccctgggcgccctgatcctgggctgctggtgctacctgcggctgcagaggatcagccagagtgaagatgaggagagcatcgtgggagatggagagaccaaggagcccttcctgctggtgcagtacagcgccaagggcccctgtgtggagaggaaggccaagctgatgacccccaacggccctgaggtgcatggatag

SEQ ID NO: 171691 - DNA, 744 bp, Artificial Sequence
  Description of Artificial Sequence: Synthetic coding sequence
atgctgcagaacagcgctgtgctgctggtgctggtgatcagcgccagcgccacccatgaagctgagcagaatgacagcgtgagccccaggaagagccgggtggccgcccagaacagcgctgaggtggtgcgctgcctgaacagcgccctgcaggtgggctgtggggcctttgcctgcctggagaacagcacctgtgacacagatggcatgtatgacatctgcaagagcttcctgtacagcgctgccaagtttgacacccagggcaaggcctttgtgaaggagagcctgaagtgcatcgccaatggagtgaccagcaaggtgttcctggccatccgccgctgcagcaccttccagaggatgattgctgaggtgcaggaggagtgctacagcaagctgaatgtgtgcagcatcgccaagaggaaccctgaggccatcacagaggtggtgcagctgcccaaccacttcagcaaccgctactacaaccggctggtgcgcagcctgctggagtgtgatgaggacacagtgtccaccatccgggacagcctgatggagaagattggccccaacatggccagcctcttccacatcctgcagacagaccactgtgcccagacccaccccagggctgacttcaacagaagaaggaccaatgagccccagaagctgaaggtgctgctgaggaacctgcggggggaggaggacagccccagccacatcaagaggaccagccatgagagcgcctag

SEQ ID NO: 171692 - DNA, 537 bp, Artificial Sequence
  Description of Artificial Sequence: Synthetic coding sequence
atgtatgacatctgcaagagcttcctgtacagcgctgccaagtttgacacccagggcaaggcctttgtgaaggagagcctgaagtgcatcgccaacggggtgaccagcaaggtgttcctggccatccgccgctgcagcaccttccagaggatgattgctgaggtgcaggaggagtgctacagcaagctgaatgtgtgcagcatcgccaagagaaatcctgaggccatcacagaggtggtgcagctgcccaaccacttcagcaaccgctactacaaccggctggtgcgcagcctgctggagtgtgatgaagatactgtgtccaccatccgggacagcctgatggagaagattggccccaacatggccagcctcttccacatcctgcagacagaccactgtgcccagacccaccccagggctgacttcaacagaagaaggaccaatgagccccagaagctgaaggtgctgctgaggaacctgcggggggaggaggacagccccagccacatcaagaggaccagccatgaaagtgcctag

SEQ ID NO: 171693 - DNA, 537 bp, Artificial Sequence; identical to SEQ ID NO: 171692
  Description of Artificial Sequence: Synthetic coding sequence

SEQ ID NO: 171694 - DNA, 2733 bp, Artificial Sequence
  Description of Artificial Sequence: Synthetic coding sequence
atggccagcagcgcccagagcggcggcagcagcggcggccctgctgtgcccaccgtgcagaggggcatcatcaagatggtgctgagcggctgtgccatcatcgtgcggggccagccccggggcggccccccacctgagcggcagatcaacctgagcaacatccgggccggcaacctggccaggagagctgctgccacccagccagatgccaaggacaccccagatgagccctgggccttccctgcccgggagttcctgaggaagaagctgattggcaaggaggtgtgcttcaccatcgagaacaagaccccccagggccgggagtatggcatgatctacctgggcaaggacaccaatggagaaaatattgctgagagcctggtggccgagggcctggccacccggcgggagggcatgagggccaacaaccctgagcagaaccggctgtctgaatgtgaggagcaggccaaggccgccaagaagggcatgtggagcgagggcaatggcagccacaccatccgggacctgaagtacaccatcgagaaccccaggcactttgtggacagccaccaccagaagcctgtgaatgccatcattgaacatgtgagagatggctctgtggtgcgggccctgctgctgcctgactactacctggtgacagtgatgctgagcggcatcaagtgccccaccttccggcgggaggctgatggcagcgagaccccagagccctttgctgctgaggccaagttcttcacagagagccggctgctgcagagagatgtgcagatcatcctggagagctgccacaaccagaacatcctgggcaccatcctgcaccccaatggaaacatcacagagctgctgctgaaggagggctttgcccgctgtgtggactggagcattgctgtgtacaccagaggagctgagaagctgcgggctgctgagagatttgccaaggagcggcggctgcgcatctggagggactatgtggcccccacagccaacctggaccagaaggacaagcagtttgtggccaaggtgatgcaggtgctgaatgctgatgccatcgtggtgaagctgaacagcggggactacaagaccatccacctgagcagcatccggcccccccggctggagggggagaacacccaggacaagaacaagaagctgcggcccctgtatgacatcccctacatgtttgaggcccgggagttcctgaggaagaagctgattggcaagaaggtgaatgtgacagtggactacatccggcctgccagccctgccacagaaacagtgcctgccttcagcgagaggacctgtgccaccgtgaccatcggcggcatcaacattgctgaggccctggtgtccaagggcctggccaccgtcatccgctaccggcaggatgatgaccagaggagcagccactatgatgagctgctggccgctgaggcccgggccatcaagaatggcaagggcctgcacagcaagaaggaggtgcccatccaccgggtggccgacatcagcggggacacccagaaggccaagcagttcctgcccttcctgcagagagctggccgctctgaggccgtggtggagtatgtgttcagcggcagccggctgaagctgtacctgcccaaggagacctgcctgatcaccttcctgctggccggcattgaatgtcccaggggggccaggaacctgcccggcctggtgcaggagggggagcccttcagcgaggaggccaccctcttcaccaaggagctggtgctgcagcgggaggtggaggtggaggtggagagcatggacaaggccggcaacttcatcggctggctgcacattgatggagccaacctgtctgtgctgctggtggagcacgccctgagcaaggtgcacttcaccgctgagaggagcagctactacaagagcctgctgtctgctgaggaggccgccaagcagaagaaggagaaggtgtgggcccactatgaggagcagcctgtggaggaggtgatgcctgtgctggaggagaaggagaggtctgccagctacaagcctgtgtttgtgacagagatcacagatgacctgcacttctacgtgcaggatgtggagaccggcacccagctggagaagctgatggagaacatgagaaatgacatcgccagccacccccctgtggagggcagctatgcccccaggagaggagagttctgcatcgccaagtttgtggatggagagtggtaccgggcccgggtggagaaggtggagagccctgccaagatccacgtgttctacatcgactatggcaaccgggaggtgctgcccagcacccggctgggcaccctgagccctgccttcagcaccagggtgctgcctgcccaggccacagaatatgcctttgccttcatccaggtgccccaggatgatgatgccaggacagatgctgtggacagcgtggtgcgggacatccagaacacccagtgcctgctgaatgtggagcacctgtctgctggctgcccccacgtgaccctgcagtttgctgacagcaaaggagatgtgggcctgggcctggtgaaggagggcctggtgatggtggaggtgaggaaggagaagcagttccagaaggtgatcacagagtacctgaatgcccaggagagcgccaagagcgcccggctgaacctgtggaggtatggagacttccgggcagatgatgctgatgaatttggctacagcaggtag

SEQ ID NO: 171695 - DNA, 2703 bp, Artificial Sequence
  Description of Artificial Sequence: Synthetic coding sequence
atggccagcagcgctgtgcccaccgtgcagaggggcatcatcaagatggtgctgagcggctgtgccatcatcgtgcggggccagccccggggcggccccccacctgagcggcagatcaacctgagcaacatccgggccggcaacctggccaggagagctgctgccacccagccagatgccaaggacaccccagatgagccctgggccttccctgcccgggagttcctgaggaagaagctgattggcaaggaggtgtgcttcaccatcgagaacaagaccccccagggccgggagtatggcatgatctacctgggcaaggacaccaatggagaaaatattgctgagagcctggtggccgagggcctggccacccggcgggagggcatgagggccaacaaccctgagcagaaccggctgtctgaatgtgaggagcaggccaaggccgccaagaagggcatgtggagcgagggcaatggcagccacaccatccgggacctgaagtacaccatcgagaaccccaggcactttgtggacagccaccaccagaagcctgtgaatgccatcattgaacatgtgagagatggctctgtggtgcgggccctgctgctgcctgactactacctggtgacagtgatgctgagcggcatcaagtgccccaccttccggcgggaggctgatggcagcgagaccccagagccctttgctgctgaggccaagttcttcacagagagccggctgctgcagagagatgtgcagatcatcctggagagctgccacaaccagaacatcctgggcaccatcctgcaccccaatggaaacatcacagagctgctgctgaaggagggctttgcccgctgtgtggactggagcattgctgtgtacaccagaggagctgagaagctgcgggctgctgagagatttgccaaggagcggcggctgcgcatctggagggactatgtggcccccacagccaacctggaccagaaggacaagcagtttgtggccaaggtgatgcaggtgctgaatgctgatgccatcgtggtgaagctgaacagcggggactacaagaccatccacctgagcagcatccggcccccccggctggagggggagaacacccaggacaagaacaagaagctgcggcccctgtatgacatcccctacatgtttgaggcccgggagttcctgaggaagaagctgattggcaagaaggtgaatgtgacagtggactacatccggcctgccagccctgccacagaaacagtgcctgccttcagcgagaggacctgtgccaccgtgaccatcggcggcatcaacattgctgaggccctggtgtccaagggcctggccaccgtcatccgctaccggcaggatgatgaccagaggagcagccactatgatgagctgctggccgctgaggcccgggccatcaagaatggcaagggcctgcacagcaagaaggaggtgcccatccaccgggtggccgacatcagcggggacacccagaaggccaagcagttcctgcccttcctgcagagagctggccgctctgaggccgtggtggagtatgtgttcagcggcagccggctgaagctgtacctgcccaaggagacctgcctgatcaccttcctgctggccggcattgaatgtcccaggggggccaggaacctgcccggcctggtgcaggagggggagcccttcagcgaggaggccaccctcttcaccaaggagctggtgctgcagcgggaggtggaggtggaggtggagagcatggacaaggccggcaacttcatcggctggctgcacattgatggagccaacctgtctgtgctgctggtggagcacgccctgagcaaggtgcacttcaccgctgagaggagcagctactacaagagcctgctgtctgctgaggaggccgccaagcagaagaaggagaaggtgtgggcccactatgaggagcagcctgtggaggaggtgatgcctgtgctggaggagaaggagaggtctgccagctacaagcctgtgtttgtgacagagatcacagatgacctgcacttctacgtgcaggatgtggagaccggcacccagctggagaagctgatggagaacatgagaaatgacatcgccagccacccccctgtggagggcagctatgcccccaggagaggagagttctgcatcgccaagtttgtggatggagagtggtaccgggcccgggtggagaaggtggagagccctgccaagatccacgtgttctacatcgactatggcaaccgggaggtgctgcccagcacccggctgggcaccctgagccctgccttcagcaccagggtgctgcctgcccaggccacagaatatgcctttgccttcatccaggtgccccaggatgatgatgccaggacagatgctgtggacagcgtggtgcgggacatccagaacacccagtgcctgctgaatgtggagcacctgtctgctggctgcccccacgtgaccctgcagtttgctgacagcaaaggagatgtgggcctgggcctggtgaaggagggcctggtgatggtggaggtgaggaaggagaagcagttccagaaggtgatcacagagtacctgaatgcccaggagagcgccaagagcgcccggctgaacctgtggaggtatggagacttccgggcagatgatgctgatgaatttggctacagcaggtag

SEQ ID NO: 171696 - DNA, 705 bp, Artificial Sequence
  Description of Artificial Sequence: Synthetic coding sequence
atgaaccacctgcctgaggacatggagaatgccctgaccggcagccagagcagccacgccagcctgaggaacatccacagcatcaaccccacccagctgatggccagaattgagagctatgagggccgggagaagaagggcatcagtgatgtgcggaggaccttctgcctgtttgtgacctttgacctgctgtttgtgaccctgctgtggatcatcgagctgaatgtgaatggaggcatcgagaacaccctggagaaggaggtgatgcagtatgactactacagcagctactttgacatcttcctgctggccgtgttccgcttcaaggtgctgatcctggcctatgctgtgtgccgcctgcggcactggtgggccatcgccctgaccacagctgtgaccagcgccttcctgctggccaaggtgatcctgagcaagctgttcagccagggcgccttcggctacgtgctgcccatcatctccttcatcctggcctggattgagacctggttcctggacttcaaggtgctgccccaggaggccgaggaggagaaccggctgctgattgtgcaggatgccagcgagcgggccgccctgatccctgggggcctgagtgatggccagttctacagccccccagagagcgaggccggcagcgaggaggccgaggagaagcaggacagcgagaagcccctgctggagctgtag

SEQ ID NO: 171697 - DNA, 705 bp, Artificial Sequence; identical to SEQ ID NO: 171696
  Description of Artificial Sequence: Synthetic coding sequence

SEQ ID NO: 171698 - DNA, 621 bp, Artificial Sequence
  Description of Artificial Sequence: Synthetic coding sequence
atgaaccacctgcctgaggacatggagaatgccctgaccggcagccagagcagccacgccagcctgaggaacatccacagcatcaaccccacccagctgatggccagaattgagagctatgagggccgggagaagaagggcatcagtgatgtgcggaggaccttctgcctgtttgtgacctttgacctgctgtttgtgaccctgctgtggatcatcgagctgaatgtgaatggaggcatcgagaacaccctggagaaggaggtgatgcagtatgactactacagcagctactttgacatcttcctgctggccgtgttccgcttcaaggtgctgatcctggcctatgctgtgtgccgcctgcggcactggtgggccatcgccctgaccacagctgtgaccagcgccttcctgctggccaaggtgatcctgagcaagctgttcagccagggcgccttcggctacgtgctgcccatcatctccttcatcctggcctggattgagacctggttcctggacttcaaggtgctgccccaggaggccgaggaggagaaccggctgctgattgtgcaggatgccagcgagcgggccgccctgatccctgggggcctgagtgatggatag

SEQ ID NO: 171699 - DNA, 555 bp, Artificial Sequence
  Description of Artificial Sequence: Synthetic coding sequence
atgaaccacctgcctgaggacatggagaatgccctgaccggcagccagagcagccacgccagcctgaggaacatccacagcatcaaccccacccagctgatggccagaattgagagctatgagggccgggagaagaagggcatcagtgatgtgcggaggaccttctgcctgtttgtgacctttgacctgctgtttgtgaccctgctgtggatcatcgagctgaatgtgaatggaggcatcgagaacaccctggagaaggaggtgatgcagtatgactactacagcagctactttgacatcttcctgctggccgtgttccgcttcaaggtgctgatcctggcctatgctgtgtgccgcctgcggcactggtgggccatcgccctgaccacagctgtgaccagcgccttcctgctggccaaggtgatcctgagcaagctgttcagccagggcgccttcggctacgtgctgcccatcatctccttcatcctggcctggattgagacctggttcctggacttcaaggtgctgccccaggaggccgaggaggagaactag

SEQ ID NO: 171700 - DNA, 519 bp, Artificial Sequence
  Description of Artificial Sequence: Synthetic coding sequence
atgaaccacctgcctgaggacatggagaatgccctgaccggcagccagagcagccacgccagcctgaggaacatccacagcatcaaccccacccagctgatggccagaattgagagctatgagggccgggagaagaagggcatcagtgatgtgcggaggaccttctgcctgtttgtgacctttgacctgctgtttgtgaccctgctgtggatcatcgagctgaatgtgaatggaggcatcgagaacaccctggagaaggaggtgatgcagtatgactactacagcagctactttgacatcttcctgctggccgtgttccgcttcaaggtgctgatcctggcctatgctgtgtgccgcctgcggcactggtgggccatcgccctgaccacagctgtgaccagcgccttcctgctggccaaggtgatcctgagcaagctgttcagccagggcgccttcggctacgtgctgcccatcatctccttcatcctggcctggattgagacctggttcctggactag

SEQ ID NO: 171701 - DNA, 684 bp, Artificial Sequence
  Description of Artificial Sequence: Synthetic coding sequence
atggagaatgccctgaccggcagccagagcagccacgccagcctgaggaacatccacagcatcaaccccacccagctgatggcccgcatcgagagctatgagggccgggagaagaagggcatcagtgatgtgcggaggaccttctgcctgtttgtgacctttgacctgctgtttgtgaccctgctgtggatcatcgagctgaatgtgaatggaggcatcgagaacaccctggagaaggaggtgatgcagtatgactactacagcagctactttgacatcttcctgctggccgtgttccgcttcaaggtgctgatcctggcctatgctgtgtgccgcctgcggcactggtgggccatcgccctgaccacagctgtgaccagcgccttcctgctggccaaggtgatcctgagcaagctgttcagccagggcgccttcggctacgtgctgcccatcatctccttcatcctggcctggattgagacctggttcctggacttcaaggtgctgccccaggaggccgaggaggagaaccggctgctgattgtgcaggatgccagcgagagagctgccctgatccctgggggcctgagtgatggccagttctacagccccccagagagcgaggccggcagcgaggaggccgaggagaagcaggacagcgagaagcccctgctggagctgtag

SEQ ID NO: 171702 - DNA, 1338 bp, Artificial Sequence
  Description of Artificial Sequence: Synthetic coding sequence
atgagcaagctgccccgggagctgacccgggacctggagaggagcctgcctgctgtggccagcctgggcagcagcctgagccacagccagagcctgagcagccacctgctgcccccacctgagaagagaagagccatcagtgatgtgcggaggaccttctgcctgtttgtgacctttgacctgctcttcatcagcctgctgtggatcatcgagctgaacaccaacacaggcatcaggaagaacctggagcaggagatcatccagtacaacttcaagaccagcttctttgacatctttgtgctggccttcttccgcttcagcggcctgctgctgggctatgctgtgctgcggctgcggcactggtgggtgattgctgtgaccaccctggtgagcagcgccttcctgattgtgaaggtgatcctgtctgagctgctgagcaaaggagccttcggctacctgctgcccatcgtgtcctttgtgctggcctggctggagacctggttcctggacttcaaggtgctgccccaggaggccgaggaggagcgctggtacctggccgcccaggtggccgtggcccggggccccctgctcttcagcggggccctgtctgagggccagttctacagccccccagagagctttgctggcagtgacaatgaaagtgatgaggaggtggccggcaagaagagcttcagcgcccaggagcgggagtacatccggcagggcaaggaggccacagctgtggtggaccagatcctggcccaggaggagaactggaagtttgagaagaacaatgaatatggagacacagtgtacaccatcgaggtgcccttccacggcaagaccttcatcctgaagaccttcctgccctgcccagctgagctggtgtaccaggaggtgatcctgcagcctgagaggatggtgctgtggaacaagacagtgacagcctgccagatcctgcagagggtggaggacaacaccctcatctcctatgatgtgtctgctggagctgctgggggcgtggtgagcccccgggactttgtgaatgtgagaagaattgaaagaagaagagaccgctacctgagcagcggcatcgccaccagccacagcgccaagccacccacccacaagtatgtgcggggggagaatggacctgggggcttcatcgtgctgaagagcgccagcaacccccgggtgtgcacctttgtgtggatcctgaacacagacctgaagggccgcctgccccgctacctgatccaccagagcctggccgccaccatgtttgaatttgccttccacctgcggcagaggatcagcgagctgggcgcccgggcctag

SEQ ID NO: 171703 - DNA, 1284 bp, Artificial Sequence
  Description of Artificial Sequence: Synthetic coding sequence
atgagcaagctgccccgggagctgacccgggacctggagaggagcctgcctgctgtggccagcctgggcagcagcctgagccacagccagagcctgagcagccacctgctgcccccacctgagaagagaagagccatcagtgatgtgcggaggaccttctgcctgtttgtgacctttgacctgctcttcatcagcctgctgtggatcatcgagctgaacaccaacacaggcatcaggaagaacctggagcaggagatcatccagtacaacttcaagaccagcttctttgacatctttgtgctggccttcttccgcttcagcggcctgctgctgggctatgctgtgctgcggctgcggcactggtgggtgattgccctgctgagcaaaggagccttcggctacctgctgcccatcgtgtcctttgtgctggcctggctggagacctggttcctggacttcaaggtgctgccccaggaggccgaggaggagcgctggtacctggccgcccaggtggccgtggcccggggccccctgctcttcagcggggccctgtctgagggccagttctacagccccccagagagctttgctggcagtgacaatgaaagtgatgaggaggtggccggcaagaagagcttcagcgcccaggagcgggagtacatccggcagggcaaggaggccacagctgtggtggaccagatcctggcccaggaggagaactggaagtttgagaagaacaatgaatatggagacacagtgtacaccatcgaggtgcccttccacggcaagaccttcatcctgaagaccttcctgccctgcccagctgagctggtgtaccaggaggtgatcctgcagcctgagaggatggtgctgtggaacaagacagtgacagcctgccagatcctgcagagggtggaggacaacaccctcatctcctatgatgtgtctgctggagctgctgggggcgtggtgagcccccgggactttgtgaatgtgagaagaattgaaagaagaagagaccgctacctgagcagcggcatcgccaccagccacagcgccaagccacccacccacaagtatgtgcggggggagaatggacctgggggcttcatcgtgctgaagagcgccagcaacccccgggtgtgcacctttgtgtggatcctgaacacagacctgaagggccgcctgccccgctacctgatccaccagagcctggccgccaccatgtttgaatttgccttccacctgcggcagaggatcagcgagctgggcgcccgggcctag

SEQ ID NO: 171704 - DNA, 591 bp, Artificial Sequence
  Description of Artificial Sequence: Synthetic coding sequence
atgagcaagctgccccgggagctgacccgggacctggagaggagcctgcctgctgtggccagcctgggcagcagcctgagccacagccagagcctgagcagccacctgctgcccccacctgagaagagaagagccatcagtgatgtgcggaggaccttctgcctgtttgtgacctttgacctgctcttcatcagcctgctgtggatcatcgagctgaacaccaacacaggcatcaggaagaacctggagcaggagatcatccagtacaacttcaagaccagcttctttgacatctttgtgctggccttcttccgcttcagcggcctgctgctgggctatgctgtgctgcggctgcggcactggtgggtgattgctgtgaccaccctggtgagcagcgccttcctgattgtgaaggtgatcctgtctgagctgctgagcaaaggagccttcggctacctgctgcccatcgtgtcctttgtgctggcctggctggagacctggttcctggacttcaaggtgctgccccaggaggccgaggaggagcgctggtacctggccgcccaggtggccgtggcccggggccccctgtag

SEQ ID NO: 171705 - DNA, 1338 bp, Artificial Sequence
  Description of Artificial Sequence: Synthetic coding sequence
atgagcaagctgccccgggagctgacccgggacctggagaggagcctgcctgctgtggccagcctgggcagcagcctgagccacagccagagcctgagcagccacctgctgcccccacctgagaagagaagagccatcagtgatgtgcggaggaccttctgcctgtttgtgacctttgacctgctcttcatcagcctgctgtggatcatcgagctgaacaccaacacaggcatcaggaagaacctggagcaggagatcatccagtacaacttcaagaccagcttctttgacatctttgtgctggccttcttccgcttcagcggcctgctgctgggctatgctgtgctgcggctgcggcactggagccgccgctggtgccctgtgcacagcagcctgagccgcagcagcagcctgagctgcagcgccaagggccacctggccacctgcagccccagcagcctgctgagcagccctggctggaggcctggcagcctgaccagcaagagctaccccaggaagctgaagagaagtgacagcgcccctcctggctacctggccgcccaggtggccgtggcccggggccccctgctcttcagcggggccctgtctgagggccagttctacagccccccagagagctttgctggcagtgacaatgaaagtgatgaggaggtggccggcaagaagagcttcagcgcccaggagcgggagtacatccggcagggcaaggaggccacagctgtggtggaccagatcctggcccaggaggagaactggaagtttgagaagaacaatgaatatggagacacagtgtacaccatcgaggtgcccttccacggcaagaccttcatcctgaagaccttcctgccctgcccagctgagctggtgtaccaggaggtgatcctgcagcctgagaggatggtgctgtggaacaagacagtgacagcctgccagatcctgcagagggtggaggacaacaccctcatctcctatgatgtgtctgctggagctgctgggggcgtggtgagcccccgggactttgtgaatgtgagaagaattgaaagaagaagagaccgctacctgagcagcggcatcgccaccagccacagcgccaagccacccacccacaagtatgtgcggggggagaatggacctgggggcttcatcgtgctgaagagcgccagcaacccccgggtgtgcacctttgtgtggatcctgaacacagacctgaagggccgcctgccccgctacctgatccaccagagcctggccgccaccatgtttgaatttgccttccacctgcggcagaggatcagcgagctgggcgcccgggcctag

SEQ ID NO: 171706 - DNA, 618 bp, Artificial Sequence
  Description of Artificial Sequence: Synthetic coding sequence
atggagggcctgagtgatgtggccagctttgccaccaagctgaagaacaccctcatccagtaccacagcattgaggaggacaagtggagggtggccaagaagaccaaggatgtgacagtgtggaggaagcccagcgaggagttcaacggctacctgtacaaggcccagggcgtgattgatgacctggtgtacagcatcatcgaccacatccggcccggcccctgccgcctggactgggacagcctgatgaccagcctggacatcctggagaactttgaggagaactgctgcgtgatgagatacaccacagctggccagctgtggaacatcatcagcccccgggagtttgtggacttctcctacacagtgggctacaaggagggcctgctgagctgtggcatcagcctggactgggatgagaagaggcctgagtttgtgcggggctacaaccacccctgtggctggttctgtgtgcccctgaaggacaaccccaaccagagcctgctgaccggctacatccagacagacctgcggggcatgatcccccagagcgctgtggacacagccatggccagcaccctgaccaacttctacggggacctgaggaaggccctgtag

SEQ ID NO: 171707 - DNA, 576 bp, Artificial Sequence
  Description of Artificial Sequence: Synthetic coding sequence
atggagggcctgagtgatgtggccagctttgccaccaagctgaagaacaccctcatccagtaccacagcattgaggaggacaagtggagggtggccaagaagaccaaggatgtgacagtgtggaggaagcccagcgaggagttcaacggctacctgtacaaggcccagggcgtgattgatgacctggtgtacagcatcatcgaccacatccggcccggcccctgccgcctggactgggacagcctgatgaccagcctggacatcctggagaactttgaggagaactgctgcgtgatgagatacaccacagctggccagctgtggaacatcatcagcccccgggagtttgtggacttctcctacacagtgggctacaaggagggcctgctgagctgtggcatcagcctggactgggatgagaagaggcctgagtttgtgcggggctacaaccacccctgtggctggttctgtgtgcccctgaaggacaaccccaaccagagcctgctgaccggctacatccagacagacctgcggggcatgatcccccagagcgctgtggacacagccatggcctag

SEQ ID NO: 171708 - DNA, 642 bp, Artificial Sequence
  Description of Artificial Sequence: Synthetic coding sequence
atggaccctgccctggccgcccagatgtctgaggccgtggccgagaagatgctgcagtacagaagagacacagctggctggaagatctgccgggagggcaatggagtgtctgtgtcctggaggccttctgtggagttccctggcaacctgtacagaggagagggcatcgtgtatggcaccctggaggaggtgtgggactgtgtgaagccagctgtgggcggcctgcgggtgaagtgggatgaaaatgtgacaggctttgagatcatccagagcatcacagacaccctgtgtgtgtccaggaccagcaccccatctgctgccatgaagctgatcagcccccgggactttgtggacctggtgctggtgaagagatatgaagatggcaccatcagcagcaatgccacccacgtggagcaccccctgtgcccccccaagccaggctttgtgcggggcttcaaccacccctgtggctgcttctgtgagcccctgcccggggagcccaccaagaccaacctggtgaccttcttccacacagacctgagcggctacctgccccagaatgtggtggacagcttcttccccaggtccatgacccgcttctacgccaacctgcagaaggctgtgaagcagttccacgagtag

SEQ ID NO: 171709 - DNA, 663 bp, Artificial Sequence
  Description of Artificial Sequence: Synthetic coding sequence
atggacttcaaggccatcgcccagcagacagcccaggaggtgctgggctacaacagagacaccagcggctggaaggtggtgaagaccagcaagaagatcaccgtgagcagcaaggccagcaggaagttccacggcaacctgtacagagtggagggcatcatccctgagagccctgccaagctgagtgacttcctgtaccagacaggagaccgcatcacctgggacaagagcctgcaggtgtacaacatggtgcacagaattgacagcgacaccttcatctgccacaccatcacccagagctttgctgtgggcagcatcagcccccgggacttcatcgacctggtgtacatcaagagatatgagggcaacatgaacatcatcagcagcaagtctgtggacttccctgagtacccacccagcagcaactacatccggggctacaaccacccctgtggctttgtgtgcagccccatggaggagaacccagcctacagcaagctggtgatgtttgtgcagacagagatgaggggcaagctgagccccagcatcatcgagaagaccatgcccagcaacctggtgaacttcatcctgaatgccaaggatggcatcaaggcccacaggacccccagcagaagaggcttccaccacaacagccacagctag

SEQ ID NO: 171710 - DNA, 3072 bp, Artificial Sequence
  Description of Artificial Sequence: Synthetic coding sequence
atgaccctgaacaactgtgcctccatgaagctggaggtgcacttccagagcaagcagaatgaagattctgaggaggaggagcagtgcaccatcagcagccactgggccttccagcaggagagcaagtgctggagccccatgggcagcagtgacctgctggccccacccagccctggcctgcctgccaccagcagctgtgagagcgtgctgacagagctgagcgccaccagcctgcctgtgatcaccgtgtccctgcccccagagcctgctgacctgcccctgcccggccgggcccccagcagcagtgaccggcccctgctgagccccacccagggccaggagggcccccaggacaaggccaagaagaggcacaggaacagaagcttcctgaagcacctggagagcctgcggaggaaggagaagagcggcagccagcaggccgagcccaagcacagccctgccaccagcgagaaggtgtccaaggccagcagcttccgcagctgccggggcttcctgtctgctggcttctaccgggccaagaactgggccgccaccagcgctgggggcagcggggccaacaccaggaaggcctgggaggcctggcctgtggccagcttccgccacccccagtggacccacagaggagactgcctggtgcacgtgcctggggaccacaagccaggcaccttccccaggagcctgagcattgagagcctgtgcccagaagatggccaccggctggccgactggcagcccggccgccgctggggctgtgagggcagaagaggcagctgtggcagcacaggcagccacgccagcacctatgacaacctgcctgagctgtacccagctgagcctgtgatggtgggcgctgaggccgaggatgaagatgatgaggagagcggcggcagctatgcccacctggatgacatcctgcagcacgtgtggggcctgcagcagagggtggagctgtggagccgggccatgtacccagacctgggccctggagatgaggaggaggaggaggccaccagctctgtggagatcgccaccgtggaggtgaagtgccaggccgaggccctgagccagatggaggtgcctgcccatggagagagccctgcctgggcccaggccgaggtgcagcctgctgtgctggccccagcccaggccccagctgaggccgagcctgtggcccaggaggaggccgaggccccagccccagccccagccccagccccagcccaggacagcgagcaggaggcccacagcggcggggagcccacctttgccagcagcctgtctgtggaggagggccacagcatcagtgacacagtggccagcagcagcgagctggacagcagcggcaacagcatgaatgaagctgaggccgccggccccctggccggcctgcaggcctccatgccccgggagcggcgggacagcggcgtgggcgccagcctgacccggccctgcaggaagctgcgctggcacagcttccagaacagccaccggcccagcctgaacagcgagagcctggagatcaaccggcagtttgctggccagatcaacctgctgcacaagggcagcctgctgcggctgacagccttcatggagaagtacacagtgccccacaagcagggctgggtgtggagcatgcccaagttcatgagaagaaacaagaccccagactaccggggccagcacgtgtttggagtgcccccactcatccacgtgcagaggacaggccagcccctgccccagagcatccagcaggccatgagatacctgcggagccagtgcctggaccaggtgggcatcttcaggaagagcggcgtgaagagccgcatccagaacctgcggcagatgaatgagaccagcccagacaacgtgtgctatgagggccagagcgcctatgatgtggccgacctgctgaagcagtacttccgggacctgcctgagcccatcttcaccagcaagctgaccaccaccttcctgcagatctaccagctgctgcccaaggaccagtggctggccgccgcccaggccgccaccctgctgctgcctgatgagaaccgggaggtgctgcagaccctgctgtacttcctgagtgacatcgccagcgctgaggagaaccagatgacagctggcaacctggccgtgtgcctggcccccagcatcttccacctgaatgtgtccaagaaggacagccccagcccccgcatcaagagcaagaggagcctcatcggccggcccggcccccgggacctgagtgacaacatggccgccacccagggcctgagccacatgatcagtgactgcaagaagctgttccaggtgccccaggacatggtgctgcagctgtgcagcagctacagcgctgctgagctgagccccccaggccctgccctggccgagctgcggcaggcccaggccgccggcgtgtccctgagcctgtacatggaggagaacatccaggacctgctgagagatgctgctgagcgcttcaagggctggatgtctgtgcccggcccccagcacacagagctggcctgcaggaaggccccagatggccaccccctgcggctgtggaaggccagcacagaggtggccgcccccccagctgtggtgctgcaccgggtgctgcgggagcgggccctgtgggatgaggacctgctgcgggcccaggtgctggaggccctgatgcctggggtggagctgtaccactacgtgacagacagcatggccccccacccctgccgggactttgtggtgctgaggatgtggaggagtgacctgccccggggcggctgcctgctggtgtcccagagcctggaccctgagcagcctgtgcctgagagcggcgtgcgggccctgatgctgaccagccagtacctgatggagccctgtggcctgggccgcagccggctgacccacatctgcagagctgacctgcggggccgcagcccagactggtacaacaaggtgtttggccacctgtgtgccatggaggtggccaagatccgggacagcttccccaccctgcaggccgccggccctgagaccaagctgtag

SEQ ID NO: 171711 - DNA, 3072 bp, Artificial Sequence; identical to SEQ ID NO: 171710
  Description of Artificial Sequence: Synthetic coding sequence

SEQ ID NO: 171712 - DNA, 3312 bp, Artificial Sequence
  Description of Artificial Sequence: Synthetic coding sequence
atgcccctgctggatgtgttctggagctgcttcaggaaggtgaagtgcttccccctgctgcaggtgaagaagaatgctgaggccgaggccaagagggcctgtgagtggctgcaggccaccggcttcccccagtatgtgcagctgtttgaggagggcagcttccccctggacatcggctctgtgaagaagaaccacggcttcctggatgaggacagcctgggcgccctgtgccggcggctgatgaccctgaacaactgtgcctccatgaagctggaggtgcacttccagagcaagcagaatgaagattctgaggaggaggagcagtgcaccatcagcagccactgggccttccagcaggagagcaagtgctggagccccatgggcagcagtgacctgctggccccacccagccctggcctgcctgccaccagcagctgtgagagcgtgctgacagagctgagcgccaccagcctgcctgtgatcaccgtgtccctgcccccagagcctgctgacctgcccctgcccggccgggcccccagcagcagtgaccggcccctgctgagccccacccagggccaggagggcccccaggacaaggccaagaagaggcacaggaacagaagcttcctgaagcacctggagagcctgcggaggaaggagaagagcggcagccagcaggccgagcccaagcacagccctgccaccagcgagaaggtgtccaaggccagcagcttccgcagctgccggggcttcctgtctgctggcttctaccgggccaagaactgggccgccaccagcgctgggggcagcggggccaacaccaggaaggcctgggaggcctggcctgtggccagcttccgccacccccagtggacccacagaggagactgcctggtgcacgtgcctggggaccacaagccaggcaccttccccaggagcctgagcattgagagcctgtgcccagaagatggccaccggctggccgactggcagcccggccgccgctggggctgtgagggcagaagaggcagctgtggcagcacaggcagccacgccagcacctatgacaacctgcctgagctgtacccagctgagcctgtgatggtgggcgctgaggccgaggatgaagatgatgaggagagcggcggcagctatgcccacctggatgacatcctgcagcacgtgtggggcctgcagcagagggtggagctgtggagccgggccatgtacccagacctgggccctggagatgaggaggaggaggaggccaccagctctgtggagatcgccaccgtggaggtgaagtgccaggccgaggccctgagccagatggaggtgcctgcccatggagagagccctgcctgggcccaggccgaggtgcagcctgctgtgctggccccagcccaggccccagctgaggccgagcctgtggcccaggaggaggccgaggccccagccccagccccagccccagccccagcccaggacagcgagcaggaggcccacagcggcggggagcccacctttgccagcagcctgtctgtggaggagggccacagcatcagtgacacagtggccagcagcagcgagctggacagcagcggcaacagcatgaatgaagctgaggccgccggccccctggccggcctgcaggcctccatgccccgggagcggcgggacagcggcgtgggcgccagcctgacccggccctgcaggaagctgcgctggcacagcttccagaacagccaccggcccagcctgaacagcgagagcctggagatcaaccggcagtttgctggccagatcaacctgctgcacaagggcagcctgctgcggctgacagccttcatggagaagtacacagtgccccacaagcagggctgggtgtggagcatgcccaagttcatgagaagaaacaagaccccagactaccggggccagcacgtgtttggagtgcccccactcatccacgtgcagaggacaggccagcccctgccccagagcatccagcaggccatgagatacctgcggagccagtgcctggaccaggtgggcatcttcaggaagagcggcgtgaagagccgcatccagaacctgcggcagatgaatgagaccagcccagacaacgtgtgctatgagggccagagcgcctatgatgtggccgacctgctgaagcagtacttccgggacctgcctgagcccatcttcaccagcaagctgaccaccaccttcctgcagatctaccagctgctgcccaaggaccagtggctggccgccgcccaggccgccaccctgctgctgcctgatgagaaccgggaggtgctgcagaccctgctgtacttcctgagtgacatcgccagcgctgaggagaaccagatgacagctggcaacctggccgtgtgcctggcccccagcatcttccacctgaatgtgtccaagaaggacagccccagcccccgcatcaagagcaagaggagcctcatcggccggcccggcccccgggacctgagtgacaacatggccgccacccagggcctgagccacatgatcagtgactgcaagaagctgttccaggtgccccaggacatggtgctgcagctgtgcagcagctacagcgctgctgagctgagccccccaggccctgccctggccgagctgcggcaggcccaggccgccggcgtgtccctgagcctgtacatggaggagaacatccaggacctgctgagagatgctgctgagcgcttcaagggctggatgtctgtgcccggcccccagcacacagagctggcctgcaggaaggccccagatggccaccccctgcggctgtggaaggccagcacagaggtggccgcccccccagctgtggtgctgcaccgggtgctgcgggagcgggccctgtgggatgaggacctgctgcgggcccaggtgctggaggccctgatgcctggggtggagctgtaccactacgtgacagacagcatggccccccacccctgccgggactttgtggtgctgaggatgtggaggagtgacctgccccggggcggctgcctgctggtgtcccagagcctggaccctgagcagcctgtgcctgagagcggcgtgcgggccctgatgctgaccagccagtacctgatggagccctgtggcctgggccgcagccggctgacccacatctgcagagctgacctgcggggccgcagcccagactggtacaacaaggtgtttggccacctgtgtgccatggaggtggccaagatccgggacagcttccccaccctgcaggccgccggccctgagaccaagctgtag

SEQ ID NO: 171713 - DNA, 159 bp, Artificial Sequence
  Description of Artificial Sequence: Synthetic coding sequence
atgcccctgctggatgtgttctggagctgcttcaggaaggtgaagtgcttccccctgctgcaggtgaagaagaatgctgaggccgaggccaagagggcctgtgagtggctgcaggccaccggcttcccccagtatgtgcagctgtttgaaggaggatag

SEQ ID NO: 171714 - DNA, 189 bp, Artificial Sequence
  Description of Artificial Sequence: Synthetic coding sequence
atgaagttcctggtgtttgccttcatcctggccctgatggtgtccatgattggagctgacagcagcgaggagaagttcctgcggcgcatcggccgcttcggctacggctacggcccctaccagcctgtgcctgagcagcccctgtacccccagccctaccagccccagtaccagcagtacaccttctag

SEQ ID NO: 171715 - DNA, 159 bp, Artificial Sequence
  Description of Artificial Sequence: Synthetic coding sequence
atgaagttcctggtgtttgccttcatcctggccctgatggtgtccatgattggagctgacagcagcgaggagtatggctacggcccctaccagcctgtgcctgagcagcccctgtacccccagccctaccagccccagtaccagcagtacaccttctag

SEQ ID NO: 171716 - DNA, 843 bp, Artificial Sequence
  Description of Artificial Sequence: Synthetic coding sequence
atgcgctggttcctgccctggaccctggccgctgtgacagctgctgctgccagcacagtgctggccacagccctgagccctgcccccaccaccatggacttcaccccagcccccctggaggacaccagcagccggccccagttctgcaagtggccctgtgagtgcccccccagccccccacgctgccccctgggcgtgtccctcatcacagatggctgtgagtgctgcaagatgtgtgcccagcagctgggggacaactgcacagaggccgccatctgtgacccccaccggggcctgtactgtgactacagcggggaccggcccaggtatgccatcggcgtgtgtgcccatgctgtgggggaggtggaggcctggcacaggaactgcatcgcctacaccagcccctggagcccctgcagcaccagctgtggcctgggcgtgtccacccgcatcagcaatgtgaatgcccagtgctggccagagcaggagagccggctgtgcaacctgcggccctgtgatgtggacatccacaccctcatcaaggccggcaagaagtgcctggccgtgtaccagcctgaggcctccatgaacttcaccctggccggctgcatcagcaccaggagctaccagcccaagtactgcggcgtgtgcatggacaaccgctgctgcatcccctacaagagcaagaccattgatgtgtccttccagtgcccagatggcctgggcttcagccggcaggtgctgtggatcaatgcctgcttctgcaacctgagctgcaggaaccccaatgacatctttgctgacctggagagctacccagacttcagcgagatcgccaactag

SEQ ID NO: 171717 - DNA, 507 bp, Artificial Sequence
  Description of Artificial Sequence: Synthetic coding sequence
atggccaagacagccatggcctacaaggagaagatgaaggagctgtccatgctgagcctcatctgcagctgcttctacccagagcccaggaacatcaacatctacacctatgatgacatggaggtgaagcagatcaacaagagggccagcggccaggcctttgagctgatcctgaagccacccagccccaagaagaaggacctgagcctggaggagatccagaagaagctggaggccgctgaggagaggaggaagagccaggaggcccaggtgctgaagcagctggccgagaagcgggagcacgagcgggaggtgctgcagaaggccctggaggagaacaacaacttcagcaagatggccgaggagaagctgatcctgaagatggagcagatcaaggaaaatcgggaggccaacctggccgccatcatcgagcggctgcaggagaaggagagacatgctgctgaggtgagaagaaacaaggagctgcaggtggagctgtctggatag

SEQ ID NO: 171718 - DNA, 564 bp, Artificial Sequence
  Description of Artificial Sequence: Synthetic coding sequence
atggccaagacagccatggcctacaaggagaagatgaaggagctgtccatgctgagcctcatctgcagctgcttctacccagagcccaggaacatcaacatctacacctatgatgacatggaggtgaagcagatcaacaagagggccagcggccaggcctttgagctgatcctgaagccacccagccccatcagcgaggcccccaggaccctggccagccccaagaagaaggacctgagcctggaggagatccagaagaagctggaggccgctgaggagaggaggaagagccaggaggcccaggtgctgaagcagctggccgagaagcgggagcacgagcgggaggtgctgcagaaggccctggaggagaacaacaacttcagcaagatggccgaggagaagctgatcctgaagatggagcagatcaaggagaaccgggaggccaacctggccgccatcatcgagcggctgcaggagaagctggtgaagttcatcagcagcgagctgaaggagagcattgagagccagttcctggagctgcagcgggagggggagaagcagtag

SEQ ID NO: 171719 - DNA, 543 bp, Artificial Sequence
  Description of Artificial Sequence: Synthetic coding sequence
atggccagcaccatcagcgcctacaaggagaagatgaaggagctgtctgtgctgagcctcatctgcagctgcttctacacccagccccaccccaacacagtgtaccagtatggagacatggaggtgaagcagctggacaagagggccagcggccagagctttgaggtgatcctgaagagccccagcgacctgagccctgagagccccatgctgagcagcccccccaagaagaaggacaccagcctggaggagctgcagaagaggctggaggccgctgaggagaggaggaagacccaggaggcccaggtgctgaagcagctggccgagcggcgggagcacgagcgggaggtgctgcacaaggccctggaggagaacaacaacttcagccggcaggccgaggagaagctgaactacaagatggagctgagcaaggagatccgggaggcccacctggccgccctgcgggagcggctgcgggagaaggagctgcatgctgctgaggtgagaagaaacaaggagcagcgggaggagatgtctggatag

SEQ ID NO: 171720 - DNA, 510 bp, Artificial Sequence
  Description of Artificial Sequence: Synthetic coding sequence
atgaaggagctgtctgtgctgagcctcatctgcagctgcttctacacccagccccaccccaacacagtgtaccagtacggggacatggaggtgaagcagctggacaagagggccagcggccagagctttgaagtcatcctgaagagccccagcgacctgagccctgagagccccatgctgagcagcccccccaagaagaaggacaccagcctggaggagctgcagaagaggctggaggccgctgaggagaggaggaagacccaggaggcccaggtgctgaagcagctggccgagcggcgggagcacgagcgggaggtgctgcacaaggccctggaggagaacaacaacttcagccggcaggccgaggagaagctgaactacaagatggagctgagcaaggagatccgggaggcccacctggccgccctgcgggagcggctgcgggagaaggagctgcacgccgctgaggtgagaagaaacaaggagcagcgggaggagatgagcggctag

SEQ ID NO: 171721 - DNA, 1422 bp, Artificial Sequence
  Description of Artificial Sequence: Synthetic coding sequence
atgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcacccccaccgtggagctgaatggcctggccatgaagagaggagagcccgccatctaccggcccctggaccccaagcccttccccaactaccgggccaactacaacttccggggcatgtacaaccagcgctaccactgccctgtgcccaagatcttctacgtgcagctgactgtgggcaacaatgagttcttcggggagggcaagacccggcaggccgcccggcacaatgctgccatgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgaagagctttgtgaccagggtgtctgtgggggagttctctgctgagggggagggcaacagcaagaagctgagcaagaagagagctgccaccaccgtgctgcaggagctgaagaagctgccccccctgcctgtggtggagaagcccaagctgttcttcaagaagaggcccaagaccatcgtgaaggccggcccagaatatggccagggcatgaaccccatcagccggctggcccagatccagcaggccaagaaggagaaggagccagactatgtgctgctgtctgagcggggcatgcccaggagaagagaatttgtgatgcaggtgaaggtgggcaatgaggtggccaccggcaccggccccaacaagaagatcgccaagaagaatgctgctgaggccatgctgctgcagctgggctacaaggccagcaccaacctgcaggaccagctggagaagacaggagagaacaagggctggagcggccccaagccaggcttccctgagcccaccaacaacacccccaagggcatcctgcacctgagcccagatgtgtaccaggagatggaggccagccgccacaaggtgatcagcggcaccaccctgggctacctgagccccaaggacatgaaccagcccagcagcagcttcttcagcatcagccccaccagcaacagcagcgccaccatcgcccgggagctgctgatgaatggcaccagcagcacagctgaggccatcggcctgaagggcagcagccccaccccaccctgcagccctgtgcagcccagcaagcagctggagtacctggcccgcatccagggcttccaggtgtag

SEQ ID NO: 171722 - DNA, 1515 bp, Artificial Sequence
  Description of Artificial Sequence: Synthetic coding sequence
atgaagagaggagagcccgccatctaccggcccctggaccccaagcccttccccaactaccgggccaactacaacttccggggcatgtacaaccagcgctaccactgccctgtgcccaagatcttctacgtgcagctgactgtgggcaacaatgagttcttcggggagggcaagacccggcaggccgcccggcacaatgctgccatgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgaagagctttgtgaccagggtgtctgtgggggagttctctgctgagggggagggcaacagcaagaagctgagcaagaagagagctgccaccaccgtgctgcaggagctgaagaagctgccccccctgcctgtggtggagaagcccaagctgttcttcaagaagaggcccaagaccatcgtgaaggccggcccagaatatggccagggcatgaaccccatcagccggctggcccagatccagcaggccaagaaggagaaggagccagactatgtgctgctgtctgagcggggcatgcccaggagaagagaatttgtgatgcaggtgaaggtgggcaatgaggtggccaccggcaccggccccaacaagaagatcgccaagaagaatgctgctgaggccatgctgctgcagctgggctacaaggccagcaccaacctgcaggaccagctggagaagacaggagagaacaagggctggagcggccccaagccaggcttccctgagcccaccaacaacacccccaagggcatcctgcacctgagcccagatgtgtaccaggagatggaggccagccgccacaaggtgatcagcggcaccaccctgggctacctgagccccaaggacatgaaccagcccagcagcagcttcttcagcatcagccccaccagcaacagcagcgccaccatcgcccgggagctgctgatgaatggcaccagcagcacagctgaggccatcggcctgaagggcagcagccccaccccaccctgcagccctgtgcagcccagcaagcagctggagtacctggcccgcatccagggcttccaggtgcactactgtgaccggcagagcggcaaggaatgtgtgacctgcctgaccctggcccctgtgcagatgaccttccacgccatcggcagcagcattgaggccagccatgaccaggccgccctgagcgccctgaagcagttcagcgagcagggcctggaccccattgatggagccatgaacatcgagaagggcagcctggagaagcaggccaagcacctgcgggagaaggctgacaacaaccaggcccctcctggcagcatcgcccaggactgcaagaagagcaacagcgctgtgtag

SEQ ID NO: 171723 - DNA, 1197 bp, Artificial Sequence
  Description of Artificial Sequence: Synthetic coding sequence
atgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgaagagctttgtgaccagggtgtctgtgggggagttctctgctgagggggagggcaacagcaagaagctgagcaagaagagagctgccaccaccgtgctgcaggagctgaagaagctgccccccctgcctgtggtggagaagcccaagctgttcttcaagaagaggcccaagaccatcgtgaaggccggcccagaatatggccagggcatgaaccccatcagccggctggcccagatccagcaggccaagaaggagaaggagccagactatgtgctgctgtctgagcggggcatgcccaggagaagagaatttgtgatgcaggtgaaggtgggcaatgaggtggccaccggcaccggccccaacaagaagatcgccaagaagaatgctgctgaggccatgctgctgcagctgggctacaaggccagcaccaacctgcaggaccagctggagaagacaggagagaacaagggctggagcggccccaagccaggcttccctgagcccaccaacaacacccccaagggcatcctgcacctgagcccagatgtgtaccaggagatggaggccagccgccacaaggtgatcagcggcaccaccctgggctacctgagccccaaggacatgaaccagcccagcagcagcttcttcagcatcagccccaccagcaacagcagcgccaccatcgcccgggagctgctgatgaatggcaccagcagcacagctgaggccatcggcctgaagggcagcagccccaccccaccctgcagccctgtgcagcccagcaagcagctggagtacctggcccgcatccagggcttccaggccgccctgagcgccctgaagcagttcagcgagcagggcctggaccccattgatggagccatgaacatcgagaagggcagcctggagaagcaggccaagcacctgcgggagaaggctgacaacaaccaggcccctcctggcagcatcgcccaggactgcaagaagagcaacagcgctgtgtag

SEQ ID NO: 171724 - DNA, 1440 bp, Artificial Sequence
  Description of Artificial Sequence: Synthetic coding sequence
atgctgcagatcaaccagatgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcacccccaccgtggagctgaatggcctggccatgaagagaggagagcccgccatctaccggcccctggaccccaagcccttccccaactaccgggccaactacaacttccggggcatgtacaaccagcgctaccactgccctgtgcccaagatcttctacgtgcagctgactgtgggcaacaatgagttcttcggggagggcaagacccggcaggccgcccggcacaatgctgccatgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgaagagctttgtgaccagggtgtctgtgggggagttctctgctgagggggagggcaacagcaagaagctgagcaagaagagagctgccaccaccgtgctgcaggagctgaagaagctgccccccctgcctgtggtggagaagcccaagctgttcttcaagaagaggcccaagaccatcgtgaaggccggcccagaatatggccagggcatgaaccccatcagccggctggcccagatccagcaggccaagaaggagaaggagccagactatgtgctgctgtctgagcggggcatgcccaggagaagagaatttgtgatgcaggtgaaggtgggcaatgaggtggccaccggcaccggccccaacaagaagatcgccaagaagaatgctgctgaggccatgctgctgcagctgggctacaaggccagcaccaacctgcaggaccagctggagaagacaggagagaacaagggctggagcggccccaagccaggcttccctgagcccaccaacaacacccccaagggcatcctgcacctgagcccagatgtgtaccaggagatggaggccagccgccacaaggtgatcagcggcaccaccctgggctacctgagccccaaggacatgaaccagcccagcagcagcttcttcagcatcagccccaccagcaacagcagcgccaccatcgcccgggagctgctgatgaatggcaccagcagcacagctgaggccatcggcctgaagggcagcagccccaccccaccctgcagccctgtgcagcccagcaagcagctggagtacctggcccgcatccagggcttccaggtgtag

SEQ ID NO: 171725 - DNA, 615 bp, Artificial Sequence
  Description of Artificial Sequence: Synthetic coding sequence
atgctgcagatcaaccagatgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcacccccaccgtggagctgaatggcctggccatgaagagaggagagcccgccatctaccggcccctggaccccaagcccttccccaactaccgggccaactacaacttccggggcatgtacaaccagcgctaccactgccctgtgcccaagatcttctacgtgcagctgactgtgggcaacaatgagttcttcggggagggcaagacccggcaggccgcccggcacaatgctgccatgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgtag

SEQ ID NO: 171726 - DNA, 195 bp, Artificial Sequence
  Description of Artificial Sequence: Synthetic coding sequence
atgctgcagatcaaccagatgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcaccccctag

SEQ ID NO: 171727 - DNA, 1440 bp, Artificial Sequence; identical to SEQ ID NO: 171724
  Description of Artificial Sequence: Synthetic coding sequence

SEQ ID NO: 171728 - DNA, 1617 bp, Artificial Sequence
  Description of Artificial Sequence: Synthetic coding sequence
atgctgcagatcaaccagatgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcacccccaccgtggagctgaatggcctggccatgaagagaggagagcccgccatctaccggcccctggaccccaagcccttccccaactaccgggccaactacaacttccggggcatgtacaaccagcgctaccactgccctgtgcccaagatcttctacgtgcagctgactgtgggcaacaatgagttcttcggggagggcaagacccggcaggccgcccggcacaatgctgccatgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgaagagctttgtgaccagggtgtctgtgggggagttctctgctgagggggagggcaacagcaagaagctgagcaagaagagagctgccaccaccgtgctgcaggagctgaagaagctgccccccctgcctgtggtggagaagcccaagctgttcttcaagaagaggcccaagaccatcgtgaaggccggcccagaatatggccagggcatgaaccccatcagccggctggcccagatccagcaggccaagaaggagaaggagccagactatgtgctgctgtctgagcggggcatgcccaggagaagagaatttgtgatgcaggtgaaggtgggcaatgaggtggccaccggcaccggccccaacaagaagatcgccaagaagaatgctgctgaggccatgctgctgcagctgggctacaaggccagcaccaacctgcaggaccagctggagaagacaggagagaacaagggctggagcggccccaagccaggcttccctgagcccaccaacaacacccccaagggcatcctgcacctgagcccagatgtgtaccaggagatggaggccagccgccacaaggtgatcagcggcaccaccctgggctacctgagccccaaggacatgaaccagcccagcagcagcttcttcagcatcagccccaccagcaacagcagcgccaccatcgcccgggagctgctgatgaatggcaccagcagcacagctgaggccatcggcctgaagggcagcagccccaccccaccctgcagccctgtgcagcccagcaagcagctggagtacctggcccgcatccagggcttccaggccgccctgagcgccctgaagcagttcagcgagcagggcctggaccccattgatggagccatgaacatcgagaagggcagcctggagaagcaggccaagcacctgcgggagaaggctgacaacaaccaggcccctcctggcagcatcgcccaggactgcaagaagagcaacagcgctgtgtag

SEQ ID NO: 171729 - DNA, 318 bp, Artificial Sequence
  Description of Artificial Sequence: Synthetic coding sequence
atgctgcagatcaaccagatgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcacccccaccgtggagctgaatggcctggccatgaagagaggagagcccgccatctaccggcccctggaccccaagcccttccccaactaccgggccaactacaacttccggggcatgtacaaccagaggtag

SEQ ID NO: 171730 - DNA, 1713 bp, Artificial Sequence
  Description of Artificial Sequence: Synthetic coding sequence
atggccaaccccaaggagaagacagccatgtgcctggtgaatgagctggcccgcttcaacagagtgcagccccagtacaagctgctgaatgaaagaggccctgcccacagcaagatgttttctgtgcagctgagcctgggggagcagacctgggagagcgagggcagcagcatcaagaaggcccagcaggccgtggccaacaaggccctgacagagagcaccctgcccaagcctgtgcagaagccacccaagagcaatgtgaacaacaaccctggcagcatcacccccaccgtggagctgaatggcctggccatgaagagaggagagcccgccatctaccggcccctggaccccaagcccttccccaactaccgggccaactacaacttccggggcatgtacaaccagcgctaccactgccctgtgcccaagatcttctacgtgcagctgactgtgggcaacaatgagttcttcggggagggcaagacccggcaggccgcccggcacaatgctgccatgaaggccctgcaggccctgcagaatgagcccatccctgagaggagcccccagaatggagagagcggcaaggatgtggatgatgacaaggatgccaacaagtctgagatcagcctggtgtttgaaattgccctgaagaggaacatgcctgtgtcctttgaagtcatcaaggagagcggccccccccacatgaagagctttgtgaccagggtgtctgtgggggagttctctgctgagggggagggcaacagcaagaagctgagcaagaagagagctgccaccaccgtgctgcaggagctgaagaagctgccccccctgcctgtggtggagaagcccaagctgttcttcaagaagaggcccaagaccatcgtgaaggccggcccagaatatggccagggcatgaaccccatcagccggctggcccagatccagcaggccaagaaggagaaggagccagactatgtgctgctgtctgagcggggcatgcccaggagaagagaatttgtgatgcaggtgaaggtgggcaatgaggtggccaccggcaccggccccaacaagaagatcgccaagaagaatgctgctgaggccatgctgctgcagctgggctacaaggccagcaccaacctgcaggaccagctggagaagacaggagagaacaagggctggagcggccccaagccaggcttccctgagcccaccaacaacacccccaagggcatcctgcacctgagcccagatgtgtaccaggagatggaggccagccgccacaaggtgatcagcggcaccaccctgggctacctgagccccaaggacatgaaccagcccagcagcagcttcttcagcatcagccccaccagcaacagcagcgccaccatcgcccgggagctgctgatgaatggcaccagcagcacagctgaggccatcggcctgaagggcagcagccccaccccaccctgcagccctgtgcagcccagcaagcagctggagtacctggcccgcatccagggcttccaggccgccctgagcgccctgaagcagttcagcgagcagggcctggaccccattgatggagccatgaacatcgagaagggcagcctggagaagcaggccaagcacctgcgggagaaggctgacaacaaccaggcccctcctggcagcatcgcccaggactgcaagaagagcaacagcgctgtgtag

SEQ ID NO: 171731 - DNA, 1044 bp, Artificial Sequence
  Description of Artificial Sequence: Synthetic coding sequence
agcctgctgaccaatgatgccagcagcgagagcatcgccagcttcagcaagcaggaggtgatgagcagcttcctgcctgagggcggctgctatgagctgctgactgtgattggaaaaggatttgaggacctgatgacagtgaacctggcccgctacaagcccactggagaatatgtgacagtgcggcgcatcaacctggaggcctgcagcaatgagatggtgaccttcctgcagggcgagctgcacgtgtccaagctgttcaaccaccccaacatcgtgccctaccgggccaccttcatcgctgacaatgagctgtgggtggtgaccagcttcatggcctacggcagcgccaaggacctgatctgcacccacttcatggatggcatgaatgagctggccatcgcctacatcctgcagggcgtgctgaaggccctggactacatccaccacatgggctacgtgcacaggtctgtgaaggccagccacatcctgatctctgtggatggcaaggtgtacctgagcggcctgcggagcaacctgtccatgatcagccacggccagaggcagagggtggtgcatgacttccccaagtacagcgtgaaggtgctgccctggctgagccctgaggtgctgcagcagaacctgcagggctatgatgccaagagtgacatctacagcgtgggcatcacagcctgtgagctggccaacggccacgtgcccttcaaggacatgcctgccacccagatgctgctggagaagctgaatggaacagtgccctgcctgctggacaccagcaccatcccagctgaggagctgaccatgagccccagccgctctgtggccaacagcggcctgagtgacagcctgaccaccagcaccccccggcccagcaatggagacagccccagccacccctaccacaggaccttcagcccccacttccaccactttgtggagcagtgcctgcagaggaacccagatgcccgctacccctgctggccaggccctggcctgcgggagagccggggctgcagcggcggctag

SEQ ID NO: 171732 - DNA, 1296 bp, Artificial Sequence
  Description of Artificial Sequence: Synthetic coding sequence
atgtccttcctggtgtccaagccagagcgcatccgccgctgggtgtctgagaagttcatcgtggagggcctgcgggacctggagctgtttggagagcagcccccaggggacaccaggaggaagaccaatgatgccagcagcgagagcatcgccagcttcagcaagcaggaggtgatgagcagcttcctgcctgagggcggctgctatgagctgctgactgtgattggaaaaggatttgaggacctgatgacagtgaacctggcccgctacaagcccactggagaatatgtgacagtgcggcgcatcaacctggaggcctgcagcaatgagatggtgaccttcctgcagggcgagctgcacgtgtccaagctgttcaaccaccccaacatcgtgccctaccgggccaccttcatcgctgacaatgagctgtgggtggtgaccagcttcatggcctacggcagcgccaaggacctgatctgcacccacttcatggatggcatgaatgagctggccatcgcctacatcctgcagggcgtgctgaaggccctggactacatccaccacatgggctacgtgcacaggtctgtgaaggccagccacatcctgatctctgtggatggcaaggtgtacctgagcggcctgcggagcaacctgtccatgatcagccacggccagaggcagagggtggtgcatgacttccccaagtacagcgtgaaggtgctgccctggctgagccctgaggtgctgcagcagaacctgcagggctatgatgccaagagtgacatctacagcgtgggcatcacagcctgtgagctggccaacggccacgtgcccttcaaggacatgcctgccacccagatgctgctggagaagctgaatggaacagtgccctgcctgctggacaccagcaccatcccagctgaggagctgaccatgagccccagccgctctgtggccaacagcggcctgagtgacagcctgaccaccagcaccccccggcccagcaatggagacagccccagccacccctaccacaggaccttcagcccccacttccaccactttgtggagcagtgcctgcagaggaacccagatgcccggcccagcgccagcaccctgctgaaccacagcttcttcaagcagatcaagaggcgggccagcgaggccctgcctgagctgctgcggcctgtgacccccatcaccaactttgagggcagccagagccaggaccacagcggcatcttcggcctggtgaccaacctggaggagctggaggtggatgactgggagttctag

SEQ ID NO: 171733 - DNA, 1122 bp, Artificial Sequence
  Description of Artificial Sequence: Synthetic coding sequence
atgagcagcttcctgcctgagggcggctgctatgagctgctgactgtgattggaaaaggatttgaggacctgatgacagtgaacctggcccgctacaagcccactggagaatatgtgacagtgcggcgcatcaacctggaggcctgcagcaatgagatggtgaccttcctgcagggcgagctgcacgtgtccaagctgttcaaccaccccaacatcgtgccctaccgggccaccttcatcgctgacaatgagctgtgggtggtgaccagcttcatggcctacggcagcgccaaggacctgatctgcacccacttcatggatggcatgaatgagctggccatcgcctacatcctgcagggcgtgctgaaggccctggactacatccaccacatgggctacgtgcacaggtctgtgaaggccagccacatcctgatctctgtggatggcaaggtgtacctgagcggcctgcggagcaacctgtccatgatcagccacggccagaggcagagggtggtgcatgacttccccaagtacagcgtgaaggtgctgccctggctgagccctgaggtgctgcagcagaacctgcagggctatgatgccaagagtgacatctacagcgtgggcatcacagcctgtgagctggccaacggccacgtgcccttcaaggacatgcctgccacccagatgctgctggagaagctgaatggaacagtgccctgcctgctggacaccagcaccatcccagctgaggagctgaccatgagccccagccgctctgtggccaacagcggcctgagtgacagcctgaccaccagcaccccccggcccagcaatggagacagccccagccacccctaccacaggaccttcagcccccacttccaccactttgtggagcagtgcctgcagaggaacccagatgcccggcccagcgccagcaccctgctgaaccacagcttcttcaagcagatcaagaggcgggccagcgaggccctgcctgagctgctgcggcctgtgacccccatcaccaactttgagggcagccagagccaggaccacagcggcatcttcggcctggtgaccaacctggaggagctggaggtggatgactgggagttctag

SEQ ID NO: 171734 - DNA, 1047 bp, Artificial Sequence
  Description of Artificial Sequence: Synthetic coding sequence
atgtccttcctgaccaatgatgccagcagcgagagcatcgccagcttcagcaagcaggaggtgatgagcagcttcctgcctgagggcggctgctatgagctgctgaccgtcatcggcaagggctttgaggacctgatgacagtgaacctggcccgctacaagcccaccggggagtatgtgacagtgcggcgcatcaacctggaggcctgcagcaatgagatggtgaccttcctgcagggcgagctgcacgtgtccaagctgttcaaccaccccaacatcgtgccctaccgggccaccttcatcgctgacaatgagctgtgggtggtgaccagcttcatggcctacggcagcgccaaggacctgatctgcacccacttcatggatggcatgaatgagctggccatcgcctacatcctgcagggcgtgctgaaggccctggactacatccaccacatgggctacgtgcacaggtctgtgaaggccagccacatcctgatctctgtggatggcaaggtgtacctgagcggcctgcggagcaacctgtccatgatcagccacggccagaggcagagggtggtgcatgacttccccaagtacagcgtgaaggtgctgccctggctgagccctgaggtgctgcagcagaacctgcagggctatgatgccaagagtgacatctacagcgtgggcatcacagcctgtgagctggccaatggacatgtgcccttcaaggacatgcctgccacccagatgctgctggagaagctgaatggcaccgtgccctgcctgctggacaccagcaccatcccagctgaggagctgaccatgagccccagccgctctgtggccaacagcggcctgagtgacagcctgaccaccagcaccccccggcccagcaatggagacagccccagccacccctaccacaggaccttcagcccccacttccaccactttgtggagcagtgcctgcagagaaatccagatgcccgctacccctgctggccaggccctggcctgcgggagagccggggctgcagcggcggctag

SEQ ID NO: 171735 - DNA, 900 bp, Artificial Sequence
  Description of Artificial Sequence: Synthetic coding sequence
atgtccttcctggtgtccaagccagagcgcatccgccgctgggtgtctgagaagttcatcgtggagggcctgcgggacctggagctgtttggaggaaaaggatttgaggacctgatgacagtgaacctggcccgctacaagcccactggagaatatgtgacagtgcggcgcatcaacctggaggcctgcagcaatgagatggtgaccttcctgcagggcgagctgcacgtgtccaagctgttcaaccaccccaacatcgtgccctaccgggccaccttcatcgctgacaatgagctgtgggtggtgaccagcttcatggcctacggcagcgccaaggacctgatctgcacccacttcatggatggcatgaatgagctggccatcgcctacatcctgcagggcgtgctgaaggccctggactacatccaccacatgggctacgtgcacaggtctgtgaaggccagccacatcctgatctctgtggatggcaaggtgtacctgagcggcctgcggagcaacctgtccatgatcagccacggccagaggcagagggtggtgcatgacttccccaagtacagcgtgaaggtgctgccctggctgagccctgaggtgctgcagcagaacctgcagggctatgatgccaagagtgacatctacagcgtgggcatcacagcctgtgagctggccaacggccacgtgcccttcaaggacatgcctgccacccagatgctgctggagaagctgaatggaacagtgccctgcctgctggacaccagcaccatcccagctgaggagctgaccatgagccccagccgctctgtggccaacagcggcctgagtgacagcctgaccaccagcaccccccggcccagcaatggacctgtgcctgcccccagctag

SEQ ID NO: 171736 - DNA, 1257 bp, Artificial Sequence
  Description of Artificial Sequence: Synthetic coding sequence
atgagcctgctggactgcttctgcaccagcaggacccaggtggagagcctgcggcctgagaagcagagcgagaccagcatccaccagtacctggtggatgagcccaccctgtcctggagccggcccagcacccgggccagcgaggtgctgtgcagcaccaacgtgagccactatgagctgcaggtggagatcggccggggctttgacaacctgacctctgtgcacctggcccggcacacccccaccggcaccctggtgaccatcaagatcaccaacctggagaactgcaatgaggagcggctgaaggccctgcagaaggctgtgatcctgagccacttcttccgccaccccaacatcaccacctactggacagtgttcaccgtgggctcctggctgtgggtgatcagccccttcatggcctacggcagcgccagccagctgctgcggacctacttccctgagggcatgtctgagaccctcatccggaacatcctgtttggagctgtgcggggcctgaactacctgcaccagaatggctgcatccacaggagcatcaaggccagccacatcctgatctctggagatggcctggtgaccctgagcggcctgagccacctgcacagcctggtgaagcacggccagaggcacagagctgtgtatgacttcccccagttcagcacctctgtgcagccctggctgagccctgagctgctgcggcaggacctgcacggctacaacgtgaagagtgacatctacagcgtgggcatcacagcctgtgagctggccagcggccaggtgcccttccaggacatgcacaggacccagatgctgctgcagaagctgaagggccccccctacagccccctggacatcagcatcttcccccagagcgagagcaggatgaagaacagccagagcggcgtggacagcggcatcggggagagcgtgctggtgagcagcggcacccacacagtgaacagcgaccggctgcacacccccagcagcaagaccttcagccctgccttcttcagcctggtgcagctgtgcctgcagcaggaccctgagaagaggccttctgccagcagcctgctgagccacgtgttcttcaagcagatgaaggaggagagccaggacagcatcctgagcctgctgcccccagcctacaacaagcccagcatcagcctgccccctgtgctgccctggacagagccagaatgtgacttcccagatgagaaggacagctactgggagttctag

SEQ ID NO: 171737 - DNA, 1134 bp, Artificial Sequence
  Description of Artificial Sequence: Synthetic coding sequence
atgagcctgctggactgcttctgcaccagcaggacccaggtggagagcctgcggcctgagaagcagagcgagaccagcatccaccagtacctggtggatgagcccaccctgtcctggagccggcccagcacccgggccagcgaggtgctgtgcagcaccaacgtgagccactatgagctgcaggtggagatcggccggggctttgacaacctgacctctgtgcacctggcccggcacacccccaccggcaccctggtgaccatcaagatcaccaacctggagaactgcaatgaggagcggctgaaggccctgcagaaggctgtgatcctgagccacttcttccgccaccccaacatcaccacctactggacagtgttcaccgtgggctcctggctgtgggtgatcagccccttcatggcctacggcagcgccagccagctgctgcggacctacttccctgagggcatgtctgagaccctcatccggaacatcctgtttggagctgtgcggggcctgaactacctgcaccagaatggctgcatccacaggagcatcaaggccagccacatcctgatctctggagatggcctggtgaccctgagcggcctgagccacctgcacagcctggtgaagcacggccagaggcacagagctgtgtatgacttcccccagttcagcacctctgtgcagccctggctgagccctgagctgctgcggcaggacctgcacggctacaacgtgaagagtgacatctacagcgtgggcatcacagcctgtgagctggccagcggccaggtgcccttccaggacatgcacaggacccagatgctgctgcagaagctgaagggccccccctacagccccctggacatcagcatcttcccccagagcgagagcaggatgaagaacagccagagcggcgtggacagcggcatcggggagagcgtgctggtgagcagcggcacccacacagtgaacagcgaccggctgcacacccccagcagcaagaccttcagccctgccttcttcagcctggtgcagctgtgcctgcagcaggaccctgagaagaggccttctgccagcagcctgctgagccacgtgttcttcaagcagccctactttgagttcctgtag

SEQ ID NO: 171738 - DNA, 843 bp, Artificial Sequence
  Description of Artificial Sequence: Synthetic coding sequence
ctgggctactgcagcgccagccagctgctgcggacctacttccctgagggcatgtctgagaccctcatccggaacatcctgtttggagctgtgcggggcctgaactacctgcaccagaatggctgcatccacaggagcatcaaggccagccacatcctgatctctggagatggcctggtgaccctgagcggcctgagccacctgcacagcctggtgaagcacggccagaggcacagagctgtgtatgacttcccccagttcagcacctctgtgcagccctggctgagccctgagctgctgcggcaggacctgcacggctacaacgtgaagagtgacatctacagcgtgggcatcacagcctgtgagctggccagcggccaggtgcccttccaggacatgcacaggacccagatgctgctgcagaagctgaagggccccccctacagccccctggacatcagcatcttcccccagagcgagagcaggatgaagaacagccagagcggcgtggacagcggcatcggggagagcgtgctggtgagcagcggcacccacacagtgaacagcgaccggctgcacacccccagcagcaagaccttcagccctgccttcttcagcctggtgcagctgtgcctgcagcaggaccctgagaagaggccttctgccagcagcctgctgagccacgtgttcttcaagcagatgaaggaggagagccaggacagcatcctgagcctgctgcccccagcctacaacaagcccagcatcagcctgccccctgtgctgccctggacagagccagaatgtgacttcccagatgagaaggacagctactgggagttctag

SEQ ID NO: 171739 - DNA, 1257 bp, Artificial Sequence; identical to SEQ ID NO: 171736
  Description of Artificial Sequence: Synthetic coding sequence

SEQ ID NO: 171740 - DNA, 1260 bp, Artificial Sequence
  Description of Artificial Sequence: Synthetic coding sequence
atggagagcatctccatgatgggcagccccaagagcctgtctgagaccttcctgcccaacggcatcaatggcatcaaggatgccaggaaggtgacagtgggcgtcatcggcagcggggactttgccaagagcctgaccatccgcctcatccgctgtggctaccacgtggtgattggcagcaggaaccccaagtttgccagcgagttcttcccccacgtggtggatgtgacccaccatgaagatgccctgaccaagaccaacatcatctttgtggccatccaccgggagcactacaccagcctgtgggacctgcggcacctgctggtgggcaagatcctgattgatgtgagcaacaacatgaggatcaaccagtacccagagagcaatgctgagtacctggccagcctcttcccagacagcctcatcgtgaagggcttcaacgtggtgtctgcctgggccctgcagctgggccccaaggatgccagccggcaggtgtacatctgcagcaacaacatccaggcccggcagcaggtgattgagctggcccggcagctgaacttcatccccatcgacctgggcagcctgagcagcgcccgggagattgagaacctgcccctgcggctcttcaccctgtggaggggccctgtggtggtggccatcagcctggccaccttcttcttcctgtacagctttgtgagagatgtgatccacccctatgccaggaaccagcagagcgacttctacaagatccccatcgagatcgtgaacaagaccctgcccatcgtggccatcaccctgctgagcctggtgtacctggccggcctgctggccgccgcctaccagctgtactacggcaccaagtaccgccgcttccccccctggctggagacctggctgcagtgcaggaagcagctgggcctgctgtccttcttctttgccatggtgcacgtggcctacagcctgtgcctgcccatgagaagaagtgagcgctacctgttcctgaacatggcctaccagcaggtgcacgccaacatcgagaacagctggaatgaggaggaggtgtggagaattgagatgtacatcagctttggcatcatgagcctgggcctgctgagcctgctggccgtgaccagcatccccagcgtgtccaatgccctgaactggagggagttctccttcatccagatcttctgcagctttgctgacacccagacagagctggagctggagtttgtgttcctgctgaccctgctgctgtag

SEQ ID NO: 171741 - DNA, 1473 bp, Artificial Sequence
  Description of Artificial Sequence: Synthetic coding sequence
atggagagcatctccatgatgggcagccccaagagcctgtctgagaccttcctgcccaacggcatcaatggcatcaaggatgccaggaaggtgacagtgggcgtcatcggcagcggggactttgccaagagcctgaccatccgcctcatccgctgtggctaccacgtggtgattggcagcaggaaccccaagtttgccagcgagttcttcccccacgtggtggatgtgacccaccatgaagatgccctgaccaagaccaacatcatctttgtggccatccaccgggagcactacaccagcctgtgggacctgcggcacctgctggtgggcaagatcctgattgatgtgagcaacaacatgaggatcaaccagtacccagagagcaatgctgagtacctggccagcctcttcccagacagcctcatcgtgaagggcttcaacgtggtgtctgcctgggccctgcagctgggccccaaggatgccagccggcaggtgtacatctgcagcaacaacatccaggcccggcagcaggtgattgagctggcccggcagctgaacttcatccccatcgacctgggcagcctgagcagcgcccgggagattgagaacctgcccctgcggctcttcaccctgtggaggggccctgtggtggtggccatcagcctggccaccttcttcttcctgtacagctttgtgagagatgtgatccacccctatgccaggaaccagcagagcgacttctacaagatccccatcgagatcgtgaacaagaccctgcccatcgtggccatcaccctgctgagcctggtgtacctggccggcctgctggccgccgcctaccagctgtactacggcaccaagtaccgccgcttccccccctggctggagacctggctgcagtgcaggaagcagctgggcctgctgtccttcttctttgccatggtgcacgtggcctacagcctgtgcctgcccatgagaagaagtgagcgctacctgttcctgaacatggcctaccagcaggtgcacgccaacatcgagaacagctggaatgaggaggaggtgtggagaattgagatgtacatcagctttggcatcatgagcctgggcctgctgagcctgctggccgtgaccagcatccccagcgtgtccaatgccctgaactggagggagttctccttcatccagagcaccctgggctacgtggccctgctgatcagcaccttccacgtgctgatctacggctggaagagggcctttgaggaggagtactaccgcttctacaccccacccaactttgtgctggccctggtgctgcccagcatcgtcatcctgggcaagatcatcctcttcctgccctgcatcagcaggaagctgaagaggatcaagaagggctgggagaagagccagttcctggaggagggcatgggcggcaccatcccccacgtgtccccagagcgggtgacagtgatgtag

SEQ ID NO: 171742 - DNA, 1473 bp, Artificial Sequence; identical to SEQ ID NO: 171741
  Description of Artificial Sequence: Synthetic coding sequence

SEQ ID NO: 171743 - DNA, 1473 bp, Artificial Sequence; identical to SEQ ID NO: 171741
  Description of Artificial Sequence: Synthetic coding sequence

SEQ ID NO: 171744 - DNA, 1365 bp, Artificial Sequence
  Description of Artificial Sequence: Synthetic coding sequence
atggagagcatctccatgatgggcagccccaagagcctgtctgagaccttcctgcccaacggcatcaatggcatcaaggatgccaggaaggtgacagtgggcgtcatcggcagcggggactttgccaagagcctgaccatccgcctcatccgctgtggctaccacgtggtgattggcagcaggaaccccaagtttgccagcgagttcttcccccacgtggtggatgtgacccaccatgaagatgccctgaccaagaccaacatcatctttgtggccatccaccgggagcactacaccagcctgtgggacctgcggcacctgctggtgggcaagatcctgattgatgtgagcaacaacatgaggatcaaccagtacccagagagcaatgctgagtacctggccagcctcttcccagacagcctcatcgtgaagggcttcaacgtggtgtctgcctgggccctgcagctgggccccaaggatgccagccggcaggtgtacatctgcagcaacaacatccaggcccggcagcaggtgattgagctggcccggcagctgaacttcatccccatcgacctgggcagcctgagcagcgcccgggagattgagaacctgcccctgcggctcttcaccctgtggaggggccctgtggtggtggccatcagcctggccaccttcttcttcctgtacagctttgtgagagatgtgatccacccctatgccaggaaccagcagagcgacttctacaagatccccatcgagatcgtgaacaagaccctgcccatcgtggccatcaccctgctgagcctggtgtacctggccggcctgctggccgccgcctaccagctgtactacggcaccaagtaccgccgcttccccccctggctggagacctggctgcagtgcaggaagcagctgggcctgctgtccttcttctttgccatggtgcacgtggcctacagcctgtgcctgcccatgagaagaagtgagcgctacctgttcctgaacatggcctaccagcaggtgcacgccaacatcgagaacagctggaatgaggaggaggtgtggagaattgagatgtacatcagctttggcatcatgagcctgggcctgctgagcctgctggccgtgaccagcatccccagcgtgtccaatgccctgaactggagggagttctccttcatccagagcaccctgggctacgtggccctgctgatcagcaccttccacgtgctgatctacggctggaagagggcctttgaggaggagtactaccgcttctacaccccacccaactttgtgctggccctggtgctgcccagcatcgtcatcctggacctgctgcagctgtgccgctacccagactag

SEQ ID NO: 171745 - DNA, 1365 bp, Artificial Sequence; identical to SEQ ID NO: 171744
  Description of Artificial Sequence: Synthetic coding sequence

SEQ ID NO: 171746 - DNA, 1365 bp, Artificial Sequence; identical to SEQ ID NO: 171744
  Description of Artificial Sequence: Synthetic coding sequence

SEQ ID NO: 171747 - DNA, 267 bp, Artificial Sequence
  Description of Artificial Sequence: Synthetic coding sequence
atggagagcatctccatgatgggcagccccaagagcctgtctgagaccttcctgcccaacggcatcaatggcatcaaggatgccaggaaggtgacagtgggcgtcatcggcagcggggactttgccaagagcctgaccatccgcctcatccgctgtggctaccacgtggtgattggcagcaggaaccccaagtttgccagcgagttcttcccccacgtggtggatgtgacccaccatgaagatgccctgaccaagaccaacatctag

SEQ ID NO: 171748 - DNA, 549 bp, Artificial Sequence
  Description of Artificial Sequence: Synthetic coding sequence
atggagagcatctccatgatgggcagccccaagagcctgtctgagaccttcctgcccaacggcatcaatggcatcaaggatgccaggaaggtgacagtgggcgtcatcggcagcggggactttgccaagagcctgaccatccgcctcatccgctgtggctaccacgtggtgattggcagcaggaaccccaagtttgccagcgagttcttcccccacgtggtggatgtgacccaccatgaagatgccctgaccaagaccaacatcatctttgtggccatccaccgggagcactacaccagcctgtgggacctgcggcacctgctggtgggcaagatcctgattgatgtgagcaacaacatgaggatcaaccagtacccagagagcaatgctgagtacctggccagcctcttcccagacagcctcatcgtgaagggcttcaacgtggtgtctgcctgggccctgcagctgggccccaaggatgccagccggcaggtgtacatctgcagcaacaacatccaggcccggcagcaggtgattgagctggcctag

SEQ ID NO: 171749 - DNA, 1467 bp, Artificial Sequence
  Description of Artificial Sequence: Synthetic coding sequence
atgcctgaggagatggacaagcccctcatcagcctgcacctggtggacagcgacagcagcctggccaaggtgcctgatgaggcccccaaggtgggcatcctgggcagcggggactttgcccggagcctggccacccggctggtgggcagcggcttcaaggtggtggtgggcagcaggaaccccaagaggacagcccggctcttccccagcgctgcccaggtgaccttccaggaggaggccgtgagcagccctgaggtgatctttgtggccgtgttccgggagcactacagcagcctgtgcagcctgagtgaccagctggccggcaagatcctggtggatgtgagcaaccccacagagcaggagcacctgcagcaccgggagagcaatgctgagtacctggccagcctcttccccacctgcaccgtggtgaaggccttcaacgtcatcagcgcctggaccctgcaggccggccccagagatggcaaccggcaggtgcccatctgtggggaccagcctgaggccaagagagctgtgtctgagatggccctggccatgggcttcatgcctgtggacatgggcagcctggccagcgcctgggaggtggaggccatgcccctgcggctgctgcctgcctggaaggtgcccaccctgctggccctgggcctgtttgtgtgcttctacgcctacaactttgtgagagatgtgctgcagccctacgtgcaggagagccagaacaagttcttcaagctgcctgtgtctgtggtgaacaccaccctgccctgtgtggcctacgtgctgctgagcctggtgtacctgcccggggtgctggccgccgccctgcagctgcggcggggcaccaagtaccagcgcttcccagactggctggaccactggctgcagcacaggaagcagatcggcctgctgtccttcttctgtgccgccctgcacgccctgtacagcttctgcctgcccctgcggcgggcccacagatatgacctggtgaacctggccgtgaagcaggtgctggccaacaagagccacctgtgggtggaggaggaggtgtggaggatggagatctacctgagcctgggcgtgctggccctgggcaccctgagcctgctggccgtgaccagcctgcccagcatcgccaacagcctgaactggagggagttctcctttgtgcagagcagcctgggctttgtggccctggtgctgagcaccctgcacaccctgacctacggctggacccgggcctttgaggagagccgctacaagttctacctgccccccaccttcaccctgaccctgctggtgccctgtgtggtgatcctggccaaggccctcttcctgctgccctgcatcagccggcggctggcccgcatccggcggggctgggagcgggagagcaccatcaagttcaccctgcccacagaccacgccctggccgagaagaccagccacgtgtag

SEQ ID NO: 171750 - DNA, 1467 bp, Artificial Sequence; identical to SEQ ID NO: 171749
  Description of Artificial Sequence: Synthetic coding sequence

SEQ ID NO: 171751 - DNA, 1467 bp, Artificial Sequence; identical to SEQ ID NO: 171749
  Description of Artificial Sequence: Synthetic coding sequence

SEQ ID NO: 171752 - DNA, 1467 bp, Artificial Sequence; identical to SEQ ID NO: 171749
  Description of Artificial Sequence: Synthetic coding sequence

SEQ ID NO: 171753 - DNA, 1497 bp, Artificial Sequence
  Description of Artificial Sequence: Synthetic coding sequence
atgagccaccagcctgctgtggccaccaagatgcctgaggagatggacaagcccctcatcagcctgcacctggtggacagcgacagcagcctggccaaggtgcctgatgaggcccccaaggtgggcatcctgggcagcggggactttgcccggagcctggccacccggctggtgggcagcggcttcaaggtggtggtgggcagcaggaaccccaagaggacagcccggctcttccccagcgctgcccaggtgaccttccaggaggaggccgtgagcagccctgaggtgatctttgtggccgtgttccgggagcactacagcagcctgtgcagcctgagtgaccagctggccggcaagatcctggtggatgtgagcaaccccacagagcaggagcacctgcagcaccgggagagcaatgctgagtacctggccagcctcttccccacctgcaccgtggtgaaggccttcaacgtcatcagcgcctggaccctgcaggccggccccagagatggcaaccggcaggtgcccatctgtggggaccagcctgaggccaagagagctgtgtctgagatggccctggccatgggcttcatgcctgtggacatgggcagcctggccagcgcctgggaggtggaggccatgcccctgcggctgctgcctgcctggaaggtgcccaccctgctggccctgggcctgtttgtgtgcttctacgcctacaactttgtgagagatgtgctgcagccctacgtgcaggagagccagaacaagttcttcaagctgcctgtgtctgtggtgaacaccaccctgccctgtgtggcctacgtgctgctgagcctggtgtacctgcccggggtgctggccgccgccctgcagctgcggcggggcaccaagtaccagcgcttcccagactggctggaccactggctgcagcacaggaagcagatcggcctgctgtccttcttctgtgccgccctgcacgccctgtacagcttctgcctgcccctgcggcgggcccacagatatgacctggtgaacctggccgtgaagcaggtgctggccaacaagagccacctgtgggtggaggaggaggtgtggaggatggagatctacctgagcctgggcgtgctggccctgggcaccctgagcctgctggccgtgaccagcctgcccagcatcgccaacagcctgaactggagggagttctcctttgtgcagagcagcctgggctttgtggccctggtgctgagcaccctgcacaccctgacctacggctggacccgggcctttgaggagagccgctacaagttctacctgccccccaccttcaccctgaccctgctggtgccctgtgtggtgatcctggccaaggccctcttcctgctgccctgcatcagccggcggctggcccgcatccggcggggctgggagcgggagagcaccatcaagttcaccctgcccacagaccacgccctggccgagaagaccagccacgtgtag

SEQ ID NO: 171754 - DNA, 1374 bp, Artificial Sequence
  Description of Artificial Sequence: Synthetic coding sequence
atgcctgaggagatggacaagcccctcatcagcctgcacctggtggacagcgacagcagcctggccaaggtgcctgatgaggcccccaaggtgggcatcctgggcagcggggactttgcccggagcctggccacccggctggtgggcagcggcttcaaggtggtggtgggcagcaggaaccccaagaggacagcccggctcttccccagcgctgcccaggtgaccttccaggaggaggccgtgagcagccctgaggtgatctttgtggccgtgttccgggagcactacagcagcctgtgcagcctgagtgaccagctggccggcaagatcctggtggatgtgagcaaccccacagagcaggagcacctgcagcaccgggagagcaatgctgagtacctggccagcctcttccccacctgcaccgtggtgaaggccttcaacgtcatcagcgcctggaccctgcaggccggccccagagatggcaaccggcaggtgcccatctgtggggaccagcctgaggccaagagagctgtgtctgagatggccctggccatgggcttcatgcctgtggacatgggcagcctggccagcgcctgggaggtggaggccatgcccctgcggctgctgcctgcctggaaggtgcccaccctgctggccctgggcctgtttgtgtgcttctacgcctacaactttgtgagagatgtgctgcagccctacgtgcaggagagccagaacaagttcttcaagctgcctgtgtctgtggtgaacaccaccctgccctgtgtggcctacgtgctgctgagcctggtgtacctgcccggggtgctggccgccgccctgcagctgcggcggggcaccaagtaccagcgcttcccagactggctggaccactggctgcagcacaggaagcagatcggcctgctgtccttcttctgtgccgccctgcacgccctgtacagcttctgcctgcccctgcggcgggcccacagatatgacctggtgaacctggccgtgaagcaggtgctggccaacaagagccacctgtgggtggaggaggaggtgtggaggatggagatctacctgagcctgggcgtgctggccctgggcaccctgagcctgctggccgtgaccagcctgcccagcatcgccaacagcctgaactggagggagttctcctttgtgcagtgtgtggccaccagcagcgctggcaacacaggcagcggcacccggcggcctgagagccagagccaggacccccacctgcctgccccccaccaccagaccagcttcctgggccccaggagcttctgctgcagcctggtgcctgtgtccaccccctacggccaccaggaggacctgtcctggaccaggtag

SEQ ID NO: 171755 - DNA, 1467 bp, Artificial Sequence; identical to SEQ ID NO: 171749
  Description of Artificial Sequence: Synthetic coding sequence

SEQ ID NO: 171756 - DNA, 1374 bp, Artificial Sequence; identical to SEQ ID NO: 171754
  Description of Artificial Sequence: Synthetic coding sequence

SEQ ID NO: 171757 - DNA, 432 bp, Artificial Sequence
  Description of Artificial Sequence: Synthetic coding sequence
atggagatctacctgagcctgggcgtgctggccctgggcaccctgagcctgctggccgtgaccagcctgcccagcatcgccaacagcctgaactggagggagttctcctttgtgcagagcagcctgggctttgtggccctggtgctgagcaccctgcacaccctgacctacggctggacccgggcctttgaggagagccgctacaagttctacctgccccccaccttcaccctgaccctgctggtgccctgtgtggtgatcctggccaaggccctcttcctgctgccctgcatcagccggcggctggcccgcatccggcggggctgggagcgggagagcaccatcaagttcaccctgcccacagaccacgccctgagccccctgggcttcctgttcctggtggtgcagagcggcatcaccgtgtgcaagtag

SEQ ID NO: 171758 - DNA, 852 bp, Artificial Sequence
  Description of Artificial Sequence: Synthetic coding sequence
atggagaagacctgcattgatgccctgcccctgaccatgaacagcagcgagaagcaggagaccgtgtgcatctttggaactggagactttggccgcagcctgggcctgaagatgctgcagtgtggctacagcgtggtgtttggcagcaggaacccccagaagaccaccctgctgcccagcggggctgaggtgctgagctacagcgaggccgccaagaagagcggcatcatcatcatcgccatccaccgggagcactatgacttcctgacagagctgacagaggtgctgaatggcaagatcctggtggacatcagcaacaacctgaagatcaaccagtacccagagagcaatgctgagtacctggcccacctggtgcctggggcccacgtggtgaaggccttcaacaccatcagcgcctgggccctgcagagcggggccctggatgccagccggcaggccatcctgaagaaggagaaccccttcagcaccagcagcgcctggctgagtgacagctatgtggccctgggcatcctgggcttcttcctgtttgtgctgctgggcatcaccagcctgcccagcgtgtccaatgctgtgaactggagggagttccgctttgtgcagagcaagctgggctacctgaccctcatcctgtgcacagcccacaccctggtgtatggaggcaagcgcttcctgagccccagcaacctgcgctggtacctgcctgctgcctacgtgctgggcctcatcatcccctgcaccgtgctggtgatcaagtttgtgctgatcatgccctgtgtggacaacaccctgacccgcatccggcagggctgggagaggaacagcaagcactag

SEQ ID NO: 171759 - DNA, 1380 bp, Artificial Sequence
  Description of Artificial Sequence: Synthetic coding sequence
atggagaagacctgcattgatgccctgcccctgaccatgaacagcagcgagaagcaggagaccgtgtgcatctttggaactggagactttggccgcagcctgggcctgaagatgctgcagtgtggctacagcgtggtgtttggcagcaggaacccccagaagaccaccctgctgcccagcggggctgaggtgctgagctacagcgaggccgccaagaagagcggcatcatcatcatcgccatccaccgggagcactatgacttcctgacagagctgacagaggtgctgaatggcaagatcctggtggacatcagcaacaacctgaagatcaaccagtacccagagagcaatgctgagtacctggcccacctggtgcctggggcccacgtggtgaaggccttcaacaccatcagcgcctgggccctgcagagcggggccctggatgccagccggcaggtgtttgtgtgtggaaatgacagcaaggccaagcagagggtgatggacatcgtgaggaacctgggcctgacccccatggaccagggcagcctgatggccgccaaggagattgagaagtaccccctgcagctgttccccatgtggaggttccccttctacctgtctgctgtgctgtgtgtgttcctgttcttctactgcgtcatcagagatgtgatctacccctacgtgtatgagaagaaggacaacaccttcaggatggccatcagcatccccaaccgcatcttccccatcacagccctgaccctgctggccctggtgtacctgcccggggtgattgctgccatcctgcagctgtaccggggcaccaagtaccgccgcttcccagactggctggaccactggatgctgtgcaggaagcagctgggcctggtggccctgggctttgccttcctgcacgtgctgtacaccctggtgatccccatccgctactacgtgcgctggaggctgggcaacctgactgtgacccaggccatcctgaagaaggagaaccccttcagcaccagcagcgcctggctgagtgacagctatgtggccctgggcatcctgggcttcttcctgtttgtgctgctgggcatcaccagcctgcccagcgtgtccaatgctgtgaactggagggagttccgctttgtgcagagcaagctgggctacctgaccctcatcctgtgcacagcccacaccctggtgtatggaggcaagcgcttcctgagccccagcaacctgcgctggtacctgcctgctgcctacgtgctgggcctcatcatcccctgcaccgtgctggtgatcaagtttgtgctgatcatgccctgtgtggacaacaccctgacccgcatccggcagggctgggagaggaacagcaagcactag

SEQ ID NO: 171760 - DNA, 1080 bp, Artificial Sequence
  Description of Artificial Sequence: Synthetic coding sequence
atgcctgcccacctgctgcaggatgacatcagcagcagctacaccaccaccaccaccatcacagccccacccagccgggtgctgcagaatggaggagacaagctggagaccatgcccctgtacctggaggatgacatccggccagacatcaaggatgacatctatgaccccacctacaaggacaaggagggccccagccccaaggtggagtatgtgtggaggaacatcatcctgatgagcctgctgcacctgggcgccctgtatggcatcaccctcatccccacctgcaagttctacacctggctgtggggcgtcttctactactttgtgtctgccctgggcatcacagctggggcccaccggctgtggagccacaggagctacaaggcccggctgcccctgcggctcttcctgatcatcgccaacaccatggccttccagaatgatgtgtatgagtgggcccgggaccaccgggcccaccacaagttcagcgagacccacgccgacccccacaacagccggcggggcttcttcttcagccacgtgggctggctgctggtgaggaagcaccctgctgtgaaggagaagggcagcaccctggacctgagtgacctggaggccgagaagctggtgatgttccagaggcgctactacaagccaggcctgctgatgatgtgcttcatcctgcccaccctggtgccctggtacttctggggcgagaccttccagaacagcgtgtttgtggccaccttcctgcgctatgctgtggtgctgaatgccacctggctggtgaacagcgctgcccacctgtttggctaccggccctatgacaagaacatcagcccccgggagaacatcctggtgtccctgggcgctgtgggggagggcttccacaactaccaccacagcttcccctatgactacagcgccagcgagtaccgctggcacatcaacttcaccaccttcttcatcgactgcatggccgccctgggcctggcctatgacaggaagaaggtgtccaaggccgccatcctggcccgcatcaagaggactggagatggcaactacaagagcggctag

SEQ ID NO: 171761 - DNA, 729 bp, Artificial Sequence
  Description of Artificial Sequence: Synthetic coding sequence
atgcctgcccacctgctgcaggatgacatcagcagcagctacaccaccaccaccaccatcacagccccacccagccgggtgctgcagaatggaggagacaagctggagaccatgcccctgtacctggaggatgacatccggccagacatcaaggatgacatctatgaccccacctacaaggacaaggagggccccagccccaaggtggagtatgtgtggaggaacatcatcctgatgagcctgctgcacctgggcgccctgtatggcatcaccctcatccccacctgcaagttctacacctggctgtggggcgtcttctactactttgtgtctgccctgggcatcacagctggggcccaccggctgtggagccacaggagctacaaggcccggctgcccctgcggctcttcctgatcatcgccaacaccatggccttccagaatgatgtgtatgagtgggcccgggaccaccgggcccaccacaagttcagcgagacccacgccgacccccacaacagccggcggggcttcttcttcagccacgtgggctggctgctggtgaggaagcaccctgctgtgaaggagaagggcagcaccctggacctgagtgacctggaggccgagaagctggtgatgttccagaggcgctactacaagccaggcctgctgatgatgtgcttcatcctgcccaccctggtgccctggtacttctggggcgagaccttctag

SEQ ID NO: 171762 - DNA, 813 bp, Artificial Sequence
  Description of Artificial Sequence: Synthetic coding sequence
atggcctgccggcccaggagcccccccaggcaccagagccgctgtgatggagatgccagcccccccagccctgcccgctggagcctgggcaggaagagaagagcagatggccgccgctggaggccagaagatgctgaggaggccgagcacagaggagctgagaggaggcctgagagcttcaccaccccagagggccccaagcccaggagccgctgcagcgactgggccagcgctgtggaggaggatgagatgaggaccagggtgaacaaggagatggcccgctacaagaggaagctgctgatcaatgactttggccgggagaggaagagcagcagcggcagcagtgacagcaaggagagcatgagcacagtgcctgctgactttgaaacagatgaatctgtgctgatgaggcggcagaagcagatcaactacggcaagaacaccatcgcctatgaccgctacatcaaggaggtgcccaggcacctgcggcagcccggcatccaccccaagacccccaacaagttcaagaagtacagccgccgctcctgggaccagcagatcaagctgtggaaggtggccctgcacttctgggaccccccagctgaggagggctgtgacctgcaggagatccaccctgtggacctggagagcgctgagagcagcagcgagccccagaccagcagccaggatgactttgatgtgtacagcggcacccccaccaaggtgcgccacatggacagccaggtggaggatgaatttgacctggaggcctgcctgacagagcccctgcgggacttcagcgccatgtcctag

SEQ ID NO: 171763 - DNA, 5328 bp, Artificial Sequence
  Description of Artificial Sequence: Synthetic coding sequence
atggccctgagcctgtggcccctgctgctgctgctgctgctgctgctgctgctgagctttgctgtgaccctggcccccaccggcccccacagcctggaccccggcctgtccttcctgaagagcctgctgagcaccctggaccaggccccccagggcagcctgagccgcagccgcttcttcaccttcctggccaacatcagcagcagctttgagcccggccgcatgggagagggccctgtgggggagcccccacccctgcagcccccagccctgcggctgcatgacttcctggtgaccctgcggggcagcccagactgggagcccatgctgggcctgctgggggacatgctggccctgctgggccaggagcagaccccccgggacttcctggtgcaccaggccggcgtgctgggcggcctggtggaggtgctgctgggcgccctggtgcctgggggcccccccacccccaccaggcctccctgcaccagagatggccccagcgactgtgtgctggccgctgactggctgcccagcctgctgctgctgctggagggcacccgctggcaggccctggtgcaggtgcagcccagcgtggaccccaccaatgccaccggcctggatggccgggaggccgccccccacttcctgcagggcctgctgggcctgctgacccccaccggggagctgggcagcaaggaggccctgtggggcggcctgctgaggacagtgggcgcccccctgtatgctgccttccaggagggcctgctgcgggtgacccacagcctgcaggatgaggtgttcagcatcctgggccagcctgagccagacaccaacggccagtgccagggcggcaacctgcagcagctgctgctgtggggcgtgcgccacaacctgtcctgggatgtgcaggccctgggcttcctgagcggcagccccccacctcctccagccctgctgcactgcctgagcactggagtgcccctgccccgggccagccagcccagcgcccacatcagcccccggcagaggcgggccatcaccgtggaggccctgtgtgagaaccacctgggccctgccccaccctacagcatcagcaacttcagcatccacctgctgtgccagcacaccaagccagccaccccccagccccaccccagcaccacagccatctgccagacagctgtgtggtatgctgtgtcctgggcccctggggcccagggctggctgcaggcctgccacgaccagttcccagatgagttcctggatgccatctgcagcaacctgtccttcagcgccctgagcggcagcaacagaaggctggtgaagaggctgtgtgccggcctgctgcccccacccaccagctgcccagagggcctgccccctgtgcccctgaccccagacatcttctggggctgcttcctggagaatgagaccctgtgggccgagcggctgtgtggggaggccagcctgcaggccgtgccccccagcaaccaggcctgggtgcagcacgtgtgccagggccccaccccagatgtgacagccagccccccctgccacatcggcccctgtggggagcgctgcccagatggcggcagcttcctggtgatggtgtgtgccaatgacaccatgtatgaggtgctggtgcccttctggccctggctggccggccagtgccgcatcagcagaggaggaaatgacacctgcttcctggagggcctgctgggccccctgctgcccagcctgccccccctgggccccagccccctgtgcctgaccccaggccccttcctgctgggcatgctgagccagctgccccgctgccagagctctgtgcctgccctggcccaccccacccggctgcactacctgctgcggctgctgaccttcctgctgggccctggagctggaggagctgaggcccagggcatgctgggccgggccctgctgctgagcagcctgcctgacaactgcagcttctgggatgccttccggcctgagggccgccgctctgtgctgcggaccatcggggagtacctggagcaggatgaggagcagcccaccccatctggctttgagcccaccgtgaaccccagcagcggcatcagcaagatggagctgctggcctgcttcagccctgtgctgtgggacctgctgcagcgggagaagtctgtgtgggccctgcagatcctggtgcaggcctacctgcacatgcctcctgagaacctgcagcagctggtgctgtctgctgagcgggaggccgcccagggcttcctgaccctgatgctgcagggcaagctgcagggcaagctgcaggtgcccccatctgaggagcaggccctgggccgcctgacagccctgctgctgcagcgctacccccggctgaccagccagctgttcatcgacctgagccccctcatccccttcctggccgtgtctgacctgatgaggttcccccccagcctgctggccaatgacagcgtgctggccgccatccgggactacagccctggcatgaggcctgagcagaaggaggccctggccaagaggctgctggcccctgagctgtttggagaggtgcctgcctggccccaggagctgctgtgggccgtgctgcccctgctgccccacctgcccctggagaacttcctgcagctgagcccccaccagatccaggccctggaggacagctggccagctgctggcctgggccctggccacgcccggcacgtgctgcggagcctggtgaaccagagcgtgcaggatggagaggagcaggtgcggcggctgggccccctggcctgcttcctgagccctgaggagctgcagagcctggtgcccctgagtgaccccactggacctgtggagcggggcctgctggagtgtgccgccaacggcaccctgagccctgagggccgggtggcctatgagctgctgggcgtgctgcggagcagcggcggcgctgtgctgagcccccgggagctgcgggtgtgggcccccctcttcagccagctgggcctgcgcttcctgcaggagctgtctgagccccagctgcgggccatgctgcctgtgctgcagggcacctctgtgaccccagcccaggccgtgctgctgctgggccgcctgctgcccaggcatgacctgagcctggaggagctgtgcagcctgcacctgctgctgcccggcctgagcccccagaccctgcaggccatcccccggcgggtgctggtgggcgcctgcagctgcctggcccctgagctgagccggctgagcgcctgccagacagctgccctgctgcagaccttccgggtgaaggatggagtgaagaacatgggcaccactggagctggccctgctgtgtgcatccctggccagcccatccccaccacctggccagactgcctgctgcccctgctgcccctgaagctgctgcagctggacagcctggccctgctggccaacagaagacgctactgggagctgccctggagcgagcagcaggcccagttcctgtggaagaagatgcaggtgcccaccaacctgaccctgaggaacctgcaggccctgggcaccctggccggcggcatgagctgtgagttcctgcagcagatcaacagcatggtggacttcctggaggtggtgcacatgatctaccagctgcccaccagggtgcggggcagcctgcgggcctgcatctgggccgagctgcagaggaggatggccatgcctgagcctgagtggaccaccgtgggccctgagctgaatggcctggacagcaagctgctgctggacctgcccatccagctgatggaccggctgagcaatgaaagcatcatgctggtggtggagctggtgcagagggcccctgagcagctgctggccctgacccccctgcaccaggccgccctggccgagcgggccctgcagaacctggcccccaaggagacccctgtgtctggagaggtgctggagaccctgggccccctggtgggcttcctgggcacagagagcacccggcagatccccctgcagatcctgctgagccacctgagccagctgcagggcttctgcctgggggagacctttgccacagagctgggctggctgctgctgcaggagagcgtgctgggcaagccagagctgtggagccaggatgaggtggagcaggccggccgcctggtgttcaccctgagcacagaggccatcagcctcatcccccgggaggccctgggccctgagaccctggagcggctgctggagaagcagcagagctgggagcagagccgggtgggccagctgtgccgggagccccagctggccgccaagaaggccgccctggtggccggcgtggtgcggcctgctgctgaggacctgcctgagcctgtgcccaactgtgctgatgtgcggggcaccttccctgctgcctggagcgccacccagattgctgagatggagctgagtgactttgaggactgcctgaccctgtttgctggggaccccggcctgggccctgaggagctgcgggccgccatgggcaaggccaagcagctgtggggccccccccggggcttccggcctgagcagatcctgcagctgggccgcctgctgattggcctgggggaccgggagctgcaggagctgatcctggtggactggggcgtgctgagcaccctgggccagattgatggctggagcaccacccagctgcgcatcgtggtgagcagcttcctgcggcagagcggccgccacgtgagccacctggactttgtgcacctgacagccctgggctacaccctgtgtggcctgcggcctgaggagctgcagcacatcagctcctgggagttcagccaggccgccctcttcctgggcaccctgcacctgcagtgcagcgaggagcagctggaggtgctggcccacctgctggtgctgcccggcggcttcggccccatcagcaactggggccctgagatcttcacagagatcggcaccatcgctgctggcatcccagacctggccctgagcgccctgctgcggggccagatccagggcgtgacccccctggccatcagcgtcatccccccacccaagtttgctgtggtgttcagccccatccagctgagcagcctgaccagcgcccaggccgtggccgtgaccccagagcagatggccttcctgagccctgagcagaggagagctgtggcctgggcccagcacgagggcaaggagagccctgagcagcagggccgcagcacagcctggggcctgcaggactggagccggcccagctggagcctggtgctgaccatctccttcctgggccacctgctgtag

SEQ ID NO: 171764 - DNA, 1056 bp, Artificial Sequence
  Description of Artificial Sequence: Synthetic coding sequence
atggccctgagcctgtggcccctgctgctgctgctgctgctgctgctgctgctgagctttgctgtgaccctggcccccaccggcccccacagcctggaccccggcctgtccttcctgaagagcctgctgagcaccctggaccaggccccccagggcagcctgagccgcagccgcttcttcaccttcctggccaacatcagcagcagctttgagcccggccgcatgggagagggccctgtgggggagcccccacccctgcagcccccagccctgcggctgcatgacttcctggtgaccctgcggggcagcccagactgggagcccatgctgggcctgctgggggacatgctggccctgctgggccaggagcagaccccccgggacttcctggtgcaccaggccggcgtgctgggcggcctggtggaggtgctgctgggcgccctggtgcctgggggcccccccacccccacccagcccccctgcaccagagatggccccagcgactgtgtgctggccgctgactggctgcccagcctgctgctgctgctggagggcacccgctggcaggccctggtgcaggtgcagcccagcgtggaccccaccaatgccaccggcctggatggccgggaggccgccccccacttcctgcagggcctgctgggcctgctgacccccaccggggagctgggcagcaaggaggccctgtggggcggcctgctgaggacagtgggcgcccccctgtatgctgccttccaggagggcctgctgcgggtgacccacagcctgcaggatgaggtgttcagcatcctgggccagcctgagccagacaccaacggccagtgccagggcggcaacctgcagcagctgctgctgtggggcgtgcgccacaacctgtcctgggatgtgcaggccctgggcttcctgagcggcagccccccacctcctccagccctgctgcactgcctgagcactggagtgcccctgccccgggccagccagcccagcgcccacatcagcccccggcagaggcgggccatcaccgtggaggccctgtag

SEQ ID NO: 171765 - DNA, 5328 bp, Artificial Sequence; identical to SEQ ID NO: 171763
  Description of Artificial Sequence: Synthetic coding sequence

SEQ ID NO: 171766 - DNA, 1056 bp, Artificial Sequence
  Description of Artificial Sequence: Synthetic coding sequence
atggccctgagcctgtggcccctgctgctgctgctgctgctgctgctgctgctgagctttgctgtgaccctggcccccaccggcccccacagcctggaccccggcctgtccttcctgaagagcctgctgagcaccctggaccaggccccccagggcagcctgagccgcagccgcttcttcaccttcctggccaacatcagcagcagctttgagcccggccgcatgggagagggccctgtgggggagcccccacccctgcagcccccagccctgcggctgcatgacttcctggtgaccctgcggggcagcccagactgggagcccatgctgggcctgctgggggacatgctggccctgctgggccaggagcagaccccccgggacttcctggtgcaccaggccggcgtgctgggcggcctggtggaggtgctgctgggcgccctggtgcctgggggcccccccacccccaccaggcctccctgcaccagagatggccccagcgactgtgtgctggccgctgactggctgcccagcctgctgctgctgctggagggcacccgctggcaggccctggtgcaggtgcagcccagcgtggaccccaccaatgccaccggcctggatggccgggaggccgccccccacttcctgcagggcctgctgggcctgctgacccccaccggggagctgggcagcaaggaggccctgtggggcggcctgctgaggacagtgggcgcccccctgtatgctgccttccaggagggcctgctgcgggtgacccacagcctgcaggatgaggtgttcagcatcctgggccagcctgagccagacaccaacggccagtgccagggcggcaacctgcagcagctgctgctgtggggcgtgcgccacaacctgtcctgggatgtgcaggccctgggcttcctgagcggcagccccccacctcctccagccctgctgcactgcctgagcactggagtgcccctgccccgggccagccagcccagcgcccacatcagcccccggcagaggcgggccatcaccgtggaggccctgtag

SEQ ID NO: 171767 - DNA, 2100 bp, Artificial Sequence
  Description of Artificial Sequence: Synthetic coding sequence
atggccctgagcctgtggcccctgctgctgctgctgctgctgctgctgctgctgagctttgctgtgaccctggcccccaccggcccccacagcctggaccccggcctgtccttcctgaagagcctgctgagcaccctggaccaggccccccagggcagcctgagccgcagccgcttcttcaccttcctggccaacatcagcagcagctttgagcccggccgcatgggagagggccctgtgggggagcccccacccctgcagcccccagccctgcggctgcatgacttcctggtgaccctgcggggcagcccagactgggagcccatgctgggcctgctgggggacatgctggccctgctgggccaggagcagaccccccgggacttcctggtgcaccaggccggcgtgctgggcggcctggtggaggtgctgctgggcgccctggtgcctgggggcccccccacccccacccagcccccctgcaccagagatggccccagcgactgtgtgctggccgctgactggctgcccagcctgctgctgctgctggagggcacccgctggcaggccctggtgcaggtgcagcccagcgtggaccccaccaatgccaccggcctggatggccgggaggccgccccccacttcctgcagggcctgctgggcctgctgacccccaccggggagctgggcagcaaggaggccctgtggggcggcctgctgaggacagtgggcgcccccctgtatgctgccttccaggagggcctgctgcgggtgacccacagcctgcaggatgaggtgttcagcatcctgggccagcctgagccagacaccaacggccagtgccagggcggcaacctgcagcagctgctgctgtggggcgtgcgccacaacctgtcctgggatgtgcaggccctgggcttcctgagcggcagccccccacctcctccagccctgctgcactgcctgagcactggagtgcccctgccccgggccagccagcccagcgcccacatcagcccccggcagaggcgggccatcaccgtggaggccctgtgtgagaaccacctgggccctgccccaccctacagcatcagcaacttcagcatccacctgctgtgccagcacaccaagccagccaccccccagccccaccccagcaccacagccatctgccagacagctgtgtggtatgctgtgtcctgggcccctggggcccagggctggctgcaggcctgccacgaccagttcccagatgagttcctggatgccatctgcagcaacctgtccttcagcgccctgagcggcagcaacagaaggctggtgaagaggctgtgtgccggcctgctgcccccacccaccagctgcccagagggcctgccccctgtgcccctgaccccagacatcttctggggctgcttcctggagaatgagaccctgtgggccgagcggctgtgtggggaggccagcctgcaggccgtgccccccagcaaccaggcctgggtgcagcacgtgtgccagggccccaccccagatgtgacagccagccccccctgccacatcggcccctgtggggagcgctgcccagatggcggcagcttcctggtgatggtgtgtgccaatgacaccatgtatgaggtgctggtgcccttctggccctggctggccggccagtgccgcatcagcagaggaggaaatgacacctgcttcctggagggcctgctgggccccctgctgcccagcctgccccccctgggccccagccccctgtgcctgaccccaggccccttcctgctgggcatgctgagccagctgccccgctgccagagctctgtgcctgccctggcccaccccacccggctgcactacctgctgcggctgctgaccttcctgctgggccctggagctggaggagctgaggcccagggcatgctgggccgggccctgctgctgagcagcctgcctgacaactgcagcttctgggatgccttccggcctgagggccgccgctctgtgctgcggaccatcggggagtacaacaagatgaggagcagccagccccaccaggccctgaaccccctgagcaccccagccctggtgtag

SEQ ID NO: 171768 - DNA, 3009 bp, Artificial Sequence
  Description of Artificial Sequence: Synthetic coding sequence
atggagctgctggcctgcttcagccctgtgctgtgggacctgctgcagcgggagaagtctgtgtgggccctgcagatcctggtgcaggcctacctgcacatgcccccagagaacctgcagcagctggtgctgtctgctgagcgggaggccgcccagggcttcctgaccctgatgctgcagggcaagctgcagggcaagctgcaggtgccccccagcgaggagcaggccctgggccgcctgacagccctgctgctgcagcgctacccccggctgaccagccagctgttcatcgacctgagccccctcatccccttcctggccgtgtctgacctgatgagatttcctcccagcctgctggccaatgattctgtgcagcagggctaccggggcagcgaggagaacagcctggaggaggacaagggcctgcggcccatgacccccaggagcctggccgccatccgggactacagccctggcatgaggcctgagcagaaggaggccctggccaagaggctgctggcccctgagctgtttggagaggtgcctgcctggccccaggagctgctgtgggccgtgctgcccctgctgccccacctgcccctggagaacttcctgcagctgagcccccaccagatccaggccctggaggacagctggccagctgctggcctgggccctggccacgcccggcacgtgctgcggagcctggtgaaccagagcgtgcaggatggagaggagcaggtgcggcggctgggccccctggcctgcttcctgagccctgaggagctgcagagcctggtgcccctgagtgaccccactggacctgtggagcggggcctgctggagtgtgccgccaacggcaccctgagccctgagggccgggtggcctatgagctgctgggcgtgctgcggagcagcggcggcgctgtgctgagcccccgggagctgcgggtgtgggcccccctcttcagccagctgggcctgcgcttcctgcaggagctgtctgagccccagctgcgggccatgctgcctgtgctgcagggcacctctgtgaccccagcccaggccgtgctgctgctgggccgcctgctgcccaggcatgacctgctgcagctggacagcctggccctgctggccaacagaagacgctactgggagctgccctggagcgagcagcaggcccagttcctgtggaagaagatgcaggtgcccaccaacctgaccctgaggaacctgcaggccctgggcaccctggccggcggcatgagctgtgagttcctgcagcagatcaacagcatggtggacttcctggaggtggtgcacatgatctaccagctgcccaccagggtgcggggcagcctgcgggcctgcatctgggccgagctgcagaggaggatggccatgcctgagcctgagtggaccaccgtgggccctgagctgaatggcctggacagcaagctgctgctggacctgcccatccagctgatggaccggctgagcaatgaaagcatcatgctggtggtggagctggtgcagagggcccctgagcagctgctggccctgacccccctgcaccaggccgccctggccgagcgggccctgcagaacctggcccccaaggagacccctgtgtctggagaggtgctggagaccctgggccccctggtgggcttcctgggcacagagagcacccggcagatccccctgcagatcctgctgagccacctgagccagctgcagggcttctgcctgggggagacctttgccacagagctgggctggctgctgctgcaggagagcgtgctgggcaagccagagctgtggagccaggatgaggtggagcaggccggccgcctggtgttcaccctgagcacagaggccatcagcctcatcccccgggaggccctgggccctgagaccctggagcggctgctggagaagcagcagagctgggagcagagccgggtgggccagctgtgccgggagccccagctggccgccaagaaggccgccctggtggccggcgtggtgcggcctgctgctgaggacctgcctgagcctgtgcccaactgtgctgatgtgcggggcaccttccctgctgcctggagcgccacccagattgctgagatggagctgagtgactttgaggactgcctgaccctgtttgctggggaccccggcctgggccctgaggagctgcgggccgccatgggcaaggccaagcagctgtggggccccccccggggcttccggcctgagcagatcctgcagctgggccgcctgctgattggcctgggggaccgggagctgcaggagctgatcctggtggactggggcgtgctgagcaccctgggccagattgatggctggagcaccacccagctgagaattgtggtgtcctccttcctgcggcagagcggcagacatgtgagccacctggactttgtgcacctgacagccctgggctacaccctgtgtggcctgcggcctgaggagctgcagcacatcagctcctgggagttcagccaggccgccctcttcctgggcaccctgcacctgcagtgcagcgaggagcagctggaggtgctggcccacctgctggtgctgcccggcggcttcggccccatcagcaactggggccctgagatcttcacagaaattggcaccatcgccgccggcatcccagacctggccctgagcgccctgctgcggggccagatccagggcgtgacccccctggccatcagcgtcatccccccacccaagtttgctgtggtgttcagccccatccagctgagcagcctgaccagcgcccaggccgtggccgtgaccccagagcagatggccttcctgagccctgagcagaggagagctgtggcctgggcccagcacgagggcaaggagagccctgagcagcagggccgcagcacagcctggggcctgcaggactggagccggcccagctggagcctggtgctgaccatctccttcctgggccacctgctgtag

SEQ ID NO: 171769 - DNA, 1890 bp, Artificial Sequence
  Description of Artificial Sequence: Synthetic coding sequence
atgttccgggaccaggtgggcgtgctggccggctggttcaagggctggaatgaatgtgagcagacagtggccctgctgagcctgctgaagagggtgtcccagacccaggcccgcttcctgcagctgtgcctggagcacagcctggccgactgtgccgagctgcacgtgctggagcgggaggccaacagccctggcatcatcaaccagtggcagcaggagagcaaggacaaggtgatcagcctgctgctgacccacctgcccctgctgaagccaggcaacctggatgccaaggtggagtacatgaagctgctgcccaagatcctggcccacagcattgagcacaaccagcacatcgaggagagccggcagctgctgtcctatgccctgatccacccagccaccagcctggaggacagaagtgccctggccatgtggctgaaccacctggaggacaggaccagcaccagctttggaggccagaacagaggccgcagtgacagcgtggactatggccagacccactactaccaccagaggcagaacagtgatgacaagctgaatggctggcagaacagccgggacagcggcatctgcatcaatgccagcaactggcaggacaagtccatgggctgtgaaaatggacatgtgcccctgtacagcagcagctctgtgcccaccaccatcaacaccatcggcaccagcaccagcaccaacgtgcctgcctggctgaagagcctgcggctgcacaagtatgctgccctcttcagccagatgacctatgaggagatgatggccctgacagagtgccagctggaggcccagaatgtgaccaagggggcccggcacaagatcgtcatcagcatccagaagctgaaggagcggcagaacctgctgaagagcctggagcgggacatcatcgagggcggcagcctgcgcatccccctgcaggagctgcaccagatgatcctgacccccatcaaggcctacagcagccccagcaccaccccagaggcccggcggcgggagccccaggccccccggcagcccagcctgatgggccctgagagccagagcccagactgcaaggatggagctgctgccaccggggccacagccaccccatctgctggggccagcggcggcctgcagccccaccagctgagcagctgtgatggagagctggccgtggcccccctgcctgagggggacctgcccggccagttcaccagggtgatgggcaaggtgtgcacccagctgctggtgtccaggccagatgaggagaacatcagcagctacctgcagctgattgacaagtgcctgatccacgaggccttcacagagacccagaagaagaggctgctgtcctggaagcagcaggtgcagaagctgttccgctccttccccaggaagaccctgctggacatcagcggctaccggcagcagaggaacagaggcttcggccagagcaacagcctgcccacagctggctctgtgggcggcggcatgggcagaagaaacccccggcagtaccagatccccagcagaaatgtgcccagcgcccggctgggcctgctgggcaccagcggctttgtgagcagcaaccagaggaacaccacagccacccccaccatcatgaagcagggccggcagaacctgtggtttgccaaccctgggggcagcaacagcatgcccagcaggacccacagctctgtgcagaggaccaggagcctgcctgtgcacaccagcccccagaacatgctgatgttccagcagcctgagttccagctgcctgtgacagagccagacatcaacaaccggctggagagcctgtgcctgtccatgacagaacatgccctgggagatggagtggacaggaccagcaccatctag

SEQ ID NO: 171770 - DNA, 1893 bp, Artificial Sequence
  Description of Artificial Sequence: Synthetic coding sequence
atgatgttccgggaccaggtgggcgtgctggccggctggttcaagggctggaatgaatgtgagcagacagtggccctgctgagcctgctgaagagggtgtcccagacccaggcccgcttcctgcagctgtgcctggagcacagcctggccgactgtgccgagctgcacgtgctggagcgggaggccaacagccctggcatcatcaaccagtggcagcaggagagcaaggacaaggtgatcagcctgctgctgacccacctgcccctgctgaagccaggcaacctggatgccaaggtggagtacatgaagctgctgcccaagatcctggcccacagcattgagcacaaccagcacatcgaggagagccggcagctgctgtcctatgccctgatccacccagccaccagcctggaggacagaagtgccctggccatgtggctgaaccacctggaggacaggaccagcaccagctttggaggccagaacagaggccgcagtgacagcgtggactatggccagacccactactaccaccagaggcagaacagtgatgacaagctgaatggctggcagaacagccgggacagcggcatctgcatcaatgccagcaactggcaggacaagtccatgggctgtgaaaatggccacgtgcccctgtacagcagcagctctgtgcccaccaccatcaacaccatcggcaccagcaccagcaccaacgtgcctgcctggctgaagagcctgcggctgcacaagtatgctgccctcttcagccagatgacctatgaggagatgatggccctgacagagtgccagctggaggcccagaatgtgaccaagggggcccggcacaagatcgtcatcagcatccagaagctgaaggagcggcagaacctgctgaagagcctggagcgggacatcattgaaggaggcagcctgcgcatccccctgcaggagctgcaccagatgatcctgacccccatcaaggcctacagcagccccagcaccaccccagaggccaggagaagagagccccaggccccccggcagcccagcctgatgggccctgagagccagagcccagactgcaaggatggagctgctgccactggagccacagccacccccagcgctggggccagcggcggcctgcagccccaccagctgagcagctgtgatggagagctggccgtggcccccctgcctgagggggacctgcccggccagttcaccagggtgatgggcaaggtgtgcacccagctgctggtgtccaggccagatgaggagaacatcagcagctacctgcagctgattgacaagtgcctgattcatgaggccttcacagagacccagaagaagaggctgctgtcctggaagcagcaggtgcagaagctgttccgctccttccccaggaagaccctgctggacatcagcggctaccggcagcagaggaacagaggatttggccagagcaacagcctgcccacagctggctctgtgggcggcggcatgggcagaagaaacccccggcagtaccagatccccagcagaaatgtgcccagcgcccggctgggcctgctgggcaccagcggctttgtgagcagcaaccagaggaacaccacagccacccccaccatcatgaagcagggccggcagaacctgtggtttgccaaccctgggggcagcaacagcatgcccagcaggacccacagctctgtgcagaggaccaggagcctgcctgtgcacaccagcccccagaacatgctgatgttccagcagcctgagttccagctgcctgtgacagagccagacatcaacaaccggctggagagcctgtgcctgtccatgacagagcacgccctgggagatggagtggacaggaccagcaccatctag

SEQ ID NO: 171771 - DNA, 2154 bp, Artificial Sequence
  Description of Artificial Sequence: Synthetic coding sequence
atgttccgggaccaggtgggcgtgctggccggctggttcaagggctggaatgaatgtgagcagacagtggccctgctgagcctgctgaagagggtgtcccagacccaggcccgcttcctgcagctgtgcctggagcacagcctggccgactgtgccgagctgcacgtgctggagcgggaggccaacagccctggcatcatcaaccagtggcagcaggagagcaaggacaaggtgatcagcctgctgctgacccacctgcccctgctgaagccaggcaacctggatgccaaggtggagtacatgaagctgctgcccaagatcctggcccacagcattgagcacaaccagcacatcgaggagagccggcagctgctgtcctatgccctgatccacccagccaccagcctggaggacagaagtgccctggccatgtggctgaaccacctggaggacaggaccagcaccagctttggaggccagaacagaggccgcagtgacagcgtggactatggccagacccactactaccaccagaggcagaacagtgatgacaagctgaatggctggcagaacagccgggacagcggcatctgcatcaatgccagcaactggcaggacaagtccatgggctgtgaaaatggacatgtgcccctgtacagcagcagctctgtgcccaccaccatcaacaccatcggcaccagcaccagcaccatcctgagcggccaggcccaccacagccccctgaagaggtctgtgtccctgaccccacccatgaatgtgcccaaccagcccctgggccacggctggatgagccatgaggacctgcgggcccggggcccccagtgcctgcccagcgaccacgcccccctgagcccccagagctctgtggccagcagcggcagcggcggcagcgagcacctggaggaccagaccacagccaggaacaccttccaggaggagggcagcggcatgaaggatgtgcctgcctggctgaagagcctgcggctgcacaagtatgctgccctcttcagccagatgacctatgaggagatgatggccctgacagagtgccagctggaggcccagaatgtgaccaagggggcccggcacaagatcgtcatcagcatccagaagctgaaggagcggcagaacctgctgaagagcctggagcgggacatcatcgagggcggcagcctgcgcatccccctgcaggagctgcaccagatgatcctgacccccatcaaggcctacagcagccccagcaccaccccagaggcccggcggcgggagccccaggccccccggcagcccagcctgatgggccctgagagccagagcccagactgcaaggatggagctgctgccaccggggccacagccaccccatctgctggggccagcggcggcctgcagccccaccagctgagcagctgtgatggagagctggccgtggcccccctgcctgagggggacctgcccggccagttcaccagggtgatgggcaaggtgtgcacccagctgctggtgtccaggccagatgaggagaacatcagcagctacctgcagctgattgacaagtgcctgatccacgaggccttcacagagacccagaagaagaggctgctgtcctggaagcagcaggtgcagaagctgttccgctccttccccaggaagaccctgctggacatcagcggctaccggcagcagaggaacagaggcttcggccagagcaacagcctgcccacagctggctctgtgggcggcggcatgggcagaagaaacccccggcagtaccagatccccagcagaaatgtgcccagcgcccggctgggcctgctgggcaccagcggctttgtgagcagcaaccagaggaacaccacagccacccccaccatcatgaagcagggccggcagaacctgtggtttgccaaccctgggggcagcaacagcatgcccagcaggacccacagctctgtgcagaggaccaggagcctgcctgtgcacaccagcccccagaacatgctgatgttccagcagcctgagttccagctgcctgtgacagagccagacatcaacaaccggctggagagcctgtgcctgtccatgacagaacatgccctgggagatggagtggacaggaccagcaccatctag

SEQ ID NO: 171772 - DNA, 2157 bp, Artificial Sequence
  Description of Artificial Sequence: Synthetic coding sequence
atgatgttccgggaccaggtgggcgtgctggccggctggttcaagggctggaatgaatgtgagcagacagtggccctgctgagcctgctgaagagggtgtcccagacccaggcccgcttcctgcagctgtgcctggagcacagcctggccgactgtgccgagctgcacgtgctggagcgggaggccaacagccctggcatcatcaaccagtggcagcaggagagcaaggacaaggtgatcagcctgctgctgacccacctgcccctgctgaagccaggcaacctggatgccaaggtggagtacatgaagctgctgcccaagatcctggcccacagcattgagcacaaccagcacatcgaggagagccggcagctgctgtcctatgccctgatccacccagccaccagcctggaggacagaagtgccctggccatgtggctgaaccacctggaggacaggaccagcaccagctttggaggccagaacagaggccgcagtgacagcgtggactatggccagacccactactaccaccagaggcagaacagtgatgacaagctgaatggctggcagaacagccgggacagcggcatctgcatcaatgccagcaactggcaggacaagtccatgggctgtgaaaatggccacgtgcccctgtacagcagcagctctgtgcccaccaccatcaacaccatcggcaccagcaccagcaccatcctgagcggccaggcccaccacagccccctgaagaggtctgtgtccctgaccccacccatgaatgtgcccaaccagcccctgggccacggctggatgagccatgaggacctgcgggcccggggcccccagtgcctgcccagcgaccacgcccccctgagcccccagagctctgtggccagcagcggcagcggcggcagcgagcacctggaggaccagaccacagccaggaacaccttccaggaggagggcagcggcatgaaggatgtgcctgcctggctgaagagcctgcggctgcacaagtatgctgccctcttcagccagatgacctatgaggagatgatggccctgacagagtgccagctggaggcccagaatgtgaccaagggggcccggcacaagatcgtcatcagcatccagaagctgaaggagcggcagaacctgctgaagagcctggagcgggacatcattgaaggaggcagcctgcgcatccccctgcaggagctgcaccagatgatcctgacccccatcaaggcctacagcagccccagcaccaccccagaggccaggagaagagagccccaggccccccggcagcccagcctgatgggccctgagagccagagcccagactgcaaggatggagctgctgccactggagccacagccacccccagcgctggggccagcggcggcctgcagccccaccagctgagcagctgtgatggagagctggccgtggcccccctgcctgagggggacctgcccggccagttcaccagggtgatgggcaaggtgtgcacccagctgctggtgtccaggccagatgaggagaacatcagcagctacctgcagctgattgacaagtgcctgattcatgaggccttcacagagacccagaagaagaggctgctgtcctggaagcagcaggtgcagaagctgttccgctccttccccaggaagaccctgctggacatcagcggctaccggcagcagaggaacagaggatttggccagagcaacagcctgcccacagctggctctgtgggcggcggcatgggcagaagaaacccccggcagtaccagatccccagcagaaatgtgcccagcgcccggctgggcctgctgggcaccagcggctttgtgagcagcaaccagaggaacaccacagccacccccaccatcatgaagcagggccggcagaacctgtggtttgccaaccctgggggcagcaacagcatgcccagcaggacccacagctctgtgcagaggaccaggagcctgcctgtgcacaccagcccccagaacatgctgatgttccagcagcctgagttccagctgcctgtgacagagccagacatcaacaaccggctggagagcctgtgcctgtccatgacagagcacgccctgggagatggagtggacaggaccagcaccatctag

SEQ ID NO: 171773 - DNA, 2157 bp, Artificial Sequence; identical to SEQ ID NO: 171772
  Description of Artificial Sequence: Synthetic coding sequence

SEQ ID NO: 171774 - DNA, 1038 bp, Artificial Sequence
  Description of Artificial Sequence: Synthetic coding sequence
atgatcctgacccccatcaaggcctacagcagccccagcaccaccccagaggcccggcggcgggagccccaggccccccggcagcccagcctgatgggccctgagagccagagcccagactgcaaggatggagctgctgccaccggggccacagccaccccatctgctggggccagcggcggcctgcagccccaccagctgagcagctgtgatggagagctggccgtggcccccctgcctgagggggacctgcccggccagttcaccagggtgatgggcaaggtgtgcacccagctgctggtgtccaggccagatgaggagaacatcagcagctacctgcagctgattgacaagtgcctgatccacgaggccttcacagagacccagaagaagaggctgctgtcctggaagcagcaggtgcagaagctgttccgctccttccccaggaagaccctgctggacatcagcggctaccggcagcagaggaacagaggcttcggccagagcaacagcctgcccacagctggctctgtgggcggcggcatgggcagaagaaacccccggcagtaccagatccccagcagaaatgtgcccagcgcccggctgggcctgctgggcaccagcggctttgtgagcagcaaccagaggaacaccacagccacccccaccatcatgaagcagggccggcagaacctgtggtttgccaaccctgggggcagcaacagcatgcccagcaggacccacagctctgtgcagaggaccaggagcctgcctgtgcacaccagcccccagaacatgctgatgttccagcagcccggcagccaggtgcacagcggcctgtgcctgacagacctgcggggctggctgagcctgagcggggcccccagcatgcctgccctgactgtgcccaagagcagccagggcgagttccagctgcctgtgacagagccagacatcaacaaccggctggagagcctgtgcctgtccatgacagaacatgccctgggagatggagtggacaggaccagcaccatctag

SEQ ID NO: 171775 - DNA, 981 bp, Artificial Sequence
  Description of Artificial Sequence: Synthetic coding sequence
atggccggccccaaccagctgtgcatccgccgctggaccaccaagcacgtggccgtgtggctgaaggatgagggcttctttgaatatgtggacatcctgtgcaacaagcaccggctggatggcatcaccctgctgaccctgacagaatatgacctgcggagcccccccctggagatcaaggtgctgggggacatcaagaggctgatgctgtctgtgaggaagctgcagaagatccacattgatgtgctggaggagatgggctacaacagcgacagccccatgggctccatgacccccttcatcagcgccctgcagagcacagactggctgtgcaatggagagctgagccatgactgtgatggccccatcacagacctgaacagcgaccagtaccagtacatgaatggcaagaacaagcacagcgtgcggcggctggaccctgagtactggaagaccatcctgagctgcatctacgtgttcatcgtgtttggcttcaccagcttcatcatggtgattgtgcatgagcgggtgcctgacatgcagacctacccacccctgcctgacatcttcctggacagcgtgccccgcatcccctgggcctttgccatgacagaggtgtgtggcatgatcctgtgctacatctggctgctggtgctgctgctgcacaagcacaggagcatcctgctgcggcggctgtgcagcctgatgggcaccgtcttcctgctgcgctgcttcaccatgtttgtgaccagcctgtctgtgcccggccagcacctgcagtgcaccgggaagatctacggctctgtgtgggagaagctgcaccgggcctttgccatctggagcggcttcggcatgaccctgactggagtgcacacctgtggggactacatgttttctggccacacagtggtgctgaccatgctgaacttctttgtgacagagtgcaagtacctgttcagcgcctccatgaggatcagatag

SEQ ID NO: 171776 - DNA, 1437 bp, Artificial Sequence
  Description of Artificial Sequence: Synthetic coding sequence
atgcctgcccggagccgccaccggccccggctgcacagcggcagccccccccgggcccctcctccacccctggaggccctgcacagcggggaggccggccgggccccagacagtgatggcggcagtgatgctgacagcgaggtgggccctggcagccccaccaggacagctgaggccgctgaggaggagatggccggccccaaccagctgtgcatccgccgctggaccaccaagcacgtggccgtgtggctgaaggatgagggcttctttgaatatgtggacatcctgtgcaacaagcaccggctggatggcatcaccctgctgaccctgacagaatatgacctgcggagcccccccctggagatcaaggtgctgggggacatcaagaggctgatgctgtctgtgaggaagctgcagaagatccacattgatgtgctggaggagatgggctacaacagcgacagccccatgggctccatgacccccttcatcagcgccctgcagagcacagactggctgtgcaatggagagctgagccatgactgtgatggccccatcacagacctgaacagcgaccagtaccagtacatgaatggcaagaacaagcacagcgtgcggcggctggaccctgagtactggaagaccatcctgagctgcatctacgtgttcatcgtgtttggcttcaccagcttcatcatggtgattgtgcatgagcgggtgcctgacatgcagacctacccacccctgcctgacatcttcctggacagcgtgccccgcatcccctgggcctttgccatgacagaggtgtgtggcatgatcctgtgctacatctggctgctggtgctgctgctgcacaagcacaggagcatcctgctgcggcggctgtgcagcctgatgggcaccgtcttcctgctgcgctgcttcaccatgtttgtgaccagcctgtctgtgcccggccagcacctgcagtgcaccgggaagatctacggctctgtgtgggagaagctgcaccgggcctttgccatctggagcggcttcggcatgaccctgactggagtgcacacctgtggggactacatgttcagcggccacacagtggtgctgaccatgctgaacttctttgtgacagagtacacccccaggtcctggaacttcctgcacaccctgtcctgggtgctgaacctgtttggcatcttcttcatcctggccgcccacgagcactacagcattgatgtgttcatcgccttctacatcaccaccaggctcttcctgtactaccacaccctggccaacacccgggcctaccagcagagcagaagagcccgcatctggttccccatgttctccttctttgagtgcaatgtgaatggcaccgtgcccaatgagtactgctggcccttcagcaagccagccatcatgaagaggctgattggatag

SEQ ID NO: 171777 - DNA, 765 bp, Artificial Sequence
  Description of Artificial Sequence: Synthetic coding sequence
atggccggccccaaccagctgtgcatccgccgctggaccaccaagcacgtggccgtgtggctgaaggatgagggcttctttgaatatgtggacatcctgtgcaacaagcaccggctggatggcatcaccctgctgaccctgacagaatatgacctgcggagcccccccctggagatcaaggtgctgggggacatcaagaggctgatgctgtctgtgaggaagctgcagaagatccacattgatgtgctggaggagatgggctacaacagcgacagccccatgggctccatgacccccttcatcagcgccctgcagagcacagactggctgtgcaatggagagctgagccatgactgtgatggccccatcacagacctgaacagcgaccagtaccagtacatgaatggcaagaacaagcacagcgtgcggcggctggaccctgagtactggaagaccatcctgagctgcatctacgtgttcatcgtgtttggcttcaccagcttcatcatggtgattgtgcatgagcgggtgcctgacatgcagacctacccacccctgcctgacatcttcctggacagcgtgccccgcatcccctgggcctttgccatgacagaggtgtgtggcatgatcctgtgctacatctggctgctggtgctgctgctgcacaagcacaggagcatcctgctgcggcggctgtgcagcctgatgggcaccgtcttcctgctgcgctgcttcaccatgtttgtgaccagcctgtctgtgtag

SEQ ID NO: 171778 - DNA, 1248 bp, Artificial Sequence
  Description of Artificial Sequence: Synthetic coding sequence
atggccggccccaaccagctgtgcatccgccgctggaccaccaagcacgtggccgtgtggctgaaggatgagggcttctttgaatatgtggacatcctgtgcaacaagcaccggctggatggcatcaccctgctgaccctgacagaatatgacctgcggagcccccccctggagatcaaggtgctgggggacatcaagaggctgatgctgtctgtgaggaagctgcagaagatccacattgatgtgctggaggagatgggctacaacagcgacagccccatgggctccatgacccccttcatcagcgccctgcagagcacagactggctgtgcaatggagagctgagccatgactgtgatggccccatcacagacctgaacagcgaccagtaccagtacatgaatggcaagaacaagcacagcgtgcggcggctggaccctgagtactggaagaccatcctgagctgcatctacgtgttcatcgtgtttggcttcaccagcttcatcatggtgattgtgcatgagcgggtgcctgacatgcagacctacccacccctgcctgacatcttcctggacagcgtgccccgcatcccctgggcctttgccatgacagaggtgtgtggcatgatcctgtgctacatctggctgctggtgctgctgctgcacaagcacaggagcatcctgctgcggcggctgtgcagcctgatgggcaccgtcttcctgctgcgctgcttcaccatgtttgtgaccagcctgtctgtgcccggccagcacctgcagtgcaccgggaagatctacggctctgtgtgggagaagctgcaccgggcctttgccatctggagcggcttcggcatgaccctgactggagtgcacacctgtggggactacatgttttctggccacacagtggtgctgaccatgctgaacttctttgtgacagagtacacccccaggtcctggaacttcctgcacaccctgtcctgggtgctgaacctgtttggcatcttcttcatcctggccgcccacgagcactacagcattgatgtgttcatcgccttctacatcaccaccaggctcttcctgtactaccacaccctggccaacacccgggcctaccagcagagccggcgggcccgcatctggttccccatgttctccttctttgaatgtaatgtgaatggaacagtgcccaatgagtactgctggcccttcagcaagccagccatcatgaagaggctcatcggctag

SEQ ID NO: 171779 - DNA, 4770 bp, Artificial Sequence
  Description of Artificial Sequence: Synthetic coding sequence
atggccaagcagctgaacctgcctgaaaatacagatgactggaccaaggaggatgtgaaccagtggctggagagccacaagattgaccagaagcaccgggagatcctgacagagcaggatgtgaatggagctgtgctgaagtggctgaagaaggagcacctggtggacatgggcatcacccacggccctgccatccagatcgaggagctgttcaaggagctgaggaagacagccatcgaggacagcatccagaccagcaagatgggcaagcccagcaagaatgcccccaaggaccagacagtgtcccagaaggagcggcgggagaccagcaagcagaagcagaagggcaaggagaacccagacatggccaaccccagcgccatgagcaccacagccaagggcagcaagagcctgaaggtggagctgattgaggacaagattgactacaccaaggagcggcagcccagcattgacctgacctgtgtgtcctacccctttgatgagttcagcaacccctaccgctacaagctggacttcagcctgcagcctgagactggacctggcaacctgattgaccccatccacgagttcaaggccttcaccaacacagccacagccacagaagaagatgtgaagatgaagttcagcaatgaggtgttccgctttgccagcgcctgcatgaacagcaggaccaacggcaccatccactttggagtgaaggacaagccccacggcaagatcgtgggcatcaaggtgaccaatgacaccaaggaggccctgatcaaccacttcaacctgatgatcaacaagtactttgaggaccaccaggtgcagcaggccaagaagtgcatccgggagcccaggtttgtggaggtgctgctgcccaacagcaccctgagtgacagatttgtgattgaggtggacatcatcccccagttcagcgagtgccagtatgactacttccagatcaagatgcagaactacaacaacaagatctgggagcagagcaagaagttcagcctgtttgtgagagatggcaccagcagcaaggacatcaccaagaacaaggtggacttccgggccttcaaggctgacttcaagaccctggccgagagcaggaaggctgctgaggagaagttccgggccaagaccaacaagaaggagcgggagggccccaagctggtgaagctgctgactggaaaccaggacctgctggacaacagctactatgagcagtacatcctggtgaccaacaagtgccacccagaccagaccaagcacctggacttcctgaaggagatcaagtggtttgctgtgctggagtttgatcctgagagcaacatcaatggagtggtgaaggcctacaaggagagccgggtggccaacctgcacttccccagcgtgtatgtggagcagaagaccaccccaaatgagaccatcagcaccctgaacctgtaccaccagcccagctggatcttctgcaatggccgcctggacctggacagcgagaagtacaagccctttgaccccagctcctggcagcgggagcgggccagtgatgtgaggaagctgatctccttcctgacccatgaggacatcatgccccggggcaagttcctggtggtgttcctgctgctgagctctgtggatgacccccgggaccccctgattgagaccttctgtgccttctaccaggacctgaagggcatggagaacatcctgtgcatctgtgtgcacccccacatcttccagggctggaaggacctgctggaggcccggctcatcaagcaccaggatgagatcagcagccagtgcatcagcgccctgagcctggaggagatcaatggcaccatcctgaagctgaagtctgtgacccagagcagcaagaggctgctgcccagcatcggcctgagcacagtgctgctgaagaaggaggaggacatcatgacagccctggagatcatctgtgaaaatgaatgtgagggcaccctgctggagaaggacaagaacaagttcctggagttcaaggccagcaaggaggaggacttctaccggggcggcaaggtgtcctggtggaacttctacttcagcagcgagagctacagcagcccctttgtgaagagggacaagtatgagcggctggaggccatgatccagaactgtgccgacagcagcaagcccaccagcaccaagatcatccacctgtaccaccaccctggctgcggcggcaccaccctggccatgcacatcctgtgggagctgaggaagaagttccgctgtgctgtgctgaagaacaagacagtggacttcagcgagattggagagcaggtgaccagcctcatcacctatggagccatgaaccggcaggagtatgtgcctgtgctgctgctggtggatgactttgaggagcaggacaacgtgtacctgctgcagtacagcatccagacagccatcgccaagaagtacatccgctatgagaagcccctggtgatcatcctgaactgcatgaggagccagaaccctgagaagagcgcccgcatcccagacagcattgctgtgatccagcagctgagccccaaggagcagagggcctttgagctgaagctgaaggagatcaaggagcagcacaagaactttgaggacttctacagcttcatgatcatgaagaccaacttcaacaaggagtacattgaaaatgtggtgaggaacatcctgaagggccagaacatcttcaccaaggaggccaagctgttctccttcctggccctgctgaacagctatgtgcctgacaccaccatcagcctgagccagtgtgagaagttcctgggcatcggcaacaagaaggccttctggggcacagagaagtttgaggacaagatgggcacctacagcaccatcctgatcaagacagaggtgattgaatgtggcaactactgcggcgtgcgcatcatccacagcctgattgctgagttcagcctggaggagctgaagaagagctaccacctgaacaagagccagatcatgctggacatgctgacagagaacctcttctttgacaccggcatgggcaagagcaagttcctgcaggacatgcacaccctgctgctgaccaggcacagagatgaacatgaaggagaaacaggcaactggttcagccccttcatcgaggccctgcacaaggatgagggcaatgaggccgtggaggccgtgctgctggagagcatccaccgcttcaaccccaatgccttcatctgccaggccctggcccggcacttctacatcaagaagaaggactttggaaatgccctgaactgggccaagcaggccaagatcatcgagccagacaacagctacatcagtgacaccctgggccaggtgtacaagagcaagatccgctggtggattgaagaaaatggaggaaatggaaacatctctgtggatgacctgattgccctgctggacctggccgagcacgccagcagcgccttcaaggagagccagcagcagagtgaagatcgggagtatgaggtgaaggagcggctgtaccccaagagcaagagaagatatgacacctacaacattgctggctaccagggcgagattgaggtgggcctgtacaccatccagatcctgcagctgatccccttctttgacaacaagaatgagctgagcaagcgctacatggtgaactttgtgtctggcagcagtgacatccctggggaccccaacaatgagtacaagctggccctgaagaactacatcccctacctgaccaagctgaagttcagcctgaagaagagctttgacttctttgatgagtactttgtgctgctgaagcccaggaacaacatcaagcagaatgaggaggccaagaccaggaggaaggtggccggctacttcaagaagtatgtggacatcttctgcctgctggaggagagccagaacaacacaggcctgggcagcaagttcagcgagcccctgcaggtggagcgctgcagaagaaacctggtggccctgaaggctgacaagttcagcggcctgctggagtacctgatcaagagccaggaggatgccatcagcaccatgaagtgcatcgtgaatgagtacaccttcctgctggagcagtgcaccgtgaagatccagagcaaggagaagctgaacttcatcctggccaacatcatcctgagctgcatccagcccaccagccggctggtgaagcctgtggagaagctgaaggaccagctgcgggaggtgctgcagcccatcggcctgacctaccagttcagcgagccctacttcctggccagcctgctcttctggccagagaaccagcagctggaccagcacagcgagcagatgaaggagtatgcccaggccctgaagaacagcttcaagggccagtacaagcacatgcacaggaccaagcagcccatcgcctacttcttcctgggcaagggcaagaggctggagcggctggtgcacaagggcaagattgaccagtgcttcaagaagaccccagacatcaacagcctgtggcagagcggagatgtgtggaaggaggagaaggtgcaggagctgctgctgcggctgcagggccgggcagagaacaactgcctgtacattgaatatggcatcaatgagaagatcaccatccccatcaccccagccttcctgggccagctgcggagcggccgcagcattgagaaggtgtccttctacctgggcttcagcatcggcggccccctggcctatgacatcgagatcgtgtag

SEQ ID NO: 171780 - DNA, 3852 bp, Artificial Sequence
  Description of Artificial Sequence: Synthetic coding sequence
atggccaagcagctgaacctgcctgaaaatacagatgactggaccaaggaggatgtgaaccagtggctggagagccacaagattgaccagaagcaccgggagatcctgacagagcaggatgtgaatggagctgtgctgaagtggctgaagaaggagcacctggtggacatgggcatcacccacggccctgccatccagatcgaggagctgttcaaggagctgaggaagacagccatcgaggacagcatccagaccagcaagatgggcaagcccagcaagaatgcccccaaggaccagacagtgtcccagaaggagcggcgggagaccagcaagcagaagcagaagggcaaggagaacccagacatggccaaccccagcgccatgagcaccacagccaagggcagcaagagcctgaaggtggagctgattgaggacaagattgactacaccaaggagcggcagcccagcattgacctgacctgtgtgtcctacccctttgatgagttcagcaacccctaccgctacaagctggacttcagcctgcagcctgagactggacctggcaacctgattgaccccatccacgagttcaaggccttcaccaacacagccacagccacagaagaagatgtgaagatgaagttcagcaatgaggtgttccgctttgccagcgcctgcatgaacagcaggaccaacggcaccatccactttggagtgaaggacaagccccacggcaagatcgtgggcatcaaggtgaccaatgacaccaaggaggccctgatcaaccacttcaacctgatgatcaacaagtactttgaggaccaccaggtgcagcaggccaagaagtgcatccgggagcccaggtttgtggaggtgctgctgcccaacagcaccctgagtgacagatttgtgattgaggtggacatcatcccccagttcagcgagtgccagtatgactacttccagatcaagatgcagaactacaacaacaagatctgggagcagagcaagaagttcagcctgtttgtgagagatggcaccagcagcaaggacatcaccaagaacaaggtggacttccgggccttcaaggctgacttcaagaccctggccgagagcaggaaggctgctgaggagaagttccgggccaagaccaacaagaaggagcgggagggccccaagctggtgaagctgctgactggaaaccaggacctgctggacaacagctactatgagcagtacatcctggtgaccaacaagtgccacccagaccagaccaagcacctggacttcctgaaggagatcaagtggtttgctgtgctggagtttgatcctgagagcaacatcaatggagtggtgaaggcctacaaggagagccgggtggccaacctgcacttccccagcgtgtatgtggagcagaagaccaccccaaatgagaccatcagcaccctgaacctgtaccaccagcccagctggatcttctgcaatggccgcctggacctggacagcgagaagtacaagccctttgaccccagctcctggcagcgggagcgggccagtgatgtgaggaagctgatctccttcctgacccatgaggacatcatgccccggggcaagttcctggtggtgttcctgctgctgagctctgtggatgacccccgggaccccctgattgagaccttctgtgccttctaccaggacctgaagggcatggagaacatcctgtgcatctgtgtgcacccccacatcttccagggctggaaggacctgctggaggcccggctcatcaagcaccaggatgagatcagcagccagtgcatcagcgccctgagcctggaggagatcaatggcaccatcctgaagctgaagtctgtgacccagagcagcaagaggctgctgcccagcatcggcctgagcacagtgctgctgaagaaggaggaggacatcatgacagccctggagatcatctgtgaaaatgaatgtgagggcaccctgctggagaaggacaagaacaagttcctggagttcaaggccagcaaggaggaggacttctaccggggcggcaaggtgtcctggtggaacttctacttcagcagcgagagctacagcagcccctttgtgaagagggacaagtatgagcggctggaggccatgatccagaactgtgccgacagcagcaagcccaccagcaccaagatcatccacctgtaccaccaccctggctgcggcggcaccaccctggccatgcacatcctgtgggagctgaggaagaagttccgctgtgctgtgctgaagaacaagacagtggacttcagcgagattggagagcaggtgaccagcctcatcacctatggagccatgaaccggcaggagtatgtgcctgtgctgctgctggtggatgactttgaggagcaggacaacgtgtacctgctgcagtacagcatccagacagccatcgccaagaagtacatccgctatgagaagcccctggtgatcatcctgaactgcatgaggagccagaaccctgagaagagcgcccgcatcccagacagcattgctgtgatccagcagctgagccccaaggagcagagggcctttgagctgaagctgaaggagatcaaggagcagcacaagaactttgaggacttctacagcttcatgatcatgaagaccaacttcaacaaggagtacattgaaaatgtggtgaggaacatcctgaagggccagaacatcttcaccaaggaggccaagctgttctccttcctggccctgctgaacagctatgtgcctgacaccaccatcagcctgagccagtgtgagaagttcctgggcatcggcaacaagaaggccttctggggcacagagaagtttgaggacaagatgggcacctacagcaccatcctgatcaagacagaggtgattgaatgtggcaactactgcggcgtgcgcatcatccacagcctgattgctgagttcagcctggaggagctgaagaagagctaccacctgaacaagagccagatcatgctggacatgctgacagagaacctcttctttgacaccggcatgggcaagagcaagttcctgcaggacatgcacaccctgctgctgaccaggcacagagatgaacatgaaggagaaacaggcaactggttcagccccttcatcgaggccctgcacaaggatgagggcaatgaggccgtggaggccgtgctgctggagagcatccaccgcttcaaccccaatgccttcatctgccaggccctggcccggcacttctacatcaagaagaaggactttggaaatgccctgaactgggccaagcaggccaagatcatcgagccagacaacagctacatcagtgacaccctgggccaggtgtacaagagcaagatccgctggtggattgaagaaaatggaggaaatggaaacatctctgtggatgacctgattgccctgctggacctggccgagcacgccagcagcgccttcaaggagagccagcagcagagtgaagatcgggagtatgaggtgaaggagcggctgtaccccaagagcaagagaagatatgacacctacaacattgctggctaccagggcgagattgaggtgggcctgtacaccatccagatcctgcagctgatccccttctttgacaacaagaatgagctgagcaagcgctacatggtgaactttgtgtctggcagcagtgacatccctggggaccccaacaatgagtacaagctggccctgaagaactacatcccctacctgaccaagctgaagttcagcctgaagaagagctttgacttctttgatgagtactttgtgctgctgaagcccaggaacaactag

SEQ ID NO: 171781 - DNA, 4755 bp, Artificial Sequence
  Description of Artificial Sequence: Synthetic coding sequence
atgagcaagcaggtgtccctgcctgagatgatcaaggactggaccaaggagcacgtgaagaagtgggtgaatgaagacctgaagatcaatgagcagtatggccagatcctgctgtctgaggaggtgacaggcctggtgctgcaggagctgacagagaaggacctggtggagatgggcctgccctggggccctgccctgctgatcaagaggagctacaacaagctgaacagcaagagccctgagagtgacaaccacgaccccggccagctggacaacagcaagcccagcaagacagagcaccagaagaaccccaagcacaccaagaaggaggaggagaacagcatgagcagcaacattgattatgacccccgggagatccgggacatcaagcaggaggagagcatcctgatgaaggaaaatgtgctggatgaggtggccaatgccaagcacaagaagaagggcaagctgaagccagagcagctgacctgcatgccctacccctttgaccagttccatgacagccaccgctacatcgagcactacaccctgcagcctgagactggagccctgaacctgattgaccccatccacgagttcaaggccctgaccaacacagaaacagccacagaggtggacatcaagatgaagttcagcaatgaggtgttccgctttgccagcgcctgcatgaacagcaggaccaacggcaccatccactttggagtgaaggacaagccccacggggagatcgtgggcgtgaagatcaccagcaaggccgccttcatcgaccacttcaacgtgatgatcaagaagtactttgaggagagcgagatcaatgaggccaagaagtgcatccgggagcccaggtttgtggaggtgctgctgcagaacaacacccccagcgacagatttgtgattgaggtggacaccatccccaagcacagcatctgcaatgacaagtacttctacatccagatgcagatctgcaaggacaagatctggaagcagaaccagaacctgagcctgtttgtgcgggagggcgccagcagccgggacatcctggccaacagcaagcagagagatgtggacttcaaggccttcctgcagaacctgaagagcctggtggccagcaggaaggaggccgaggaggagtatggcatgaaggccatgaagaaggagagcgagggcctgaagctggtgaagctgctgattggcaacagagacagcctggacaacagctactatgactggtacatcctggtgaccaacaagtgccaccccaaccagatcaagcacctggacttcctgaaggagatcaagtggtttgctgtgctggagtttgatcctgagagcatgatcaatggagtggtgaaggcctacaaggagagccgggtggccaacctgcacttccccaaccagtatgaggacaagaccaccaacatgtgggagaagatcagcaccctgaacctgtaccagcagcccagctggatcttctgcaatggccgcagtgacctgaagtctgagacctacaagcccctggagccccacctgtggcagcgggagcgggccagcgaggtgaggaagctgatcctcttcctgacagatgagaacatcatgacccggggcaagttcctggtggtgttcctgctgctgagctctgtggagagccctggggaccccctgattgagaccttctgggccttctaccaggccctgaagggcatggagaacatgctgtgcatctctgtgaacagccacatctaccagcgctggaaggacctgctgcagaccaggatgaagatggaggatgagctgaccaaccacagcatcagcaccctgaacatcgagctggtgaacagcaccatcctgaagctgaagtctgtgaccaggagcagccgccgcttcctgcctgcccggggcagcagcagcgtcatcctggagaagaagaaggaggatgtgctgacagccctggagatcctgtgtgaaaatgaatgtacagaaacagacatcgagaaggacaagagcaagttcctggagttcaagaagagcaaggaggagcacttctaccggggcggcaaggtgtcctggtggaacttctacttcagcagcgagaactacagcagtgactttgtgaagagggacagctatgagaagctgaaggacctgatccactgctgggccgagagccccaagcccatctttgccaagatcatcaacctgtaccaccaccctggctgcggcggcaccaccctggccatgcacgtgctgtgggacctgaagaagaacttccgctgtgctgtgctgaagaacaagaccacagactttgctgagattgctgagcaggtgatcaacctggtgacctaccgggccaagagccaccaggactacatccctgtgctgctgctggtggatgactttgaggagcaggagaatgtgtacttcctgcagaatgccatccacagcgtgctggccgagaaggacctgcgctatgagaagaccctggtgatcatcctgaactgcatgaggagcagaaatccagatgagagcgccaagctggccgacagcatcgccctgaactaccagctgagcagcaaggagcagagggcctttggagccaagctgaaggagattgagaagcagcacaagaactgtgagaacttctacagcttcatgatcatgaagagcaactttgatgagacctacattgaaaatgtggtgaggaacatcctgaagggccaggatgtggacagcaaggaggcccagctgatctccttcctggccctgctgagcagctatgtgacagacagcaccatctctgtgtcccagtgtgagatcttcctgggcatcatctacaccagcaccccctgggagcctgagagcctggaggacaagatgggcacctacagcaccctgctgatcaagacagaggtggccgagtatggccgctacacaggagtgcgcatcatccaccccctcatcgccctgtactgcctgaaggagctggagaggagctaccacctggacaagtgccagatcgccctgaacatcctggaggagaacctcttctatgacagcggcatcggccgggacaagttccagcatgatgtgcagaccctgctgctgacccggcagaggaaggtgtatggagatgaaacagacaccctcttcagccccctgatggaggccctgcagaacaaggacatcgagaaggtgctgtctgctggcagccgccgcttcccccagaatgccttcatctgccaggccctggcccggcacttctacatcaaggagaaggacttcaacacagccctggactgggcccggcaggccaagatgaaggcccccaagaacagctacatcagtgacaccctgggccaggtgtacaagtctgagatcaagtggtggctggatggcaacaagaactgccgcagcatcaccgtgaatgacctgacccacctgctggaggccgctgagaaggccagccgggccttcaaggagagccagaggcagacagacagcaagaactatgaaacagagaactggagcccccagaagagccagaggagatatgacatgtacaacacagcctgcttcctgggggagattgaggtgggcctgtacaccatccagatcctgcagctgacccccttcttccacaaggaaaatgagctgagcaagaagcacatggtgcagttcctgagcggcaagtggaccatccccccagaccccagaaatgaatgctacctggccctgagcaagttcaccagccacctgaagaacctgcagagcgacctgaagcgctgctttgacttcttcatcgactacatggtgctgctgaagatgagatacacccagaaggagattgctgagatcatgctgagcaagaaggtgagccgctgcttcaggaagtacacagagctgttctgccacctggacccctgcctgctgcagagcaaggagagccagctgctgcaggaggagaactgcaggaagaagctggaggccctgcgggctgacagatttgctggcctgctggagtacctgaaccccaactacaaggatgccaccaccatggagagcatcgtgaatgaatatgccttcctgctgcagcagaacagcaagaagcccatgaccaatgagaagcagaacagcatcctggccaacatcatcctgagctgcctgaagcccaacagcaagctgatccagcccctgaccaccctgaagaagcagctgcgggaggtgctgcagtttgtgggcctgagccaccagtacccaggcccctacttcctggcctgcctgctcttctggccagagaaccaggagctggaccaggacagcaagctgattgagaagtatgtgagcagcctgaacagaagcttccggggccagtacaagaggatgtgccgcagcaagcaggccagcaccctcttctacctgggcaagaggaagggcctgaacagcatcgtgcacaaggccaagattgagcagtactttgacaaggcccagaacaccaacagcctgtggcacagcggagatgtgtggaagaagaatgaggtgaaggacctgctgcggcggctgaccggccaggccgagggcaagctgatctctgtggagtatggaacagaggagaagatcaagatccctgtgatctctgtgtacagcggccccctgcggagcggcaggaacatcgagcgggtgtccttctacctgggcttcagcattgagggccccctggcctatgacattgaagtcatctag

SEQ ID NO: 171782 - DNA, 1221 bp, Artificial Sequence
  Description of Artificial Sequence: Synthetic coding sequence
atgagcaagcaggtgtccctgcctgagatgatcaaggactggaccaaggagcacgtgaagaagtgggtgaatgaagacctgaagatcaatgagcagtatggccagatcctgctgtctgaggaggtgacaggcctggtgctgcaggagctgacagagaaggacctggtggagatgggcctgccctggggccctgccctgctgatcaagaggagctacaacaagctgaacagcaagagccctgagagtgacaaccacgaccccggccagctggacaacagcaagcccagcaagacagagcaccagaagaaccccaagcacaccaagaaggaggaggagaacagcatgagcagcaacattgattatgacccccgggagatccgggacatcaagcaggaggagagcatcctgatgaaggaaaatgtgctggatgaggtggccaatgccaagcacaagaagaagctggaggccctgcgggctgacagatttgctggcctgctggagtacctgaaccccaactacaaggatgccaccaccatggagagcatcgtgaatgaatatgccttcctgctgcagcagaacagcaagaagcccatgaccaatgagaagcagaacagcatcctggccaacatcatcctgagctgcctgaagcccaacagcaagctgatccagcccctgaccaccctgaagaagcagctgcgggaggtgctgcagtttgtgggcctgagccaccagtacccaggcccctacttcctggcctgcctgctcttctggccagagaaccaggagctggaccaggacagcaagctgattgagaagtatgtgagcagcctgaacagaagcttccggggccagtacaagaggatgtgccgcagcaagcaggccagcaccctcttctacctgggcaagaggaagggcctgaacagcatcgtgcacaaggccaagattgagcagtactttgacaaggcccagaacaccaacagcctgtggcacagcggagatgtgtggaagaagaatgaggtgaaggacctgctgcggcggctgaccggccaggccgagggcaagctgatctctgtggagtatggaacagaggagaagatcaagatccctgtgatctctgtgtacagcggccccctgcggagcggcaggaacatcgagcgggtgtccttctacctgggcttcagcattgagggccccctggcctatgacattgaagtcatctag

SEQ ID NO: 171783 - DNA, 4755 bp, Artificial Sequence; identical to SEQ ID NO: 171781
  Description of Artificial Sequence: Synthetic coding sequence

SEQ ID NO: 171784 - DNA, 213 bp, Artificial Sequence
  Description of Artificial Sequence: Synthetic coding sequence
atgagcaagcaggtgtccctgcctgagatgatcaaggactggaccaaggagcacgtgaagaagtgggtgaatgaagacctgaagatcaatgagcagtatggccagatcctgctgtctgaggaggtgacaggcctggtgctgcaggagctgacagagaaggacctggtggagatgggcctgccctggggccctgccctgctgatcaagaggtag

SEQ ID NO: 171785 - DNA, 4755 bp, Artificial Sequence; identical to SEQ ID NO: 171781
  Description of Artificial Sequence: Synthetic coding sequence

SEQ ID NO: 171786 - DNA, 213 bp, Artificial Sequence; identical to SEQ ID NO: 171784
  Description of Artificial Sequence: Synthetic coding sequence

SEQ ID NO: 171787 - DNA, 213 bp, Artificial Sequence; identical to SEQ ID NO: 171784
  Description of Artificial Sequence: Synthetic coding sequence

SEQ ID NO: 171788 - DNA, 213 bp, Artificial Sequence; identical to SEQ ID NO: 171784
  Description of Artificial Sequence: Synthetic coding sequence

SEQ ID NO: 171789 - DNA, 957 bp, Artificial Sequence
  Description of Artificial Sequence: Synthetic coding sequence
atggccccctgggccgaggccgagcacagcgccctgaaccccctgcgggctgtgtggctgaccctgacagctgccttcctgctgaccctgctgctgcagctgctgcccccaggcctgctgcccggctgtgccatcttccaggacctgatccgctatggcaagaccaagtgtggggagcccagcaggcctgctgcctgccgggcctttgatgtgcccaagcgctacttcagccacttctacatcatctctgtgctgtggaatggcttcctgctgtggtgcctgacccagagcctcttcctgggcgcccccttccccagctggctgcacggcctgctgcgcatcctgggcgccgcccagttccagggcggggagctggccctgagcgccttcctggtgctggtgttcctgtggctgcacagcctgcggcggctgtttgagtgcctgtatgtgtctgtgttcagcaatgtgatgattcatgtggtgcagtactgcttcggcctggtgtactacgtgctggtgggcctgactgtgctgagccaggtgcccatggatggaagaaatgcctacatcaccgggaagaacctgctgatgcaggcccgctggttccacatcctgggcatgatgatgttcatctggagcagcgcccaccagtacaagtgccacgtgatcctgggcaacctgaggaagaacaaggccggcgtggtgatccactgcaaccaccgcatcccctttggagactggtttgaatatgtgagcagccccaactacctggccgagctgatgatctacgtgtccatggctgtgaccttcggcttccacaacctgacctggtggctggtggtgaccaacgtgttcttcaaccaggccctgagcgccttcctgagccaccagttctacaagagcaagtttgtgtcctaccccaagcacaggaaggccttcctgcccttcctgttctag

SEQ ID NO: 171790 - DNA, 711 bp, Artificial Sequence
  Description of Artificial Sequence: Synthetic coding sequence
atgacccgctgcccagctggccaggccgaggtggagatggccgagctgtatgtgaagccaggcaacaaggagcggggctggaatgaccccccccagttctcctatggcctgcagacccaggccggcggccccaggaggagcctgctgaccaagagggtggccgccccccaggacggcagcccccgggtgcctgccagcgagaccagccctggccccccacccatgggccccccaccacccagcagcaaggcccccaggagcccccctgtgggcagcggccctgccagcggcgtggagcccaccagcttccctgtggagagcgaggccgtgatggaggatgtgctgcggcccctggagcaggccctggaggactgccggggccacaccaggaagcaggtgtgtgatgacatcagccggcggctggccctgctgcaggagcagtgggccggcggcaagctgagcatccctgtgaagaagaggatggccctgctggtgcaggagctgagcagccaccgctgggatgctgctgatgacatccacaggagcctgatggtggaccacgtgacagaggtgtcccagtggatggtgggcgtgaagaggctgattgctgagaagaggagcctcttcagcgaggaggccgccaatgaggagaagtctgctgccacagctgagaagaaccacaccatccctggcttccagcaggccagctag

SEQ ID NO: 171791 - DNA, 681 bp, Artificial Sequence
  Description of Artificial Sequence: Synthetic coding sequence
atggagggctgtgtgagcaacctgatggtgtgcaacctggcctacagcggcaagctggaggagctgaaggagagcatcctggccgacaagagcctggccaccaggacagaccaggacagcaggacagccctgcactgggcctgcagcgctggccacacagaaattgtggagttcctgctgcagctgggcgtgcctgtgaatgacaaggatgatgctggctggagccccctgcacatcgccgccagcgctggaagagatgagatcgtgaaggccctgctgggcaaaggagcccaggtgaatgctgtgaaccagaatggctgcacccccctgcactatgctgccagcaagaacagacatgaaattgctgtgatgctgctggagggcggggccaacccagatgccaaggaccactatgaggccacagccatgcacagagctgctgccaagggcaacctgaagatgatccacatcctgctgtactacaaggccagcaccaacatccaggacacagagggcaacacccccctgcacctggcctgtgatgaggagcgggtggaggaggccaagctgctggtgtcccagggcgccagcatctacatcgagaacaaggaggagaagacccccctgcaggtggccaagggcggcctgggcctcatcctgaagaggatggtggagggctag

SEQ ID NO: 171792 - DNA, 780 bp, Artificial Sequence
  Description of Artificial Sequence: Synthetic coding sequence
atggccacagccactggagtggccgaggagcggctgctggccgccctggcctacctgcagtgtgctgtgggctgtgctgtgtttgccaggaaccggcagaccaacagcgtgtatggaagacatgccctgcccagccaccggctgcgggtgcctgcccgggccgcctgggtggtgcaggagctgcccagcctggccctgcccctgtaccagtatgccagcgagagcgccccccggctgcggagcgcccccaactgcatcctgctggccatgttcctggtgcactacggccaccgctgcctgatctaccccttcctgatgaggggcggcaagcccatgcccctgctggcctgcaccatggccatcatgttctgcacctgcaatggctacctgcagagccgctacctgagccactgtgctgtgtatgcagatgactgggtgacagacccccgcttcctgattggatttggcctgtggctgaccggcatgctgatcaacatccacagcgaccacatcctgaggaacctgaggaagccaggggacaccggctacaagatcccccggggcggcctgtttgaatatgtgacagctgccaactactttggagagatcatggagtggtgtggctacgccctggcctcctggagcgtgcagggcgccgcctttgccttcttcaccttctgcttcctgagcggccgggccaaggagcaccacgagtggtacctgaggaagtttgaggagtaccccaagttcaggaagatcatcatccccttcctgttctag

SEQ ID NO: 171793 - DNA, 585 bp, Artificial Sequence
  Description of Artificial Sequence: Synthetic coding sequence
atggagcacgccgcccagccctggcgctggcagaggagaagaggctggaggagaagtgcctgctggcccaggagccccacctgcagcgccccctgggccgcccggagcagccgggccatcgtgcggaggacccagtgcacagctgccacccgctgcccagccactggaagtgagtgccggcggggccccccaggctggtgccgcagctgcccccgctggccctgccgcagcaccagcaccccagccagccccccccgggtgtctgctgcccggcccacagccagctcctggccctgcagcagcagcaccaccggcattggaaatgtgggcatgcaggccctggccgtgtgcctgcaccccaagtgccagcccatggtgcccatcgtgtgcccagacctgaaccacgacagcaagacccagcgggagattgctggcatccgctgcagctacagcctgctgggcaacacagctgccagccgccgcatccccaccagcctgatgacccagcacctgaatgcccacctgctggccaacacctgctttgctgtgaaccagtatgaggtgttcctgggcgtgctggcctag

SEQ ID NO: 171794 - DNA, 639 bp, Artificial Sequence
  Description of Artificial Sequence: Synthetic coding sequence
atggagcacgccgcccagccctggcgctggcagaggagaagaggctggaggagaagtgcctgctggcccaggagccccacctgcagcgccccctgggccgcccggagcagccgggccatcgtgcggaggacccagtgcacagctgccacccgctgcccagccactggaagtgagtgccggcggggccccccaggctggtgccgcagctgcccccgctggccctgccgcagcaccagcaccccagccagccccccccgggtgtctgctgcccggcccacagccagctcctggccctgcagcagcagcaccaccggcatcggcttcggcctgtggctgaccggcatgctgatcaacatccacagcgaccacatcctgaggaacctgaggaagccaggggacaccggctacaagatcccccggggcggcctgtttgaatatgtgacagctgccaactactttggagagatcatggagtggtgtggctacgccctggcctcctggagcgtgcagggcgccgcctttgccttcttcaccttctgcttcctgagcggccgggccaaggagcaccacgagtggtacctgaggaagtttgaggagtaccccaagttcaggaagatcatcatccccttcctgttctag

SEQ ID NO: 171795 - DNA, 858 bp, Artificial Sequence
  Description of Artificial Sequence: Synthetic coding sequence
atgctgctggccaccttcaagctgtgtgccggcagcagctaccgccacatgaggaacatgaagggcctgcggcagcaggccgtgatggccatcagccaggagctgaacagaagagccctgggcggccccacccccagcacctggatcaaccaggtgagaagaagaagcagcctgctgggcagccggctggaggagaccctgtacagcgaccaggagctggcctacctgcagcagggcgaggaggccatgcagaaggccctgggcatcctgagcaaccaggagggctggaagaaggagagccagcaggacaacggggacaaggtgatgagcaaggtggtgcctgatgtgggcaaggtgttccggctggaggtggtggtggaccagcccatggagcggctgtatgaggagctggtggagaggatggaggccatgggagagtggaaccccaacgtgaaggagatcaaggtgctgcagaagattggcaaggacaccttcatcacccatgagctggccgctgaggccgccggcaacctggtgggcccccgggactttgtgtctgtgcgctgtgccaagaggcggggcagcacctgtgtgctggccggcatggccacagactttggaaacatgcctgagcagaagggcgtcatccgggcagagcacggccccacctgcatggtgctgcaccccctggccggcagccccagcaagaccaagctgacctggctgctgagcattgacctgaagggctggctgcccaagagcatcatcaaccaggtgctgagccagacccaggtggactttgccaaccacctgaggaagaggctggagagccacccagccagcgaggcccgctgctag

SEQ ID NO: 171796 - DNA, 744 bp, Artificial Sequence
  Description of Artificial Sequence: Synthetic coding sequence
atgctgctggccaccttcaagctgtgtgccggcagcagctaccgccacatgaggaacatgaagggcagccggctggaggagaccctgtacagcgaccaggagctggcctacctgcagcagggcgaggaggccatgcagaaggccctgggcatcctgagcaaccaggagggctggaagaaggagagccagcaggacaacggggacaaggtgatgagcaaggtggtgcctgatgtgggcaaggtgttccggctggaggtggtggtggaccagcccatggagcggctgtatgaggagctggtggagaggatggaggccatgggagagtggaaccccaacgtgaaggagatcaaggtgctgcagaagattggcaaggacaccttcatcacccatgagctggccgctgaggccgccggcaacctggtgggcccccgggactttgtgtctgtgcgctgtgccaagaggcggggcagcacctgtgtgctggccggcatggccacagactttggaaacatgcctgagcagaagggcgtcatccgggcagagcacggccccacctgcatggtgctgcaccccctggccggcagccccagcaagaccaagctgacctggctgctgagcattgacctgaagggctggctgcccaagagcatcatcaaccaggtgctgagccagacccaggtggactttgccaaccacctgaggaagaggctggagagccacccagccagcgaggcccgctgctag

SEQ ID NO: 171797 - DNA, 969 bp, Artificial Sequence
  Description of Artificial Sequence: Synthetic coding sequence
atgagcagcagcccctgggagcccgccaccctgcggcgggtgtttgtggtgggcgtgggcatgaccaagtttgtgaagccaggagctgagaacagccgggactacccagacctggccgaggaggccggcaagaaggccctggctgatgcccagatcccctacagcgctgtggaccaggcctgtgtgggctacgtgtttggagtggccgagtgtgtgctggccctgggctttgagaagatgagcaagggcagcctgggcatcaagttcagtgacaggaccatccccacagacaagcacgtggacctgctgatcaacaagtatggcctgagcgcccaccctgtggccccccagatgtttggctacgccggcaaggagcacatggagaagtatggcaccaagattgagcactttgccaagattggctggaagaaccacaagcacagcgtgaacaacccctacagccagttccaggatgagtacagcctggatgaggtgatggccagcaaggaggtgtttgacttcctgaccatcctgcagtgctgccccaccagtgatggagctgctgctgccatcctggccagcgaggcctttgtgcagaagtatggcctgcagagcaaggctgtggagatcctggcccaggagatgatgacagacctgcccagcagctttgaggagaagagcatcatcaagatggtgggctttgacatgagcaaggaggccgccaggaaatgttatgagaagagcggcctgaccccaaatgacattgatgtgattgagctgcatgactgcttcagcaccaatgagctgctgacctatgaggccctgggcctgtgcccagagggccagggcgccaccctggtggacagaggagacaacacctacggcggcaagtgggtgatcaaccccagcggcggcctcatcagcaagggccaccccctgggcgccaccggcggccacagctgcagctag

SEQ ID NO: 171798 - DNA, 1644 bp, Artificial Sequence
  Description of Artificial Sequence: Synthetic coding sequence
atgagcagcagcccctgggagcccgccaccctgcggcgggtgtttgtggtgggcgtgggcatgaccaagtttgtgaagccaggagctgagaacagccgggactacccagacctggccgaggaggccggcaagaaggccctggctgatgcccagatcccctacagcgctgtggaccaggcctgtgtgggctacgtgtttggagacagcacctgtggccagagggccatctaccacagcctgggcatgacaggcatccccatcatcaacgtgaacaacaactgtgccaccggcagcacagccctcttcatggcccggcagctgatccagggcggcgtggccgagtgtgtgctggccctgggctttgagaagatgagcaagggcagcctgggcatcaagttcagtgacaggaccatccccacagacaagcacgtggacctgctgatcaacaagtatggcctgagcgcccaccctgtggccccccagatgtttggctacgccggcaaggagcacatggagaagtatggcaccaagattgagcactttgccaagattggctggaagaaccacaagcacagcgtgaacaacccctacagccagttccaggatgagtacagcctggatgaggtgatggccagcaaggaggtgtttgacttcctgaccatcctgcagtgctgccccaccagtgatggagctgctgctgccatcctggccagcgaggcctttgtgcagaagtatggcctgcagagcaaggctgtggagatcctggcccaggagatgatgacagacctgcccagcagctttgaggagaagagcatcatcaagatggtgggctttgacatgagcaaggaggccgccaggaaatgttatgagaagagcggcctgaccccaaatgacattgatgtgattgagctgcatgactgcttcagcaccaatgagctgctgacctatgaggccctgggcctgtgcccagagggccagggcgccaccctggtggacagaggagacaacacctacggcggcaagtgggtgatcaaccccagcggcggcctcatcagcaagggccaccccctgggcgccaccggcctggcccagtgtgccgagctgtgctggcagctgcggggggaggccggcaagaggcaggtgcctggggccaaggtggccctgcagcacaacctgggcatcggcggcgctgtggtggtgaccctgtacaagatgggcttccctgaggccgccagcagcttccgcacccaccagattgaagctgtgcccaccagcagcgccagtgatggcttcaaggccaacctggtgttcaaggagattgagaagaagctggaggaggagggggagcagtttgtgaagaagattggaggcatctttgccttcaaggtgaaggatggccctgggggcaaggaggccacctgggtggtggatgtgaagaatggcaagggctctgtgctgcccaacagcgacaagaaggctgactgcaccatcaccatggctgacagcgacttcctggccctgatgaccgggaagatgaacccccagagcgccttcttccagggcaagctgaagatcaccggcaacatgggcctggccatgaagctgcagaacctgcagctgcagcctggaaatgccaagctgtag

SEQ ID NO: 171799 - DNA, 1572 bp, Artificial Sequence
  Description of Artificial Sequence: Synthetic coding sequence
atgagcagcagcccctgggagcccgccaccctgcggcgggtgtttgtggtgggcgtgggcatgaccaagtttgtgaagccaggagctgagaacagccgggactacccagacctggccgaggaggccggggacagcacctgtggccagagggccatctaccacagcctgggcatgacaggcatccccatcatcaacgtgaacaacaactgtgccaccggcagcacagccctcttcatggcccggcagctgatccagggcggcgtggccgagtgtgtgctggccctgggctttgagaagatgagcaagggcagcctgggcatcaagttcagtgacaggaccatccccacagacaagcacgtggacctgctgatcaacaagtatggcctgagcgcccaccctgtggccccccagatgtttggctacgccggcaaggagcacatggagaagtatggcaccaagattgagcactttgccaagattggctggaagaaccacaagcacagcgtgaacaacccctacagccagttccaggatgagtacagcctggatgaggtgatggccagcaaggaggtgtttgacttcctgaccatcctgcagtgctgccccaccagtgatggagctgctgctgccatcctggccagcgaggcctttgtgcagaagtatggcctgcagagcaaggctgtggagatcctggcccaggagatgatgacagacctgcccagcagctttgaggagaagagcatcatcaagatggtgggctttgacatgagcaaggaggccgccaggaaatgttatgagaagagcggcctgaccccaaatgacattgatgtgattgagctgcatgactgcttcagcaccaatgagctgctgacctatgaggccctgggcctgtgcccagagggccagggcgccaccctggtggacagaggagacaacacctacggcggcaagtgggtgatcaaccccagcggcggcctcatcagcaagggccaccccctgggcgccaccggcctggcccagtgtgccgagctgtgctggcagctgcggggggaggccggcaagaggcaggtgcctggggccaaggtggccctgcagcacaacctgggcatcggcggcgctgtggtggtgaccctgtacaagatgggcttccctgaggccgccagcagcttccgcacccaccagattgaagctgtgcccaccagcagcgccagtgatggcttcaaggccaacctggtgttcaaggagattgagaagaagctggaggaggagggggagcagtttgtgaagaagattggaggcatctttgccttcaaggtgaaggatggccctgggggcaaggaggccacctgggtggtggatgtgaagaatggcaagggctctgtgctgcccaacagcgacaagaaggctgactgcaccatcaccatggctgacagcgacttcctggccctgatgaccgggaagatgaacccccagagcgccttcttccagggcaagctgaagatcaccggcaacatgggcctggccatgaagctgcagaacctgcagctgcagcctggaaatgccaagctgtag

SEQ ID NO: 171800 - DNA, 180 bp, Artificial Sequence
  Description of Artificial Sequence: Synthetic coding sequence
atgggcttccctgaggccgccagcagcttccgcacccaccagattgaagctgtgcccaccagcagcgccagtgatggcttcaaggccaacctggtgttcaaggagattgagaagaagctggaggagatccggcggctgacagcccagagccagtggctgacccagacctcctggctgtag

SEQ ID NO: 171801 - DNA, 423 bp, Artificial Sequence
  Description of Artificial Sequence: Synthetic coding sequence
atgggcttccctgaggccgcccggacccaccagatcgaggccgtgcccaccagcagcgccagtgatggcttcaaggccaacctggtgttcaaggagattgagaagaagctggaggaggagggggagcagtttgtgaagaagattggaggcatctttgccttcaaggtgaaggatggccctgggggcaaggaggccacctgggtggtggatgtgaagaatggaaaaggatctgtgctgcccaacagcgacaagaaggctgactgcaccatcaccatggctgacagcgacttcctggccctgatgaccgggaagatgaacccccagagcgccttcttccagggcaagctgaagatcactggaaacatgggcctggccatgaagctgcagaacctgcagctgcagcctggaaatgccaagctgtag

SEQ ID NO: 171802 - DNA, 432 bp, Artificial Sequence
  Description of Artificial Sequence: Synthetic coding sequence
atgggcttccctgaggccgccagcagcttccgcacccaccagattgaagctgtgcccaccagcagcgccagtgatggcttcaaggccaacctggtgttcaaggagattgagaagaagctggaggaggagggggagcagtttgtgaagaagattggaggcatctttgccttcaaggtgaaggatggccctgggggcaaggaggccacctgggtggtggatgtgaagaatggcaagggctctgtgctgcccaacagcgacaagaaggctgactgcaccatcaccatggctgacagcgacttcctggccctgatgaccgggaagatgaacccccagagcgccttcttccagggcaagctgaagatcaccggcaacatgggcctggccatgaagctgcagaacctgcagctgcagcctggaaatgccaagctgtag

SEQ ID NO: 171803 - DNA, 180 bp, Artificial Sequence; identical to SEQ ID NO: 171800
  Description of Artificial Sequence: Synthetic coding sequence

SEQ ID NO: 171804 - DNA, 1401 bp, Artificial Sequence
  Description of Artificial Sequence: Synthetic coding sequence
atgacaggcatccccatcatcaacgtgaacaacaactgtgccaccggcagcacagccctcttcatggcccggcagctgatccagggcggcgtggctgaatgtgtgctggccctgggctttgagaagatgagcaagggcagcctgggcatcaagttcagtgacaggaccatccccacagacaagcacgtggacctgctgatcaacaagtatggcctgagcgcccaccctgtggccccccagatgtttggctacgccggcaaggagcacatggagaagtatggcaccaagattgagcactttgccaagattggctggaagaaccacaagcacagcgtgaacaacccctacagccagttccaggatgagtacagcctggatgaggtgatggccagcaaggaggtgtttgacttcctgaccatcctgcagtgctgccccaccagtgatggagctgctgctgccatcctggccagcgaggcctttgtgcagaagtatggcctgcagagcaaggctgtggagatcctggcccaggagatgatgacagacctgcccagcagctttgaggagaagagcatcatcaagatggtgggctttgacatgagcaaggaggccgccaggaagtgctatgagaagagcggcctgaccccaaatgacattgatgtgattgagctgcatgactgcttcagcaccaatgagctgctgacctatgaggccctgggcctgtgcccagagggccagggcgccaccctggtggacagaggagacaacacctatggaggcaagtgggtgatcaaccccagcggcggcctcatcagcaagggccaccccctgggcgccaccggcctggcccagtgtgccgagctgtgctggcagctgcggggggaggccggcaagaggcaggtgcctggggccaaggtggccctgcagcacaacctgggcattggaggagctgtggtggtgaccctgtacaagatgggcttccctgaggccgccagcagcttccgcacccaccagatcgaggccgtgcccaccagcagcgccagtgatggcttcaaggccaacctggtgttcaaggagattgagaagaagctggaggaggagggggagcagtttgtgaagaagattggaggcatctttgccttcaaggtgaaggatggccctgggggcaaggaggccacctgggtggtggatgtgaagaatggaaaaggatctgtgctgcccaacagcgacaagaaggctgactgcaccatcaccatggctgacagcgacttcctggccctgatgaccgggaagatgaacccccagagcgccttcttccagggcaagctgaagatcactggaaacatgggcctggccatgaagctgcagaacctgcagctgcagcctggaaatgccaagctgtag

SEQ ID NO: 171805 - DNA, 1512 bp, Artificial Sequence
  Description of Artificial Sequence: Synthetic coding sequence
atgagcagcagcccctgggagcccgccaccctgcggcgggtgtttgtggtgggcgtgggcatgaccaagtttgtgaagccaggagctgagaacagccgggactacccagacctggccgaggaggccggcaagaaggccctggctgatgcccagatcccctacagcgctgtggaccaggcctgtgtgggctacgtgtttggagtggccgagtgtgtgctggccctgggctttgagaagatgagcaagggcagcctgggcatcaagttcagtgacaggaccatccccacagacaagcacgtggacctgctgatcaacaagtatggcctgagcgcccaccctgtggccccccagatgtttggctacgccggcaaggagcacatggagaagtatggcaccaagattgagcactttgccaagattggctggaagaaccacaagcacagcgtgaacaacccctacagccagttccaggatgagtacagcctggatgaggtgatggccagcaaggaggtgtttgacttcctgaccatcctgcagtgctgccccaccagtgatggagctgctgctgccatcctggccagcgaggcctttgtgcagaagtatggcctgcagagcaaggctgtggagatcctggcccaggagatgatgacagacctgcccagcagctttgaggagaagagcatcatcaagatggtgggctttgacatgagcaaggaggccgccaggaaatgttatgagaagagcggcctgaccccaaatgacattgatgtgattgagctgcatgactgcttcagcaccaatgagctgctgacctatgaggccctgggcctgtgcccagagggccagggcgccaccctggtggacagaggagacaacacctacggcggcaagtgggtgatcaaccccagcggcggcctcatcagcaagggccaccccctgggcgccaccggcctggcccagtgtgccgagctgtgctggcagctgcggggggaggccggcaagaggcaggtgcctggggccaaggtggccctgcagcacaacctgggcatcggcggcgctgtggtggtgaccctgtacaagatgggcttccctgaggccgccagcagcttccgcacccaccagattgaagctgtgcccaccagcagcgccagtgatggcttcaaggccaacctggtgttcaaggagattgagaagaagctggaggaggagggggagcagtttgtgaagaagattggaggcatctttgccttcaaggtgaaggatggccctgggggcaaggaggccacctgggtggtggatgtgaagaatggcaagggctctgtgctgcccaacagcgacaagaaggctgactgcaccatcaccatggctgacagcgacttcctggccctgatgaccgggaagatgaacccccagagcgccttcttccagggcaagctgaagatcaccggcaacatgggcctggccatgaagctgcagaacctgcagctgcagcctggaaatgccaagctgtag

SEQ ID NO: 171806 - DNA, 1653 bp, Artificial Sequence
  Description of Artificial Sequence: Synthetic coding sequence
atggtgggggaggagaagatgagcctgaggaaccggctgagcaagagccgggagaaccctgaggaggatgaggaccagagaaatcctgccaaggagagcctggagacccccagcaatggaagaattgacatcaagcagctgattgccaagaagatcaagctgacagctgaggccgaggagctgaagcccttcttcatgaaggaggtgggcagccactttgatgactttgtgaccaacctgattgagaagagcgccagcctggacaatggaggctgtgccctgaccaccttctctgtgctggagggggagaagaacaaccaccgggccaaggacctgcgggcccctcctgagcagggcaagatcttcatcgcccggcgcagcctgctggatgagctgctggaggtggaccacatccgcaccatctaccacatgttcatcgccctgctgatcctcttcatcctgagcaccctggtggtggactacattgatgagggccgcctggtgctggagttcagcctgctgtcctatgccttcggcaagttccccaccgtggtgtggacctggtggatcatgttcctgagcaccttctctgtgccctacttcctgttccagcactgggccaccggctacagcaagagcagccaccccctcatccgcagcctcttccacggcttcctgttcatgatcttccagatcggcgtgctgggcttcggccccacctacgtggtgctggcctacaccctgcccccagccagccgcttcatcatcatctttgagcagatccgctttgtgatgaaggcccacagctttgtgagagaaaatgtgccccgggtgctgaacagcgccaaggagaagagcagcacagtgcccatccccaccgtgaaccagtacctgtacttcctgtttgcccccaccctcatctacagagacagctaccccaggaaccccaccgtgcgctggggctacgtggccatgaagtttgcccaggtgtttggctgcttcttctacgtgtactacatctttgagcggctgtgtgcccccctcttcaggaacatcaagcaggagcccttcagcgcccgggtgctggtgctgtgtgtgttcaacagcatcctgcccggggtgctgatcctcttcctgaccttctttgccttcctgcactgctggctgaatgcctttgctgagatgctgcgctttggagacaggatgttctacaaggactggtggaacagcaccagctacagcaactactaccgcacctggaatgtggtggtgcatgactggctgtactactatgcctacaaggacttcctgtggttcttcagcaagcgcttcaagtctgctgccatgctggccgtgtttgctgtgtctgctgtggtgcatgaatatgccctggccgtgtgcctgtccttcttctaccctgtgctgtttgtgctcttcatgttcttcggcatggccttcaacttcatcgtgaatgacagcaggaagaagcccatctggaatgtgctgatgtggaccagcctcttcctgggcaatggagtgctgctgtgcttctacagccaggagtggtacgcccggcagcactgccccctgaagaaccccaccttcctggactatgtgcggcccaggtcctggacctgccgctacgtgttctag

SEQ ID NO: 171807 - DNA, 783 bp, Artificial Sequence
  Description of Artificial Sequence: Synthetic coding sequence
atggtgggggaggagaagatgagcctgaggaaccggctgagcaagagccgggagaaccctgaggaggatgaggaccagagaaatcctgccaaggagagcctggagacccccagcaatggaagaattgacatcaagcagctgattgccaagaagatcaagctgacagctgaggccgaggagctgaagcccttcttcatgaaggaggtgggcagccactttgatgactttgtgaccaacctgattgagaagagcgccagcctggacaatggaggctgtgccctgaccaccttctctgtgctggagggggagaagaacaaccaccgggccaaggacctgcgggcccctcctgagcagggcaagatcttcatcgcccggcgcagcctgctggatgagctgctggaggtggaccacatccgcaccatctaccacatgttcatcgccctgctgatcctcttcatcctgagcaccctggtggtggactacattgatgagggccgcctggtgctggagttcagcctgctgtcctatgccttcggcaagttccccaccgtggtgtggacctggtggatcatgttcctgagcaccttctctgtgccctacttcctgttccagcactgggccaccggctacagcaagagcagccaccccctcatccgcagcctcttccacggcttcctgttcatgatcttccagatcggcgtgctgggcttcggccccacctacgtggtgctggcctacaccctgcccccagccagccgcttcatcatcatctttgagcagtag

SEQ ID NO: 171808 - DNA, 861 bp, Artificial Sequence
  Description of Artificial Sequence: Synthetic coding sequence
atgaaggcccacagctttgtgagagaaaatgtgccccgggtgctgaacagcgccaaggagaagagcagcacagtgcccatccccaccgtgaaccagtacctgtacttcctgtttgcccccaccctcatctacagagacagctaccccaggaaccccaccgtgcgctggggctacgtggccatgaagtttgcccaggtgtttggctgcttcttctacgtgtactacatctttgagcggctgtgtgcccccctcttcaggaacatcaagcaggagcccttcagcgcccgggtgctggtgctgtgtgtgttcaacagcatcctgcccggggtgctgatcctcttcctgaccttctttgccttcctgcactgctggctgaatgcctttgctgagatgctgcgctttggagacaggatgttctacaaggactggtggaacagcaccagctacagcaactactaccgcacctggaatgtggtggtgcatgactggctgtactactatgcctacaaggacttcctgtggttcttcagcaagcgcttcaagtctgctgccatgctggccgtgtttgctgtgtctgctgtggtgcatgaatatgccctggccgtgtgcctgtccttcttctaccctgtgctgtttgtgctcttcatgttcttcggcatggccttcaacttcatcgtgaatgacagcaggaagaagcccatctggaatgtgctgatgtggaccagcctcttcctgggcaatggagtgctgctgtgcttctacagccaggagtggtacgcccggcagcactgccccctgaagaaccccaccttcctggactatgtgcggcccaggtcctggacctgccgctacgtgttctag

SEQ ID NO: 171809 - DNA, 1458 bp, Artificial Sequence
  Description of Artificial Sequence: Synthetic coding sequence
atgaaggaggtgggcagccactttgatgactttgtgaccaacctgattgagaagagcgccagcctggacaatggaggctgtgccctgaccaccttctctgtgctggagggggagaagaacaaccaccgggccaaggacctgcgggcccctcctgagcagggcaagatcttcatcgcccggcgcagcctgctggatgagctgctggaggtggaccacatccgcaccatctaccacatgtttattgccctgctgatcctcttcatcctgagcaccctggtggtggactacattgatgagggccgcctggtgctggagttcagcctgctgtcctatgccttcggcaagttccccaccgtggtgtggacctggtggatcatgttcctgagcaccttctctgtgccctacttcctgttccagcactgggccaccggctacagcaagagcagccaccccctcatccgcagcctcttccacggcttcctgttcatgatcttccagattggagtgctgggcttcggccccacctacgtggtgctggcctacaccctgcccccagccagccgcttcatcatcatctttgagcagatccgctttgtgatgaaggcccacagctttgtgcgggagaatgtgccccgggtgctgaacagcgccaaggagaagagcagcacagtgcccatccccaccgtgaaccagtacctgtacttcctgtttgcccccaccctcatctacagagacagctaccccaggaaccccaccgtgcgctggggctacgtggccatgaagtttgcccaggtgtttggctgcttcttctacgtgtactacatctttgagcggctgtgtgcccccctcttcaggaacatcaagcaggagcccttcagcgcccgggtgctggtgctgtgtgtgttcaacagcatcctgcccggggtgctgatcctcttcctgaccttctttgccttcctgcactgctggctgaatgcctttgctgagatgctgcgctttggagacaggatgttctacaaggactggtggaacagcaccagctacagcaactactaccgcacctggaatgtggtggtgcatgactggctgtactactatgcctacaaggacttcctgtggttcttcagcaagcgcttcaagtctgctgccatgctggccgtgtttgctgtgtctgctgtggtgcatgaatatgccctggccgtgtgcctgtccttcttctaccctgtgctgtttgtgctcttcatgttcttcggcatggccttcaacttcatcgtgaatgacagcaggaagaagcccatctggaatgtgctgatgtggaccagcctcttcctgggcaatggagtgctgctgtgcttctacagccaggagtggtacgcccggcagcactgccccctgaagaaccccaccttcctggactatgtgcggcccaggtcctggacctgccgctacgtgttctag

SEQ ID NO: 171810 - DNA, 1479 bp, Artificial Sequence
  Description of Artificial Sequence: Synthetic coding sequence
atggagctgaagcccttcttcatgaaggaggtgggcagccactttgatgactttgtgaccaacctgattgagaagagcgccagcctggacaatggaggctgtgccctgaccaccttctctgtgctggagggggagaagaacaaccaccgggccaaggacctgcgggcccctcctgagcagggcaagatcttcatcgcccggcgcagcctgctggatgagctgctggaggtggaccacatccgcaccatctaccacatgttcatcgccctgctgatcctcttcatcctgagcaccctggtggtggactacattgatgagggccgcctggtgctggagttcagcctgctgtcctatgccttcggcaagttccccaccgtggtgtggacctggtggatcatgttcctgagcaccttctctgtgccctacttcctgttccagcactgggccaccggctacagcaagagcagccaccccctcatccgcagcctcttccacggcttcctgttcatgatcttccagatcggcgtgctgggcttcggccccacctacgtggtgctggcctacaccctgcccccagccagccgcttcatcatcatctttgagcagatccgctttgtgatgaaggcccacagctttgtgagagaaaatgtgccccgggtgctgaacagcgccaaggagaagagcagcacagtgcccatccccaccgtgaaccagtacctgtacttcctgtttgcccccaccctcatctacagagacagctaccccaggaaccccaccgtgcgctggggctacgtggccatgaagtttgcccaggtgtttggctgcttcttctacgtgtactacatctttgagcggctgtgtgcccccctcttcaggaacatcaagcaggagcccttcagcgcccgggtgctggtgctgtgtgtgttcaacagcatcctgcccggggtgctgatcctcttcctgaccttctttgccttcctgcactgctggctgaatgcctttgctgagatgctgcgctttggagacaggatgttctacaaggactggtggaacagcaccagctacagcaactactaccgcacctggaatgtggtggtgcatgactggctgtactactatgcctacaaggacttcctgtggttcttcagcaagcgcttcaagtctgctgccatgctggccgtgtttgctgtgtctgctgtggtgcatgaatatgccctggccgtgtgcctgtccttcttctaccctgtgctgtttgtgctcttcatgttcttcggcatggccttcaacttcatcgtgaatgacagcaggaagaagcccatctggaatgtgctgatgtggaccagcctcttcctgggcaatggagtgctgctgtgcttctacagccaggagtggtacgcccggcagcactgccccctgaagaaccccaccttcctggactatgtgcggcccaggtcctggacctgccgctacgtgttctag

SEQ ID NO: 171811 - DNA, 1569 bp, Artificial Sequence
  Description of Artificial Sequence: Synthetic coding sequence
atggagcctggaggagcccggctgcggctgcagaggacagagggcctgggcggggagcgggagcggcagccctgtggagatggcaacacagagacccaccgggccccagacctggtgcagtggaccaggcacatggaggccgtgaaggcccagctgctggagcaggcccagggccagctgcgggagctgctggaccgggccatgagggaggccatccagagctaccccagccaggacaagcccctgcccccacctcctcctggcagcctgagcaggacccaggagcccagcctgggcaagcagaaggtgttcatcatcaggaagagcctgctggatgagctgatggaggtgcagcacttccgcaccatctaccacatgttcatcgccggcctgtgtgtgttcatcatcagcaccctggccatcgacttcattgatgagggccgcctgctgctggagtttgacctgctgatcttctcctttggccagctgcccctggccctggtgacctgggtgcccatgttcctgagcaccctgctggccccctaccaggccctgcggctgtgggcccggggcacctggacccaggccaccggcctgggctgtgccctgctggccgcccatgctgtggtgctgtgtgccctgcctgtgcacgtggccgtggagcaccagctgcccccagccagccgctgtgtgctggtgtttgagcaggtgcgcttcctgatgaagagctacagcttcctgcgggaggccgtgcccggcaccctgcgggcccggcggggggagggcatccaggcccccagcttcagcagctacctgtacttcctgttctgccccaccctcatctaccgggagacctaccccaggaccccctacgtgcgctggaactacgtggccaagaactttgcccaggccctgggctgtgtgctgtatgcctgcttcatcctgggccgcctgtgtgtgcctgtgtttgccaacatgagccgggagcccttcagcacccgggccctggtgctgagcatcctgcacgccaccctgcccggcatcttcatgctgctgctgatcttctttgccttcctgcactgctggctgaatgcctttgctgagatgctgcgctttggagacaggatgttctacagagactggtggaacagcaccagcttcagcaactactaccgcacctggaatgtggtggtgcatgactggctgtacagctatgtgtaccaggacggcctgcggctgctgggcgcccgggcccggggcgtggccatgctgggcgtcttcctggtgtctgctgtggcccacgagtacatcttctgctttgtgctgggcttcttctaccctgtgatgctgatcctcttcctggtgattggaggcatgctgaacttcatgatgcatgaccagaggactggacctgcctggaatgtgctgatgtggaccatgctgttcctgggccagggcatccaggtgtccctgtactgccaggagtggtacgcccggcggcactgccccctgccccaggccaccttctggggcctggtgacccccaggtcctggagctgccacacctag

SEQ ID NO: 171812 - DNA, 3426 bp, Artificial Sequence
  Description of Artificial Sequence: Synthetic coding sequence
atggatgacagcggggagctgggcggcctggagaccatggagaccctgacagagctgggagatgagctgaccctgggggacattgatgagatgctgcagtttgtgagcaaccaggtgggggagttcccagacctcttcagcgagcagctgtgcagcagcttccctggcagcggcggcagcggcagcagcagcggcagcagcggcagcagcagcagcagcagcaatggccggggcagcagcagtggagctgtggaccccagcgtgcagaggagcttcacccaggtgaccctgcccagcttcagccccagcgctgccagcccccaggcccccaccctgcaggtgaaggtgagccccacctctgtgcccaccaccccccgggccacccccatcctgcagccccggccccagccccagccccagccccagacccagctgcagcagcagacagtgatgatcacccccaccttcagcaccaccccccagacccgcatcatccagcagcccctcatctaccagaatgctgccaccagcttccaggtgctgcagccccaggtgcagagcctggtgaccagcagccaggtgcagcctgtgaccatccagcagcaggtgcagacagtgcaggcccagagggtgctgacccagacagccaacggcaccctgcagaccctggccccagccaccgtgcagacagtggccgccccccaggtgcagcaggtgcctgtgctggtgcagccccagatcatcaagacagacagcctggtgctgaccaccctgaagacagatggcagccctgtgatggctgctgtgcagaacccagccctgacagccctgaccacccccatccagacagctgccctgcaggtgcccaccctggtgggcagcagcggcaccatcctgaccaccatgcctgtgatgatgggccaggagaaggtgcccatcaagcaggtgcctggaggagtgaagcagctggagccccccaaggagggggagaggaggaccacccacaacatcatcgagaagcgctaccgcagcagcatcaatgacaagatcatcgagctgaaggacctggtgatgggcacagatgccaagatgcacaagtctggagtgctgaggaaggccatcgactacatcaagtacctgcagcaggtgaaccacaagctgcggcaggagaacatggtgctgaagctggccaaccagaagaacaagctgctgaagggcatcgacctgggcagcctggtggacaatgaggtggacctgaagattgaggacttcaaccagaatgtgctgctgatgagccccccagccagtgacagcggcagccaggccggcttcagcccctacagcattgattctgagcccggcagccccctgctggatgatgccaaggtgaaggatgagccagacagcccccctgtggccctgggcatggtggacaggagccgcatcctgctgtgtgtgctgaccttcctgtgcctgtccttcaaccccctgaccagcctgctgcagtggggcggggcccatgacagcgaccagcacccccacagcggcagcggccgctctgtgctgagctttgagagcggcagcggcggctggtttgactggatgatgcccaccctgctgctgtggctggtgaatggagtcatcgtgctgtctgtgtttgtgaagctgctggtgcatggagagcccgtcatccggccccacagccgcagctctgtgaccttctggaggcacaggaagcaggccgacctggacctggcccggggggactttgctgctgctgctggcaacctgcagacctgcctggccgtgctgggccgggccctgcccaccagccggctggacctggcctgcagcctgtcctggaatgtcatccgctacagcctgcagaagctgcggctggtgcgctggctgctgaagaaggtgttccagtgcagaagagccaccccagccacagaagctggctttgaagatgaggccaagaccagcgccagagatgctgccctggcctaccaccggctgcaccagctgcacatcaccgggaagctgcctgctggcagcgcctgcagtgatgtgcacatggccctgtgtgctgtgaacctggccgagtgtgccgaggagaagatcccccccagcaccctggtggagatccacctgacagctgccatgggcctgaagacccgctgtggcggcaagctgggcttcctggccagctacttcctgagccgggcccagagcctgtgtggccctgagcacagcgctgtgcctgacagcctgcgctggctgtgccaccccctgggccagaagttcttcatggagaggtcctggagcgtgaagtctgctgccaaggagagcctgtactgtgcccagaggaacccagctgaccccatcgcccaggtgcaccaggccttctgcaagaacctgctggagcgggccatcgagagcctggtgaagccccaggccaagaagaaggccggggaccaggaggaggagagctgtgagttcagcagcgccctggagtacctgaagctgctgcacagctttgtggacagcgtgggcgtgatgagcccccccctgagccgcagctctgtgctgaagagcgccctgggccctgacatcatctgccgctggtggaccagcgccatcaccgtggccatctcctggctgcagggagatgatgctgctgtgcgcagccacttcaccaaggtggagcgcatccccaaggccctggaggtgacagagagccccctggtgaaggccatcttccacgcctgccgggccatgcacgccagcctgcccgggaaggcagatggccagcagagcagcttctgccactgtgagcgggccagcggccacctgtggagcagcctgaatgtgtctggggccaccagtgaccctgccctgaaccacgtggtgcagctgctgacctgtgacctgctgctgagcctgaggacagccctgtggcagaagcaggccagcgccagccaggccgtgggggagacctaccacgccagcggggctgagctggccggcttccagagggacctgggcagcctgcggcggctggcccacagcttccggcctgcctacaggaaggtgttcctgcacgaggccaccgtgcggctgatggccggggccagccccaccaggacccaccagctgctggagcacagcctgcggcggaggaccacccagagcaccaagcacggggaggtggatgcctggccaggccagcgggagcgggccacagccatcctgctggcctgccgccacctgcccctgtccttcctgagcagccctggccagagagctgtgctgctggccgaggccgcccggaccctggagaaggtgggggacagaagaagctgcaatgactgccagcagatgattgtgaagctgggcggcggcacagccatcgccgccagctag

SEQ ID NO: 171813 - DNA, 2055 bp, Artificial Sequence
  Description of Artificial Sequence: Synthetic coding sequence
atggatgacagcggggagctgggcggcctggagaccatggagaccctgacagagctgggagatgagctgaccctgggggacattgatgagatgctgcagtttgtgagcaaccaggtgggggagttcccagacctcttcagcgagcagctgtgcagcagcttccctggcagcggcggcagcggcagcagcagcggcagcagcggcagcagcagcagcagcagcaatggccggggcagcagcagtggagctgtggaccccagcgtgcagaggagcttcacccaggtgaccctgcccagcttcagccccagcgctgccagcccccaggcccccaccctgcaggtgaaggtgagccccacctctgtgcccaccaccccccgggccacccccatcctgcagccccggccccagccccagccccagccccagacccagctgcagcagcagacagtgatgatcacccccaccttcagcaccaccccccagacccgcatcatccagcagcccctcatctaccagaatgctgccaccagcttccaggtgctgcagccccaggtgcagagcctggtgaccagcagccaggtgcagcctgtgaccatccagcagcaggtgcagacagtgcaggcccagagggtgctgacccagacagccaacggcaccctgcagaccctggccccagccaccgtgcagacagtggccgccccccaggtgcagcaggtgcctgtgctggtgcagccccagatcatcaagacagacagcctggtgctgaccaccctgaagacagatggcagccctgtgatggctgctgtgcagaacccagccctgacagccctgaccacccccatccagacagctgccctgcaggtgcccaccctggtgggcagcagcggcaccatcctgaccaccatgcctgtgatgatgggccaggagaaggtgcccatcaagcaggtgcctggaggagtgaagcagctggagccccccaaggagggggagaggaggaccacccacaacatcatcgagaagcgctaccgcagcagcatcaatgacaagatcatcgagctgaaggacctggtgatgggcacagatgccaagatgcacaagtctggagtgctgaggaaggccatcgactacatcaagtacctgcagcaggtgaaccacaagctgcggcaggagaacatggtgctgaagctggccaaccagaagaacaagctgctgaagggcatcgacctgggcagcctggtggacaatgaggtggacctgaagattgaggacttcaaccagaatgtgctgctgatgagccccccagccagtgacagcggcagccaggccggcttcagcccctacagcattgattctgagcccggcagccccctgctggatgatgccaaggtgaaggatgagccagacagcccccctgtggccctgggcatggtggacaggagccgcatcctgctgtgtgtgctgaccttcctgtgcctgtccttcaaccccctgaccagcctgctgcagtggggcggggcccatgacagcgaccagcacccccacagcggcagcggccgctctgtgctgagctttgagagcggcagcggcggctggtttgactggatgatgcccaccctgctgctgtggctggtgaatggagtcatcgtgctgtctgtgtttgtgaagctgctggtgcatggagagcccgtcatccggccccacagccgcagctctgtgaccttctggaggcacaggaagcaggccgacctggacctggcccggggcgtgtatggcaagaagagcggggccacccacagcattgaggaggagctgaacatccacatcagccggggcaccaggaccaggaccctgctgagcagccgccgcttctgcagctgctgccggcagcccaccaacctgcccggcagctttggacctggaacagcccacctgcccccaggccctggcctgcagcccctgctggagcgggaccccctgcagcctgctgaggccacccctggggccctggccgcccaggagagcctgcctgtgcctgctggccacgccagccactag

SEQ ID NO: 171814 - DNA, 3309 bp, Artificial Sequence
  Description of Artificial Sequence: Synthetic coding sequence
atggatgacagcggggagctgggcggcctggagaccatggagaccctgacagagctgggagatgagctgaccctgggggacattgatgagatgctgcagtttgtgagcaaccaggtgggggagttcccagacctcttcagcgagcagctgtgcagcagcttccctggcagcggcggcagcggcagcagcagcggcagcagcggcagcagcagcagcagcagcaatggccggggcagcagcagtggagctgtggaccccagcgtgcagaggagcttcacccaggtgaccctgcccagcttcagccccagcgctgccagcccccaggcccccaccctgcaggtgaaggtgagccccacctctgtgcccaccaccccccgggccacccccatcctgcagccccggccccagccccagccccagccccagacccagctgcagcagcagacagtgatgatcacccccaccttcagcaccaccccccagacccgcatcatccagcagcccctcatctaccagaatgctgccaccagcttccaggtgctgcagccccaggtgcagagcctggtgaccagcagccaggtgcagcctgtgaccatccagcagcaggtgcagacagtgcaggcccagagggtgctgacccagacagccaacggcaccctgcagaccctggccccagccaccgtgcagacagtggccgccccccaggtgcagcaggtgcctgtgctggtgcagccccagatcatcaagacagacagcctggtgctgaccaccctgaagacagatggcagccctgtgatggctgctgtgcagaacccagccctgacagccctgaccacccccatccagacagctgccctgcaggtgcccaccctggtgggcagcagcggcaccatcctgaccaccatgcctgtgatgatgggccaggagaaggtgcccatcaagcaggtgcctggaggagtgaagcagctggagccccccaaggagggggagaggaggaccacccacaacatcatcgagaagcgctaccgcagcagcatcaatgacaagatcatcgagctgaaggacctggtgatgggcacagatgccaagatgcacaagtctggagtgctgaggaaggccatcgactacatcaagtacctgcagcaggtgaaccacaagctgcggcaggagaacatggtgctgaagctggccaaccagaagaacaagctgctgaagggcatcgacctgggcagcctggtggacaatgaggtggacctgaagattgaggacttcaaccagaatgtgctgctgatgagccccccagccagtgacagcggcagccaggccggcttcagcccctacagcattgattctgagcccggcagccccctgctggatgatgccaaggtgaaggatgagccagacagcccccctgtggccctgggcatggtggacaggagccgcatcctgctgtgtgtgctgaccttcctgtgcctgtccttcaaccccctgaccagcctgctgcagtggggcggggcccatgacagcgaccagcacccccacagcggcagcggccgctctgtgctgagctttgagagcggcagcggcggctggtttgactggatgatgcccaccctgctgctgtggctggtgaatggagtcatcgtgctgtctgtgtttgtgaagctgctggtgcatggagagcccgtcatccggccccacagccgcagctctgtgaccttctggaggcacaggaagcaggccgacctggacctggcccggggggactttgctgctgctgctggcaacctgcagacctgcctggccgtgctgggccgggccctgcccaccagccggctggacctggcctgcagcctgtcctggaatgtcatccgctacagcctgcagaagctgcggctggtgcgctggctgctgaagaaggtgttccagtgcagaagagccaccccagccacagaagctggctttgaagatgaggccaagaccagcgccagagatgctgccctggcctaccaccggctgcaccagctgcacatcaccgggaagctgcctgctggcagcgcctgcagtgatgtgcacatggccctgtgtgctgtgaacctggccgagtgtgccgaggagaagatcccccccagcaccctggtggagatccacctgacagctgccatgggcctgaagacccgctgtggcggcaagctgggcttcctggccagctacttcctgagccgggcccagagcctgtgtggccctgagcacagcgctgtgcctgacagcctgcgctggctgtgccaccccctgggccagaagttcttcatggagaggtcctggagcgtgaagtctgctgccaaggagagcctgtactgtgcccagaggaacccagctgaccccatcgcccaggtgcaccaggccttctgcaagaacctgctggagcgggccatcgagagcctggtgaagccccaggccaagaagaaggccggggaccaggaggaggagagctgtgagttcagcagcgccctggagtacctgaagctgctgcacagctttgtggacagcgtgggcgtgatgagcccccccctgagccgcagctctgtgctgaagagcgccctgggccctgacatcatctgccgctggtggaccagcgccatcaccgtggccatctcctggctgcagggagatgatgctgctgtgcgcagccacttcaccaaggtggagcgcatccccaaggccctggaggtgacagagagccccctggtgaaggccatcttccacgcctgccgggccatgcacgccagcctgcccgggaaggcagatggccagcagagcagcttctgccactgtgagcgggccagcggccacctgtggagcagcctgaatgtgtctggggccaccagtgaccctgccctgaaccacgtggtgcagctgctgacctgtgacctgctgctgagcctgaggacagccctgtggcagaagcaggccagcgccagccaggccgtgggggagacctaccacgccagcggggctgagctggccggcttccagagggacctgggcagcctgcggcggctggcccacagcttccggcctgcctacaggaaggtgttcctgcacgaggccaccgtgcggctgatggccggggccagccccaccaggacccaccagctgctggagcacagcctgcggcggaggaccacccagagcaccaagcacggggaggtggatgcctggccaggccagcgggagcgggccacagccatcctgctggcctgccgccacctgcccctgtccttcctgccctgcctgcagcccagctag

SEQ ID NO: 171815 - DNA, 648 bp, Artificial Sequence
  Description of Artificial Sequence: Synthetic coding sequence
atgcacgccagcctgcccgggaaggcagatggccagcagagcagcttctgccactgtgagcgggccagcggccacctgtggagcagcctgaatgtgtctggggccaccagtgaccctgccctgaaccacgtggtgcagctgctgacctgtgacctgctgctgagcctgaggacagccctgtggcagaagcaggccagcgccagccaggccgtgggggagacctaccacgccagcggggctgagctggccggcttccagagggacctgggcagcctgcggcggctggcccacagcttccggcctgcctacaggaaggtgttcctgcacgaggccaccgtgcggctgatggccggggccagccccaccaggacccaccagctgctggagcacagcctgcggcggaggaccacccagagcaccaagcacggggaggtggatgcctggccaggccagcgggagcgggccacagccatcctgctggcctgccgccacctgcccctgtccttcctgagcagccctggccagagagctgtgctgctggccgaggccgcccggaccctggagaaggtgggggacagaagaagctgcaatgactgccagcagatgattgtgaagctgggcggcggcacagccatcgccgccagctag

SEQ ID NO: 171816 - DNA, 900 bp, Artificial Sequence
  Description of Artificial Sequence: Synthetic coding sequence
atggacctggtgctgcgggtggccgactactacttcttcaccccctacgtgtacccagccacctggccagaagatgacatcttccggcaggccatcagcctgctgattgtgaccaacgtgggcgcctacatcctgtacttcttctgtgccaccctgagctactactttgtgtttgaccacgccctgatgaagcacccccagttcctgaagaaccaggtgcggcgggagatcaagttcaccgtgcaggccctgccctggatcagcatcctgactgtggccctcttcctgctggagatccggggctacagcaagctgcatgatgacctgggggagttcccctacggcctgtttgagctggtggtgtccatcatctccttcctgttcttcacagacatgttcatctactggatccaccggggcctgcaccaccggctggtgtacaagaggctgcacaagccccaccacatctggaagatccccaccccatttgccagccacgccttccaccccattgatggcttcctgcagagcctgccctaccacatctaccccttcatcttccccctgcacaaggtggtgtacctgagcctgtacatcctggtgaacatctggaccatcagcatccatgatggagacttccgggtgccccagatcctgcagcccttcatcaatggcagcgcccaccacacagaccaccacatgttctttgactacaactacggccagtacttcaccctgtgggaccgcatcggcggcagcttcaagaaccccagcagctttgagggcaagggccccctgtcctatgtgaaggagatgacagagggcaagaggagcagccacagcggaaatggctgcaagaatgagaagctgttcaacggggagttcaccaagacagaatag

SEQ ID NO: 171817 - DNA, 900 bp, Artificial Sequence; identical to SEQ ID NO: 171816
  Description of Artificial Sequence: Synthetic coding sequence

SEQ ID NO: 171818 - DNA, 192 bp, Artificial Sequence
  Description of Artificial Sequence: Synthetic coding sequence
atggagggcgctggggccggcagcggcttcaggaaggagctggtgtcccggctgctgcacctgcacttcaaggatgacaagaccaaggaggccgctgtgcggggcgtgcggcaggcccaggccgaggatgccctgcgggtggatgtggaccagctggagaaggtgctgccccagctgctgctggacttctag

SEQ ID NO: 171819 - DNA, 246 bp, Artificial Sequence
  Description of Artificial Sequence: Synthetic coding sequence
atggagggcgctggggccggcagcggcttcaggaaggagctggtgtcccggctgctgcacctgcacttcaaggatgacaagaccaaggtgtctggagatgccctgcagctgatggtggagctgctgaaggtgtttgtggtggaggccgctgtgcggggcgtgcggcaggcccaggccgaggatgccctgcgggtggatgtggaccagctggagaaggtgctgccccagctgctgctggacttctag

SEQ ID NO: 171820 - DNA, 2121 bp, Artificial Sequence
  Description of Artificial Sequence: Synthetic coding sequence
atgggcggcaagggcggcggggacacccggggccctgtgctcttcccctgccagctggcccaggccctgagcccccggcgggccttcccccgggagctgaaggagaagggccagaggatgagcagccagcctgctggcaaccagaccagccctggggccacagaggactacagctatggctcctggtacattgatgagccccagggcggggaggagctgcagcctgagggggaggtgcccagctgccacaccagcatccccccaggcctgtaccacgcctgcctggccagcctgagcatcctggtgctgctgctgctggccatgctggtgagaagacggcagctgtggccagactgtgtgcggggccggcccggcctgcccagccctgtggacttcctggccggggaccggcccagggctgtgcctgctgctgtgttcatggtgctgctgagcagcctgtgcctgctgctgcctgatgaagatgccctgcccttcctgaccctggccagcgcccccagccaggacggcaagacagaggcccccaggggggcctggaagatcctgggcctcttctactatgctgccctgtactaccccctggccgcctgtgccacagctggccacacagctgcccacctgctgggcagcaccctgtcctgggcccacctgggcgtgcaggtgtggcagagagctgagtgcccccaggtgcccaagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgaccggcacagccatctaccaggtggccctgctgctgctggtgggcgtggtgcccaccatccagaaggtgcgggccggcgtgaccacagatgtgtcctacctgctggccggctttggaattgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcacggcaggaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgccccccagggctgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaggaggatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaacggggcccagccctag

SEQ ID NO: 171821 - DNA, 2004 bp, Artificial Sequence
  Description of Artificial Sequence: Synthetic coding sequence
atgagcagccagcctgctggcaaccagaccagccctggggccacagaggactacagctatggctcctggtacattgatgagccccagggcggggaggagctgcagcctgagggggaggtgcccagctgccacaccagcatccccccaggcctgtaccacgcctgcctggccagcctgagcatcctggtgctgctgctgctggccatgctggtgagaagacggcagctgtggccagactgtgtgcggggccggcccggcctgcccagccctgtggacttcctggccggggaccggcccagggctgtgcctgctgctgtgttcatggtgctgctgagcagcctgtgcctgctgctgcctgatgaagatgccctgcccttcctgaccctggccagcgcccccagccaggacggcaagacagaggcccccaggggggcctggaagatcctgggcctcttctactatgctgccctgtactaccccctggccgcctgtgccacagctggccacacagctgcccacctgctgggcagcaccctgtcctgggcccacctgggcgtgcaggtgtggcagagagcagaatgtccccaggtgcccaagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgactggaacagccatctaccaggtggccctgctgctgctggtgggcgtggtgcccaccatccagaaggtgcgggccggcgtgaccacagatgtgtcctacctgctggccggcttcggcatcgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcatggaagaaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgcccccccgggccgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaagaagatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaatggagcccagccctag

SEQ ID NO: 171822 - DNA, 2004 bp, Artificial Sequence; identical to SEQ ID NO: 171821
  Description of Artificial Sequence: Synthetic coding sequence

SEQ ID NO: 171823 - DNA, 1800 bp, Artificial Sequence
  Description of Artificial Sequence: Synthetic coding sequence
atgctggtgagaagacggcagctgtggccagactgtgtgcggggccggcccggcctgcccagccctgtggacttcctggccggggaccggcccagggctgtgcctgctgctgtgttcatggtgctgctgagcagcctgtgcctgctgctgcctgatgaagatgccctgcccttcctgaccctggccagcgcccccagccaggacggcaagacagaggcccccaggggggcctggaagatcctgggcctcttctactatgctgccctgtactaccccctggccgcctgtgccacagctggccacacagctgcccacctgctgggcagcaccctgtcctgggcccacctgggcgtgcaggtgtggcagagagcagaatgtccccaggtgcccaagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgactggaacagccatctaccaggtggccctgctgctgctggtgggcgtggtgcccaccatccagaaggtgcgggccggcgtgaccacagatgtgtcctacctgctggccggcttcggcatcgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcatggaagaaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgcccccccgggccgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaagaagatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaatggagcccagccctag

SEQ ID NO: 171824 - DNA, 1977 bp, Artificial Sequence
  Description of Artificial Sequence: Synthetic coding sequence
atgagcagccagcctgctggcaaccagaccagccctggggccacagaggactacagctatggctcctggtacattgatgagccccagggcggggaggagctgcagcctgagggggaggtgcccagctgccacaccagcatccccccaggcctgtaccacgcctgcctggccagcctgagcatcctggtgctgctgctgctggccatgctggtgagaagacggcagctgtggccagactgtgtgcggggccggcccggcctgccccggcccagggctgtgcctgctgctgtgttcatggtgctgctgagcagcctgtgcctgctgctgcctgatgaagatgccctgcccttcctgaccctggccagcgcccccagccaggacggcaagacagaggcccccaggggggcctggaagatcctgggcctcttctactatgctgccctgtactaccccctggccgcctgtgccacagctggccacacagctgcccacctgctgggcagcaccctgtcctgggcccacctgggcgtgcaggtgtggcagagagctgagtgcccccaggtgcccaagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgaccggcacagccatctaccaggtggccctgctgctgctggtgggcgtggtgcccaccatccagaaggtgcgggccggcgtgaccacagatgtgtcctacctgctggccggctttggaattgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcacggcaggaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgccccccagggctgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaggaggatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaacggggcccagccctag

SEQ ID NO: 171825 - DNA, 480 bp, Artificial Sequence
  Description of Artificial Sequence: Synthetic coding sequence
atgagcagccagcctgctggcaaccagaccagccctggggccacagaggactacagctatggctcctggtacattgatgagccccagggcggggaggagctgcagcctgagggggaggtgcccagctgccacaccagcatccccccaggcctgtaccacgcctgcctggccagcctgagcatcctggtgctgctgctgctggccatgctggtgagaagacggcagctgtggccagactgtgtgcggggccggcccggcctgcccagccctgtggacttcctggccggggaccggcccagggctgtgcctgctgctgtgttcatggtgctgctgagcagcctgtgcctgctgctgcctgatgaagatgccctgcccttcctgaccctggccagcgcccccagccaggacggcaagacagaggccccccggggcaacctgcccaagatcacagagctgcggctggtgcgggcctggatctag

SEQ ID NO: 171826 - DNA, 2121 bp, Artificial Sequence; identical to SEQ ID NO: 171820
  Description of Artificial Sequence: Synthetic coding sequence

SEQ ID NO: 171827 - DNA, 2115 bp, Artificial Sequence
  Description of Artificial Sequence: Synthetic coding sequence
atgcagatccggctgctgcgggcagagctggtggtgcccctgtggcagttcatccggcagtggcccccaggcagtgatggctggggccagatggaggagaagggccagaggatgagcagccagcctgctggcaaccagaccagccctggggccacagaggactacagctatggctcctggtacattgatgagccccagggcggggaggagctgcagcctgagggggaggtgcccagctgccacaccagcatccccccaggcctgtaccacgcctgcctggccagcctgagcatcctggtgctgctgctgctggccatgctggtgagaagacggcagctgtggccagactgtgtgcggggccggcccggcctgcccagccctgtggacttcctggccggggaccggcccagggctgtgcctgctgctgtgttcatggtgctgctgagcagcctgtgcctgctgctgcctgatgaagatgccctgcccttcctgaccctggccagcgcccccagccaggacggcaagacagaggcccccaggggggcctggaagatcctgggcctcttctactatgctgccctgtactaccccctggccgcctgtgccacagctggccacacagctgcccacctgctgggcagcaccctgtcctgggcccacctgggcgtgcaggtgtggcagagagctgagtgcccccaggtgcccaagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgaccggcacagccatctaccaggtggccctgctgctgctggtgggcgtggtgcccaccatccagaaggtgcgggccggcgtgaccacagatgtgtcctacctgctggccggctttggaattgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcacggcaggaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgccccccagggctgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaggaggatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaacggggcccagccctag

SEQ ID NO: 171828 - DNA, 1674 bp, Artificial Sequence
  Description of Artificial Sequence: Synthetic coding sequence
atggctgctggcacctccatgagcccagatgaagatgccctgcccttcctgaccctggccagcgcccccagccaggacggcaagacagaggcccccaggggggcctggaagatcctgggcctcttctactatgctgccctgtactaccccctggccgcctgtgccacagctggccacacagctgcccacctgctgggcagcaccctgtcctgggcccacctgggcgtgcaggtgtggcagagagcagaatgtccccaggtgcccaagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgactggaacagccatctaccaggtggccctgctgctgctggtgggcgtggtgcccaccatccagaaggtgcgggccggcgtgaccacagatgtgtcctacctgctggccggcttcggcatcgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcatggaagaaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgcccccccgggccgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaagaagatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaatggagcccagccctag

SEQ ID NO: 171829 - DNA, 1431 bp, Artificial Sequence
  Description of Artificial Sequence: Synthetic coding sequence
atgggcaagctgcggctgcaggagatctacaagtactacagcctgctggccagcctgcccctgctgctgggcctgggcttcctgagcctgtggtaccctgtgcagctggtgcgctccttcagcagaagaactggagctggcagcaagggcctgcagagcagctacagcgaggagtacctgaggaacctgctgtgcaggaagaagctgggcagcagctaccacaccagcaagcacggcttcctgtcctgggcccgggtgtgcctgcggcactgcatctacaccccccagcccggcttccacctgcccctgaagctggtgctgagcgccaccctgaccggcacagccatctaccaggtggccctgctgctgctggtgggcgtggtgcccaccatccagaaggtgcgggccggcgtgaccacagatgtgtcctacctgctggccggctttggaattgtgctgtctgaggacaagcaggaggtggtggagctggtgaagcaccacctgtgggccctggaggtgtgctacatcagcgccctggtgctgagctgcctgctgaccttcctggtgctgatgaggagcctggtgacccacaggaccaacctgcgggccctgcacagaggagctgccctggacctgagccccctgcacaggagcccccaccccagccggcaggccatcttctgctggatgtccttcagcgcctaccagacagccttcatctgcctgggcctgctggtgcagcagatcatcttcttcctgggcaccacagccctggccttcctggtgctgatgcctgtgctgcacggcaggaacctgctgctcttccgcagcctggagagctcctggcccttctggctgaccctggccctggccgtcatcctgcagaacatggccgcccactgggtgttcctggagacccatgatggccacccccagctgaccaacagaagagtgctgtatgctgccaccttcctgctcttccccctgaatgtgctggtgggcgccatggtggccacctggagggtgctgctgagcgccctgtacaatgccatccacctgggccagatggacctgagcctgctgccccccagggctgccaccctggaccccggctactacacctacagaaacttcctgaagattgaggtgtcccagagccacccagccatgacagccttctgcagcctgctgctgcaggcccagagcctgctgcccaggaccatggccgccccccaggacagcctgcggcctggagaggaggatgagggcatgcagctgctgcagaccaaggacagcatggccaagggggcccggcctggggccagccggggccgggcccgctggggcctggcctacaccctgctgcacaaccccaccctgcaggtgttcaggaagacagccctgctgggcgccaacggggcccagccctag

SEQ ID NO: 171830 - DNA, 993 bp, Artificial Sequence
  Description of Artificial Sequence: Synthetic coding sequence
atgggcaagattgatgtggacaagatcctcttcttcaaccaggagatccggctgtggcagctgatcatggccaccccagaggagaacagcaacccccatgaccgggccaccccccagctgcctgcccagctgcaggagctggagcaccgggtggcccggcggcggctgagccaggcccggcaccgggccaccctggccgccctcttcaacaacctgaggaagacagtgtacagccagagcgacctgattgccagcaagtggcaggtgctgaacaaggccaagagccacatccctgagctggagcagaccctggacaacctgctgaagctgaaggccagcttcaacctggaggatggccacgccagcagcctggaggaggtgaagaaggagtatgcctccatgtacagcggaaatgacagcttcccccagaatggcagcagcccctggtacctgaacttctacaagcagaccatggacctgctgaccggcagcggcatcatcaccccccaggaggccgccctgcccatcgtgtctgctgccatcagccacctgtggcagaacctgtctgaggagaggaaggccagcctgcggcaggcctgggcccagaagcaccggggccctgccaccctggccgaggcctgccgggagcccgcctgtgccgagggctctgtgaaggacagcggcgtggacagccagggcgccagctgcagcctggtgtccaccccagaggagatcctgtttgaagatgcctttgatgtggccagcttcctggacaagtctgaggtgcccagcaccagcagcagcagctctgtgctggccagctgcaaccctgagaaccctgaggagaagttccagctgtacatgcagatcatcaacttcttcaagggcctgagctgtgccaacacccaggtgaagcaggaggccagcttccctgtggatgaggagatgatcatgctgcagtgcacagagacctttgatgatgaggacctgtag

SEQ ID NO: 171831 - DNA, 882 bp, Artificial Sequence
  Description of Artificial Sequence: Synthetic coding sequence
atgggcttccctgctgctgccctgctgtgtgccctgtgctgcggcctgctggccccagctgcccgggccggctacagcgaggagcgctgctcctggaggggcagcggcctgacccaggagcccggctctgtgggccagctggccctggcctgtgccgagggcgctgtggagtggctgtacccagctggggccctgcggctgaccctgggcggccctgacccccgggcccggcccggcatcgcctgcctgcggcctgtgcggccctttgctggggcccaggtgtttgctgagagagctggaggagccctggagctgctgctggccgagggccctggccctgctgggggccgctgtgtgcgctggggcccccgggagcggcgggccctcttcctgcaggccaccccccaccaggacatcagcagaagagtggccgccttccgctttgagctgcgggaggatggccggcctgagctgcccccccaggcccacggcctgggcgtggatggagcctgccggccctgcagtgatgctgagctgctgctggccgcctgcaccagtgactttgtgattcatggcatcatccatggagtgacccatgatgtggagctgcaggagagcgtcatcaccgtggtggccgcccgggtgctgcggcagaccccacccctcttccaggccggccgcagcggggaccagggcctgaccagcatccgcacccccctgcgctgtggggtgcaccctggccctggcaccttcctgttcatgggctggagcagatttggagaggcccggctgggctgtgccccccgcttccaggagttccggcgggcctatgaagctgcccgggccgcccacctgcacccctgtgaggtggccctgcactag

SEQ ID NO: 171832 - DNA, 1197 bp, Artificial Sequence
  Description of Artificial Sequence: Synthetic coding sequence
atgctgggccgcagcggctaccgggccctgcccctgggggactttgaccgcttccagcagagcagctttggcttcctgggcagccagaagggctgcctgagccctgagcggggcggcgtgggcaccggggctgatgtgccccagagctggcccagctgcctgtgccacggcctcatctccttcctgggcttcctgctgctgctggtgaccttccccatcagcggctggtttgccctgaagatcgtgcccacctatgaaagaatgattgtgttccggctgggccgcatccgcaccccccagggccctggcatggtgctgctgctgcccttcatcgacagcttccagagggtggacctgcggacccgggccttcaacgtgcccccctgcaagctggccagcaaggatggagctgtgctgtctgtgggcgcagatgtgcagttccgcatctgggaccctgtgctgtctgtgatgacagtgaaggacctgaacacagccaccaggatgacagcccagaatgccatgaccaaggccctgctgaagaggcccctgcgggagatccagatggagaagctgaagatcagtgaccagctgctgctggagatcaatgatgtgacccgggcctggggcctggaggtggacagagtggagctggccgtggaggccgtgctgcagcccccccaggacagccctgctggccccaacctggacagcaccctgcagcagctggccctgcacttcctgggcggctccatgaacagcatggccggcggggcccccagccctggccctgctgacacagtggagatggtgtctgaggtggagcccccagccccccaggtgggcgcccggagcagccccaagcagcccctggccgagggcctgctgacagccctgcagcccttcctgtctgaggccctggtgtcccaggtgggcgcctgctaccagttcaacgtggtgctgcccagcggcacccagagcgcctacttcctggacctgaccaccggccggggccgggtgggccatggagtgcctgatggcatcccagatgtggtggtggagatggccgaggccgacctgcgggccctgctgtgccgggagctgcggcccctgggcgcctacatgagcggccgcctgaaggtgaagggggacctggccatggccatgaagctggaggccgtgctgcgggccctgaagtag

SEQ ID NO: 171833 - DNA, 1047 bp, Artificial Sequence
  Description of Artificial Sequence: Synthetic coding sequence
atgctgggccgcagcggctaccgggccctgcccctgggggactttgaccgcttccagcagagcagctttggcttcctgggcagccagaagggctgcctgagccctgagcggggcggcgtgggcaccggggctgatgtgccccagagctggcccagctgcctgtgccacggcctcatctccttcctgggcttcctgctgctgctggtgaccttccccatcagcggctggtttgccctgaagctggccagcaaggatggagctgtgctgtctgtgggcgcagatgtgcagttccgcatctgggaccctgtgctgtctgtgatgacagtgaaggacctgaacacagccaccaggatgacagcccagaatgccatgaccaaggccctgctgaagaggcccctgcgggagatccagatggagaagctgaagatcagtgaccagctgctgctggagatcaatgatgtgacccgggcctggggcctggaggtggacagagtggagctggccgtggaggccgtgctgcagcccccccaggacagccctgctggccccaacctggacagcaccctgcagcagctggccctgcacttcctgggcggctccatgaacagcatggccggcggggcccccagccctggccctgctgacacagtggagatggtgtctgaggtggagcccccagccccccaggtgggcgcccggagcagccccaagcagcccctggccgagggcctgctgacagccctgcagcccttcctgtctgaggccctggtgtcccaggtgggcgcctgctaccagttcaacgtggtgctgcccagcggcacccagagcgcctacttcctggacctgaccaccggccggggccgggtgggccatggagtgcctgatggcatcccagatgtggtggtggagatggccgaggccgacctgcgggccctgctgtgccgggagctgcggcccctgggcgcctacatgagcggccgcctgaaggtgaagggggacctggccatggccatgaagctggaggccgtgctgcgggccctgaagtag

SEQ ID NO: 171834 - DNA, 984 bp, Artificial Sequence
  Description of Artificial Sequence: Synthetic coding sequence
atgctgggccgcagcggctaccgggccctgcccctgggggactttgaccgcttccagcagagcagctttggcttcctgggcagccagaagggctgcctgagccctgagcggggcggcgtgggcaccggggctgatgtgccccagagctggcccagctgcctgtgccacggcctcatctccttcctgggcttcctgctgctgctggtgaccttccccatcagcggctggtttgccctgaagatcgtgcccacctatgaaagaatgattgtgttccggctgggccgcatccgcaccccccagggccctggcatggtgctgctgctgcccttcatcgacagcttccagagggtggacctgcggacccgggccttcaacgtgcccccctgcaagctggccagcaaggatggagctgtgctgtctgtgggcgcagatgtgcagttccgcatctgggaccctgtgctgtctgtgatgacagtgaaggacctgaacacagccaccaggatgacagcccagaatgccatgaccaaggccctgctgaagaggcccctgcgggagatccagatggagaagctgaagatcagtgaccagctgctgctggagatcaatgatgtgacccgggcctggggcctggaggtggacagagtggagctggccgtggaggccgtgctgcagcccccccaggacagccctgctggccccaacctggacagcaccctgcagcagctggccctgcacttcctgggcggctccatgaacagcatggccggcggggcccccagccctggccctggccggggccgggtgggccacggcgtgcctgatggcatcccagatgtggtggtggagatggccgaggccgacctgcgggccctgctgtgccgggagctgcggcccctgggcgcctacatgagcggccgcctgaaggtgaagggggacctggccatggccatgaagctggaggccgtgctgcgggccctgaagtag

SEQ ID NO: 171835 - DNA, 1068 bp, Artificial Sequence
  Description of Artificial Sequence: Synthetic coding sequence
atgccagatgtgccccagagctggcccagctgcctgtgccacggcctcatctccttcctgggcttcctgctgctgctggtgaccttccccatcagcggctggtttgccctgaagatcgtgcccacctatgaaagaatgattgtgttccggctgggccgcatccgcaccccccagggccctggcatggtgctgctgctgcccttcatcgacagcttccagagggtggacctgcggacccgggccttcaacgtgcccccctgcaagctggccagcaaggatggagctgtgctgtctgtgggcgcagatgtgcagttccgcatctgggaccctgtgctgtctgtgatgacagtgaaggacctgaacacagccaccaggatgacagcccagaatgccatgaccaaggccctgctgaagaggcccctgcgggagatccagatggagaagctgaagatcagtgaccagctgctgctggagatcaatgatgtgacccgggcctggggcctggaggtggacagagtggagctggccgtggaggccgtgctgcagcccccccaggacagccctgctggccccaacctggacagcaccctgcagcagctggccctgcacttcctgggcggctccatgaacagcatggccggcggggcccccagccctggccctgacacagtggagatggtgtctgaggtggagcccccagccccccaggtgggcgcccggagcagccccaagcagcccctggccgagggcctgctgacagccctgcagcccttcctgtctgaggccctggtgtcccaggtgggcgcctgctaccagttcaacgtggtgctgcccagcggcacccagagcgcctacttcctggacctgaccaccggccggggccgggtgggccacggcgtgcctgatggcatcccagatgtggtggtggagatggccgaggccgacctgcgggccctgctgtgccgggagctgcggcccctgggcgcctacatgagcggccgcctgaaggtgaagggggacctggccatggccatgaagctggaggccgtgctgcgggccctgaagtag

SEQ ID NO: 171836 - DNA, 933 bp, Artificial Sequence
  Description of Artificial Sequence: Synthetic coding sequence
atgattgtgttccggctgggccgcatccgcaccccccagggccctggcatggtgctgctgctgcccttcatcgacagcttccagagggtggacctgcggacccgggccttcaacgtgcccccctgcaagctggccagcaaggatggagctgtgctgtctgtgggcgcagatgtgcagttccgcatctgggaccctgtgctgtctgtgatgacagtgaaggacctgaacacagccaccaggatgacagcccagaatgccatgaccaaggccctgctgaagaggcccctgcgggagatccagatggagaagctgaagatcagtgaccagctgctgctggagatcaatgatgtgacccgggcctggggcctggaggtggacagagtggagctggccgtggaggccgtgctgcagcccccccaggacagccctgctggccccaacctggacagcaccctgcagcagctggccctgcacttcctgggcggctccatgaacagcatggccggcggggcccccagccctggccctgacacagtggagatggtgtctgaggtggagcccccagccccccaggtgggcgcccggagcagccccaagcagcccctggccgagggcctgctgacagccctgcagcccttcctgtctgaggccctggtgtcccaggtgggcgcctgctaccagttcaacgtggtgctgcccagcggcacccagagcgcctacttcctggacctgaccaccggccggggccgggtgggccatggagtgcctgatggcatcccagatgtggtggtggagatggccgaggccgacctgcgggccctgctgtgccgggagctgcggcccctgggcgcctacatgagcggccgcctgaaggtgaagggggacctggccatggccatgaagctggaggccgtgctgcgggccctgaagtag

SEQ ID NO: 171837 - DNA, 1044 bp, Artificial Sequence
  Description of Artificial Sequence: Synthetic coding sequence
atgctgggccgcagcggctaccgggccctgcccctgggggactttgaccgcttccagcagagcagctttggcttcctgggcagccagaagggctgcctgagccctgagcggggcggcgtgggcaccggggctgatgtgccccagagctggcccagctgcctgtgccacggcctcatctccttcctgggcttcctgctgctgctggtgaccttccccatcagcggctggtttgccctgaagctggccagcaaggatggagctgtgctgtctgtgggcgcagatgtgcagttccgcatctgggaccctgtgctgtctgtgatgacagtgaaggacctgaacacagccaccaggatgacagcccagaatgccatgaccaaggccctgctgaagaggcccctgcgggagatccagatggagaagctgaagatcagtgaccagctgctgctggagatcaatgatgtgacccgggcctggggcctggaggtggacagagtggagctggccgtggaggccgtgctgcagcccccccaggacagccctgctggccccaacctggacagcaccctgcagcagctggccctgcacttcctgggcggctccatgaacagcatggccggcggggcccccagccctggccctgacacagtggagatggtgtctgaggtggagcccccagccccccaggtgggcgcccggagcagccccaagcagcccctggccgagggcctgctgacagccctgcagcccttcctgtctgaggccctggtgtcccaggtgggcgcctgctaccagttcaacgtggtgctgcccagcggcacccagagcgcctacttcctggacctgaccaccggccggggccgggtgggccacggcgtgcctgatggcatcccagatgtggtggtggagatggccgaggccgacctgcgggccctgctgtgccgggagctgcggcccctgggcgcctacatgagcggccgcctgaaggtgaagggggacctggccatggccatgaagctggaggccgtgctgcgggccctgaagtag

SEQ ID NO: 171838 - DNA, 1071 bp, Artificial Sequence
  Description of Artificial Sequence: Synthetic coding sequence
atgctggcccgggccgcccggggcactggagccctgctgctgcggggcagcctgctggccagcggccgggccccccggcgggccagcagcggcctgcccaggaacacagtggtgctgtttgtgccccagcaggaggcctgggtggtggagaggatgggccgcttccaccgcatcctggagcccggcctgaacatcctgatccctgtgctggaccgcatccgctacgtgcagagcctgaaggagatcgtcatcaacgtgcctgagcagagcgctgtgaccctggacaacgtgaccctgcagattgatggagtgctgtacctgcgcatcatggacccctacaaggccagctatggagtggaggaccctgaatatgctgtgacccagctggcccagaccaccatgaggtctgagctgggcaagctgagcctggacaaggtgttccgggagcgggagagcctgaatgccagcatcgtggatgccatcaaccaggccgctgactgctggggcatccgctgcctgcgctatgagatcaaggacatccacgtgcccccccgggtgaaggagagcatgcagatgcaggtggaggccgagaggaggaagagggccaccgtgctggagagcgagggcacccgggagagcgccatcaacgtggccgagggcaagaagcaggcccagatcctggccagcgaggccgagaaggccgagcagatcaaccaggccgccggggaggccagcgctgtgctggccaaggccaaggccaaggccgaggccatccgcatcctggccgccgccctgacccagcacaatggagatgctgctgccagcctgactgtggccgagcagtatgtgtctgccttcagcaagctggccaaggacagcaacaccatcctgctgcccagcaaccctggagatgtgacctccatggtggcccaggccatgggcgtgtatggagccctgaccaaggcccctgtgcccggcaccccagacagcctgagcagcggcagcagcagagatgtgcagggcacagatgccagcctggatgaggagctggacagagtgaagatgtcctag

SEQ ID NO: 171839 - DNA, 936 bp, Artificial Sequence
  Description of Artificial Sequence: Synthetic coding sequence
atgctggcccgggccgcccggggcactggagccctgctgctgcggggcagcctgctggccagcggccgggccccccggcgggccagcagcggcctgcccaggaacacagtggtgctgtttgtgccccagcaggaggcctgggtggtggagaggatgggccgcttccaccgcatcctggagcccggcctgaacatcctgatccctgtgctggaccgcatccgctacgtgcagagcctgaaggagatcgtcatcaacgtgcctgagcagagcgctgtgaccctggacaacgtgaccctgcagattgatggagtgctgtacctgcgcatcatggacccctacaaggccagctatggagtggaggaccctgaatatgctgtgacccagctggcccagaccaccatgaggtctgagctgggcaagctgagcctggacaaggtgttccgggtggaggccgagaggaggaagagggccaccgtgctggagagcgagggcacccgggagagcgccatcaacgtggccgagggcaagaagcaggcccagatcctggccagcgaggccgagaaggccgagcagatcaaccaggccgccggggaggccagcgctgtgctggccaaggccaaggccaaggccgaggccatccgcatcctggccgccgccctgacccagcacaatggagatgctgctgccagcctgactgtggccgagcagtatgtgtctgccttcagcaagctggccaaggacagcaacaccatcctgctgcccagcaaccctggagatgtgacctccatggtggcccaggccatgggcgtgtatggagccctgaccaaggcccctgtgcccggcaccccagacagcctgagcagcggcagcagcagagatgtgcagggcacagatgccagcctggatgaggagctggacagagtgaagatgtcctag

SEQ ID NO: 171840 - DNA, 876 bp, Artificial Sequence
  Description of Artificial Sequence: Synthetic coding sequence
atggacagccgggtgagcagccctgagaagcaggacaaggagaactttgtgggcgtgaacaacaagaggctgggcgtgtgtggctggatcctcttcagcctgtccttcctgctggtgatcatcaccttccccatcagcatctggatgtgcctgaagatcatcaaggagtatgaaagagctgtggtgttccggctgggccgcatccaggccgacaaggccaagggccctggcctcatcctggtgctgccctgcattgatgtgtttgtgaaggtggacctgaggacagtgacctgcaacatccccccccaggagatcctgacccgggacagcgtgaccacccaggtggatggagtggtgtactaccgcatctacagcgctgtgtctgctgtggccaacgtgaatgatgtgcaccaggccaccttcctgctggcccagaccaccctgagaaatgtgctgggcacccagaccctgagccagatcctggccggccgggaggagatcgcccacagcatccagaccctgctggatgatgccacagagctgtggggcatccgggtggcccgggtggagatcaaggatgtgcgcatccctgtgcagctgcagaggtccatggctgctgaggccgaggccacccgggaggcccgggccaaggtgctggccgctgagggggagatgaatgccagcaagagcctgaagagcgcctccatggtgctggccgagagccccatcgccctgcagctgcgctacctgcagaccctgagcacagtggccacagagaagaacagcaccatcgtgttccccctgcccatgaacatcctggagggcatcggcggcgtgtcctatgacaaccacaagaagctgcccaacaaggcctag

SEQ ID NO: 171841 - DNA, 849 bp, Artificial Sequence
  Description of Artificial Sequence: Synthetic coding sequence
atgaacagcagaggagagctggtgggcgtgaacaacaagaggctgggcgtgtgtggctggatcctcttcagcctgtccttcctgctggtgatcatcaccttccccatcagcatctggatgtgcctgaagatcatcaaggagtatgaaagagctgtggtgttccggctgggccgcatccaggccgacaaggccaagggccctggcctcatcctggtgctgccctgcattgatgtgtttgtgaaggtggacctgaggacagtgacctgcaacatccccccccaggagatcctgacccgggacagcgtgaccacccaggtggatggagtggtgtactaccgcatctacagcgctgtgtctgctgtggccaacgtgaatgatgtgcaccaggccaccttcctgctggcccagaccaccctgagaaatgtgctgggcacccagaccctgagccagatcctggccggccgggaggagatcgcccacagcatccagaccctgctggatgatgccacagagctgtggggcatccgggtggcccgggtggagatcaaggatgtgcgcatccctgtgcagctgcagaggtccatggctgctgaggccgaggccacccgggaggcccgggccaaggtgctggccgctgagggggagatgaatgccagcaagagcctgaagagcgcctccatggtgctggccgagagccccatcgccctgcagctgcgctacctgcagaccctgagcacagtggccacagagaagaacagcaccatcgtgttccccctgcccatgaacatcctggagggcattggaggagtgtcctatgacaaccacaagaagctgcccaacaaggcctag

SEQ ID NO: 171842 - DNA, 2970 bp, Artificial Sequence
  Description of Artificial Sequence: Synthetic coding sequence
atggcccggcctgtgcagctggcccctggcagcctggccctggtgctgtgccgcctggaggcccagaaggctgctggagctgctgaggagcccggcggccgggctgtgttccgggccttcagaagagccaatgcccgctgcttctggaatgcccggctggcccgggccgccagccggctggccttccagggctggctgcggcggggcgtgctgctggtgcgggcccccccagcctgcctgcaggtgctgagagatgcctggaggagaagagccctgcggcccccccggggcttccgcatccgggctgtgggagatgtgtttcctgtgcagatgaaccccatcacccagagccagtttgtgcccctgggggaggtgctgtgctgtgccatcagtgacatgaacacagcccagatcgtggtgacccaggagagcctgctggagcggctgatgaagcactacccaggcatcgccatccccagcgaggacatcctgtacaccaccctgggcaccctcatcaaggagaggaagatctaccacactggagagggctacttcatcgtgaccccccagacctacttcatcaccaacaccaccacccaggagaacaagaggatgctgcccagtgatgagagccggctgatgcctgcctccatgacctacctggtgtccatggagagctgtgccgagagcgcccaggagaatgctgcccccatcagccactgccagagctgccagtgcttccgggacatgcacacccaggatgtgcaggaggcccctgtggccgctgaggtgaccaggaagagccaccggggcctgggggagagcgtgtcctgggtgcagaatggagctgtgtctgtgtctgctgagcaccacatctgtgagagcaccaagcccctgccctacacccgggacaaggagaagggcaagaagtttggcttcagcctgctgtggaggagcctgagcaggaaggagaagcccaagacagagcacagcagcttcagcgcccagttccccccagaggagtggcctgtgagagatgaagatgacctggacaacatccccagagatgtggagcacgagatcatcaagaggatcaaccccatcctgactgtggacaacctgatcaagcacacagtgctgatgcagaagtatgaggagcagaagaagtacaacagccagggcaccagcacagacatgctgaccatcggccacaagtaccccagcaaggagggcgtgaagaagaggcagggcctgagcgccaagccccagggccagggccacagcagaagagacagacacaaggccaggaaccagggcagcgagttccagcccggcagcatccggctggagaagcaccccaagctgcctgccacccagcccatcccccgcatcaagagccccaatgagatggtgggccagaagcccctgggggagatcaccaccgtgctgggcagccacctgatctacaagaagaggatcagcaaccccttccagggcctgagccaccggggcagcaccatcagcaagggccacaagatccagaagaccagtgacctgaagcccagccagacaggccccaaggagaagcccttccagaagcccaggagcctggacagcagccgcatctttgatggcaaggccaaggagccctatgcagagcagcccaatgacaagatggaggccgagagcatctacatcaatgaccccaccgtgaagcccatcaatgatgacttccggggccacctgttcagccacccccagcagagcatgctgcagaatgatggcaagtgctgccccttcatggagagcatgctgcgctatgaggtgtatggaggagaaaatgaggtgattcctgaggtgctgaggaagagccacagccactttgacaagctgggggagaccaagcagaccccccacagcctgcccagcagaggagccagcttcagtgacaggacccccagcgcctgccgcctggtggacaacaccatccaccagttccagaacctgggcctgctggactaccctgtgggcgtgaaccccctgcggcaggccgcccggcaggacaaggacagcgaggagctgctgaggaaaggatttgtgcaggatgctgagaccaccagcctggagaatgagcagctgagcaatgatgaccaggccctgtaccagaatgaggtggaggatgatgatggagcctgcagcagcctgtacctggaggaggatgacatcagtgaaaatgatgacctgcggcagatgctgcccggccacagccagtacagcttcaccggcggcagccagggcaaccacctgggcaagcagaaggtgattgaaagaagcctgacagagtacaacagcaccatggagcgggtggagagccaggtgctgaagagaaatgaatgctacaagcccaccggcctgcacgccaccccaggagagagccaggagcccaacctgtctgctgagagctgtggcctgaacagcggggcccagtttggcttcaactatgaggaggagcccagcgtggccaagtgtgtgcaggccagcgccccagcagatgagcgcatctttgactactacagcgccaggaaggccagctttgaagctgaggtgatccaggacaccatcggggacaccgggaagaagccagcctcctggagccagagcccccagaaccaggagatgaggaagcacttcccccagaagttccagctgttcaacaccagccacatgcctgtgctggcccaggatgtgcagtatgagcacagccacctggagggcacagagaaccacagcatggccggggacagcggcatcgacagccccaggacccagagcctgggcagcaacaacagcgtcatcctggatggcctgaagaggcggcagaacttcctgcagaatgtggagggcaccaagagcagccagcccctgaccagcaacagcctgctgcccctgacccctgtgatcaacgtgtag

SEQ ID NO: 171843 - DNA, 510 bp, Artificial Sequence
  Description of Artificial Sequence: Synthetic coding sequence
atggcccggcctgtgcagctggcccctggcagcctggccctggtgctgtgccgcctggaggcccagaaggctgctggagctgctgaggagcccggcggccgggctgtgttccgggccttcagaagagccaatgcccgctgcttctggaatgcccggctggcccgggccgccagccggctggccttccagggctggctgcggcggggcgtgctgctggtgcgggcccccccagcctgcctgcaggtgctgagagatgcctggaggagaagagccctgcggcccccccggggcttccgcatccgggctgtgggagatgtgtttcctgtgcagatgaaccccatcacccagagccagtttgtgcccctgggggaggtgctgtgctgtgccatcagtgacatgaacacagcccagatcgtggtgacccaggagagcctgctggagcggctgatgaagcactacccaggccaccgggtgtgggacctgatcatccagagcttctggatggactag

SEQ ID NO: 171844 - DNA, 684 bp, Artificial Sequence
  Description of Artificial Sequence: Synthetic coding sequence
atggcccggcctgtgcagctggcccctggcagcctggccctggtgctgtgccgcctggaggcccagaaggctgctggagctgctgaggagcccggcggccgggctgtgttccgggccttcagaagagccaatgcccgctgcttctggaatgcccggctggcccgggccgccagccggctggccttccagggctggctgcggcggggcgtgctgctggtgcgggcccccccagcctgcctgcaggtgctgagagatgcctggaggagaagagccctgcggcccccccggggcttccgcatccgggctgtgggagatgtgtttcctgtgcagatgaaccccatcacccagagccagtttgtgcccctgggggaggtgctgtgctgtgccatcagtgacatgaacacagcccagatcgtggtgacccaggagagcctgctggagcggctgatgaagcactacccaggcatcgccatccccagcgaggacatcctgtacaccaccctgggcaccctcatcaaggagaggaagatctaccacactggagagggctacttcatcgtgaccccccagacctacttcatcaccaacaccaccacccaggagaacaagaggatgctgcccagtgatgagagccggctgatgcctgcctccatgacctacctggacacagaaagtggcatctag

SEQ ID NO: 171845 - DNA, 2970 bp, Artificial Sequence; identical to SEQ ID NO: 171842
  Description of Artificial Sequence: Synthetic coding sequence

SEQ ID NO: 171846 - DNA, 2640 bp, Artificial Sequence
  Description of Artificial Sequence: Synthetic coding sequence
atgaaccccatcacccagagccagtttgtgcccctgggggaggtgctgtgctgtgccatcagtgacatgaacacagcccagatcgtggtgacccaggagagcctgctggagcggctgatgaagcactacccaggcatcgccatccccagcgaggacatcctgtacaccaccctgggcaccctcatcaaggagaggaagatctaccacactggagagggctacttcatcgtgaccccccagacctacttcatcaccaacaccaccacccaggagaacaagaggatgctgcccagtgatgagagccggctgatgcctgcctccatgacctacctggtgtccatggagagctgtgccgagagcgcccaggagaatgctgcccccatcagccactgccagagctgccagtgcttccgggacatgcacacccaggatgtgcaggaggcccctgtggccgctgaggtgaccaggaagagccaccggggcctgggggagagcgtgtcctgggtgcagaatggagctgtgtctgtgtctgctgagcaccacatctgtgagagcaccaagcccctgccctacacccgggacaaggagaagggcaagaagtttggcttcagcctgctgtggaggagcctgagcaggaaggagaagcccaagacagagcacagcagcttcagcgcccagttccccccagaggagtggcctgtgagagatgaagatgacctggacaacatccccagagatgtggagcacgagatcatcaagaggatcaaccccatcctgactgtggacaacctgatcaagcacacagtgctgatgcagaagtatgaggagcagaagaagtacaacagccagggcaccagcacagacatgctgaccatcggccacaagtaccccagcaaggagggcgtgaagaagaggcagggcctgagcgccaagccccagggccagggccacagcagaagagacagacacaaggccaggaaccagggcagcgagttccagcccggcagcatccggctggagaagcaccccaagctgcctgccacccagcccatcccccgcatcaagagccccaatgagatggtgggccagaagcccctgggggagatcaccaccgtgctgggcagccacctgatctacaagaagaggatcagcaaccccttccagggcctgagccaccggggcagcaccatcagcaagggccacaagatccagaagaccagtgacctgaagcccagccagacaggccccaaggagaagcccttccagaagcccaggagcctggacagcagccgcatctttgatggcaaggccaaggagccctatgcagagcagcccaatgacaagatggaggccgagagcatctacatcaatgaccccaccgtgaagcccatcaatgatgacttccggggccacctgttcagccacccccagcagagcatgctgcagaatgatggcaagtgctgccccttcatggagagcatgctgcgctatgaggtgtatggaggagaaaatgaggtgattcctgaggtgctgaggaagagccacagccactttgacaagctgggggagaccaagcagaccccccacagcctgcccagcagaggagccagcttcagtgacaggacccccagcgcctgccgcctggtggacaacaccatccaccagttccagaacctgggcctgctggactaccctgtgggcgtgaaccccctgcggcaggccgcccggcaggacaaggacagcgaggagctgctgaggaaaggatttgtgcaggatgctgagaccaccagcctggagaatgagcagctgagcaatgatgaccaggccctgtaccagaatgaggtggaggatgatgatggagcctgcagcagcctgtacctggaggaggatgacatcagtgaaaatgatgacctgcggcagatgctgcccggccacagccagtacagcttcaccggcggcagccagggcaaccacctgggcaagcagaaggtgattgaaagaagcctgacagagtacaacagcaccatggagcgggtggagagccaggtgctgaagagaaatgaatgctacaagcccaccggcctgcacgccaccccaggagagagccaggagcccaacctgtctgctgagagctgtggcctgaacagcggggcccagtttggcttcaactatgaggaggagcccagcgtggccaagtgtgtgcaggccagcgccccagcagatgagcgcatctttgactactacagcgccaggaaggccagctttgaagctgaggtgatccaggacaccatcggggacaccgggaagaagccagcctcctggagccagagcccccagaaccaggagatgaggaagcacttcccccagaagttccagctgttcaacaccagccacatgcctgtgctggcccaggatgtgcagtatgagcacagccacctggagggcacagagaaccacagcatggccggggacagcggcatcgacagccccaggacccagagcctgggcagcaacaacagcgtcatcctggatggcctgaagaggcggcagaacttcctgcagaatgtggagggcaccaagagcagccagcccctgaccagcaacagcctgctgcccctgacccctgtgatcaacgtgtag

SEQ ID NO: 171847 - DNA, 4179 bp, Artificial Sequence
  Description of Artificial Sequence: Synthetic coding sequence
atggtggagcccggccaggacctgctgctggccgccctgtctgagagcggcatcagccccaatgacctgtttgatattgatggaggagatgctggcctggccacccccatgcccaccccatctgtgcagcagagcgtgcccctgagcgccctggagctgggcctggagacagaagctgctgtgcctgtgaagcaggagcctgagaccgtgcccaccccagccctgctgaatgtgcggcagccccccagcaccaccacctttgtgctgaaccagatcaaccacctgccccccctgggcagcaccatcgtgatgaccaagaccccacctgtgaccaccaaccggcagaccatcaccctgaccaagttcatccagaccacagccagcacccggcccagcgtgtctgcccccaccgtgagaaatgccatgaccagcgcccccagcaaggaccaggtgcagctgaaggacctgctgaagaacaacagcctgaatgagctgatgaagctgaagcccccagccaacatcgcccagcctgtggccacagctgccacagatgtgtccaatggaacagtgaagaaggagagcagcaacaaggagggcgccaggatgtggatcaatgacatgaagatgaggagcttcagccccaccatgaaggtgcctgtggtgaaggaggatgatgagcctgaggaggaggatgaggaggagatgggccacgccgagacctacgccgagtacatgcccatcaagctgaagattggcctgcggcacccagatgctgtggtggagaccagcagcctgagctctgtgaccccaccagatgtgtggtacaagaccagcatcagcgaggagaccatcgacaatggctggctgagcgccctgcagctggaggccatcacctacgccgcccagcagcacgagaccttcctgcccaacggggaccgggccggcttcctgattggagatggagctggggtgggcaagggccgcaccatcgccggcatcatctatgagaactacctgctgagcaggaagagggccctgtggttctctgtgtccaatgacctgaagtatgatgctgagcgggacctgcgggacattggagccaagaacatcctggtgcacagcctgaacaagttcaagtatggcaagatcagcagcaagcacaacggctctgtgaagaagggcgtcatctttgccacctacagcagcctcatcggggagagccagagcggcggcaagtacaagacccggctgaagcagctgctgcactggtgtggagatgactttgatggagtcatcgtgtttgatgagtgccacaaggccaagaacctgtgccctgtgggcagcagcaagcccaccaagacaggcctggccgtgctggagctgcagaacaagctgcccaaggcccgggtggtgtatgccagcgccaccggggccagcgagcccaggaacatggcctacatgaaccggctgggcatctggggcgagggcacccccttccgggagttcagtgacttcatccaggccgtggagaggagaggagtgggcgccatggagatcgtggccatggacatgaagctgcggggcatgtacatcgcccggcagctgtccttcaccggggtgaccttcaagattgaggaggtgctgctgagccagagctatgtgaagatgtacaacaaggctgtgaagctgtgggtgattgcccgggagcgcttccagcaggccgctgacctgattgatgctgagcagaggatgaagaagtccatgtggggccagttctggagcgcccaccagcgcttcttcaagtacctgtgcatcgccagcaaggtgaagagggtggtgcagctggcccgggaggagatcaagaatggaaaatgtgtggtgattggcctgcagagcactggagaggcccggaccctggaggccctggaggagggcggcggggagctgaatgactttgtgtccacagccaagggcgtgctgcagagcctcatcgagaagcacttccctgccccagacaggaagaagctgtacagcctgctgggcatcgacctgacagcccccagcaacaacagcagcccccgggacagcccctgcaaggagaacaagatcaagaagaggaaaggagaggagatcacccgggaggccaagaaggccaggaaggtgggcggcctgaccggcagcagcagtgatgacagcggcagcgagagtgatgccagtgacaatgaggagagtgactatgagagcagcaagaacatgagcagtggagatgatgatgacttcaaccccttcctggatgagagcaatgaagatgatgaaaatgacccctggctgatcaggaaggaccacaagaagaacaaggagaagaagaagaagaagagcattgatcctgacagcatccagagcgccctgctggccagcggcctgggcagcaagaggcccagcttcagcagcacccctgtgatcagccctgcccccaacagcaccccagccaacagcaacaccaacagcaacagcagcctcatcaccagccaggatgctgtggagcgggcccagcagatgaagaaggacctgctggacaagctggagaagctggccgaggacctgccccccaacaccctggatgagctgattgatgagctgggcggcccagaaaatgtggccgagatgacaggcaggaagggccgggtggtgtccaatgatgatggcagcatctcctatgagagccgctctgagctggatgtgcctgtggagatcctgaacatcacagagaagcagcgcttcatggatggagacaagaacatcgccatcatcagcgaggccgccagcagcggcatcagcctgcaggccgacagaagagccaagaaccagaggcggcgggtgcacatgaccctggagctgccctggagcgctgaccgggccatccagcagtttggaagaacccacaggagcaaccaggtgacagccccagaatatgtgttcctgatcagcgagctggccggggagcagagatttgccagcatcgtggccaagaggctggagagcctgggcgccctgacccacggggacagaagagccacagagagccgggacctgagccgcttcaactttgacaacaagtatggaagaaatgccctggagatcgtgatgaagagcatcgtgaacctggacagccccatggtgagccccccaccagactacccaggagagttcttcaaggatgtgcggcagggcctgattggagtgggcctcatcaacgtggaggacaggagcggcatcctgaccctggacaaggactacaacaacatcggcaagttcctgaaccgcatcctgggcatggaggtgcaccagcagaatgccctcttccagtactttgctgacaccctgacagctgtggtgcagaatgccaagaagaatggccgctatgacatgggcatcctggacctgggcagcggagatgagaaggtgaggaagagtgatgtgaagaagttcctgaccccaggctacagcaccagcggccacgtggagctgtacaccatctctgtggagcggggcatgtcctgggaggaggccaccaagatctgggccgagctgaccggcccagatgatggcttctacctgagcctgcagatccggaacaacaagaagacagccatcctggtgaaggaggtgaaccccaagaagaagctgttcctggtgtaccggcccaacacaggcaagcagctgaagctggagatctatgctgacctgaagaagaagtacaagaaggtggtgtctgatgatgccctgatgcactggctggaccagtacaacagcagcgctgacacctgcacccacgcctactggaggggcaactgcaagaaggccagcctgggcctggtgtgtgagatcggcctgcgctgcaggacctactacgtgctgtgtggctctgtgctgtctgtgtggaccaaggtggagggcgtgctggcctctgtgtctggcaccaacgtgaagatgcagatcgtgcggctgaggacagaagatggccagagaattgtgggcctcatcatcccagccaactgtgtgagccccctggtgaacctgctgagcaccagtgaccagagccagcagctggccgtgcagcagaagcagctgtggcagcagcaccacccccagagcatcaccaacctgagcaatgcctag

SEQ ID NO: 171848 - DNA, 4182 bp, Artificial Sequence
  Description of Artificial Sequence: Synthetic coding sequence
atggtggagcccggccaggacctgctgctggccgccctgtctgagagcggcatcagccccaatgacctgtttgatattgatggaggagatgctggcctggccacccccatgcccaccccatctgtgcagcagagcgtgcccctgagcgccctggagctgggcctggagacagaagctgctgtgcctgtgaagcaggagcctgagaccgtgcccaccccagccctgctgaatgtgcggcagcagccccccagcaccaccacctttgtgctgaaccagatcaaccacctgccccccctgggcagcaccatcgtgatgaccaagaccccacctgtgaccaccaaccggcagaccatcaccctgaccaagttcatccagaccacagccagcacccggcccagcgtgtctgcccccaccgtgagaaatgccatgaccagcgcccccagcaaggaccaggtgcagctgaaggacctgctgaagaacaacagcctgaatgagctgatgaagctgaagcccccagccaacatcgcccagcctgtggccacagctgccacagatgtgtccaatggcaccgtgaagaaggagagcagcaacaaggagggcgccaggatgtggatcaatgacatgaagatgaggagcttcagccccaccatgaaggtgcctgtggtgaaggaggatgatgagcctgaggaggaggatgaggaggagatgggccatgctgagacctatgcagagtacatgcccatcaagctgaagattggcctgcggcacccagatgctgtggtggagaccagcagcctgagctctgtgaccccaccagatgtgtggtacaagaccagcatcagcgaggagaccatcgacaatggctggctgagcgccctgcagctggaggccatcacctatgctgcccagcagcacgagaccttcctgcccaatggagacagagctggcttcctgattggagatggagctggggtgggcaaaggaagaaccatcgccggcatcatctatgagaactacctgctgagcaggaagagggccctgtggttctctgtgtccaatgacctgaagtatgatgctgagcgggacctgcgggacatcggggccaagaacatcctggtgcacagcctgaacaagttcaagtatggcaagatcagcagcaagcacaatggatctgtgaagaagggcgtcatctttgccacctacagcagcctgattggagagagccagagcggcggcaagtacaagacccggctgaagcagctgctgcactggtgtggagatgactttgatggagtgattgtgtttgatgagtgccacaaggccaagaacctgtgccctgtgggcagcagcaagcccaccaagacaggcctggccgtgctggagctgcagaacaagctgcccaaggcccgggtggtgtatgccagcgccactggagccagcgagcccaggaacatggcctacatgaaccggctgggcatctggggcgagggcacccccttccgggagttcagtgacttcatccaggccgtggagcggcggggcgtgggcgccatggagatcgtggccatggacatgaagctgcggggcatgtacatcgcccggcagctgtccttcaccggggtgaccttcaagattgaggaggtgctgctgagccagagctatgtgaagatgtacaacaaggctgtgaagctgtgggtgattgcccgggagcgcttccagcaggccgctgacctgattgatgctgagcagaggatgaagaagtccatgtggggccagttctggagcgcccaccagcgcttcttcaagtacctgtgcatcgccagcaaggtgaagagggtggtgcagctggcccgggaggagatcaagaatggaaaatgtgtggtgattggcctgcagagcactggagaggcccggaccctggaggccctggaggagggcggcggggagctgaatgactttgtgtccacagccaagggcgtgctgcagagcctgattgagaagcacttccctgccccagacaggaagaagctgtacagcctgctgggcatcgacctgacagcccccagcaacaacagcagcccccgggacagcccctgcaaggagaacaagatcaagaagaggaagggggaggagatcacccgggaggccaagaaggccaggaaggtgggcggcctgaccggcagcagcagtgatgattctggcagcgagagtgatgccagtgacaatgaggagagtgactatgagagcagcaagaacatgagcagtggagatgatgatgacttcaaccccttcctggatgagagcaatgaagatgatgaaaatgacccctggctgatcaggaaggaccacaagaagaacaaggagaagaagaagaagaagagcattgatcctgacagcatccagagcgccctgctggccagcggcctgggcagcaagaggcccagcttcagcagcacccctgtgatcagccctgcccccaacagcaccccagccaacagcaacaccaacagcaacagcagcctcatcaccagccaggatgctgtggagcgggcccagcagatgaagaaggacctgctggacaagctggagaagctggccgaggacctgccccccaacaccctggatgagctgattgatgagctgggcggcccagaaaatgtggccgagatgactggaaggaagggccgggtggtgtccaatgatgatggcagcatctcctatgagagccgctctgagctggatgtgcctgtggagatcctgaacatcacagagaagcagcgcttcatggatggagacaagaacatcgccatcatcagcgaggccgccagcagcggcatcagcctgcaggccgaccggcgggccaagaaccagaggagaagagtgcacatgaccctggagctgccctggagcgctgaccgggccatccagcagtttggccgcacccacaggagcaaccaggtgacagccccagaatatgtgttcctgatcagcgagctggccggggagcagagatttgccagcatcgtggccaagaggctggagagcctgggcgccctgacccatggagaccggcgggccacagagagccgggacctgagccgcttcaactttgacaacaagtatggaagaaatgccctggagatcgtgatgaagagcatcgtgaacctggacagccccatggtgtccccacctccagactacccaggagagttcttcaaggatgtgcggcagggcctcatcggcgtgggcctcatcaacgtggaggacagaagtggcatcctgaccctggacaaggactacaacaacatcggcaagttcctgaaccgcatcctgggcatggaggtgcaccagcagaatgccctcttccagtactttgctgacaccctgacagctgtggtgcagaatgccaagaagaatggccgctatgacatgggcatcctggacctgggcagcggagatgagaaggtgaggaagagtgatgtgaagaagttcctgaccccaggctacagcaccagcggccacgtggagctgtacaccatctctgtggagcggggcatgtcctgggaggaggccaccaagatctgggccgagctgactggaccagatgatggcttctacctgagcctgcagatccggaacaacaagaagacagccatcctggtgaaggaggtgaaccccaagaagaagctgttcctggtgtaccggcccaacacaggcaagcagctgaagctggagatctatgctgacctgaagaagaagtacaagaaggtggtgtctgatgatgccctgatgcactggctggaccagtacaacagcagcgctgacacctgcacccacgcctactggaggggcaactgcaagaaggccagcctgggcctggtgtgtgaaattggcctgcgctgcaggacctactacgtgctgtgtggctctgtgctgtctgtgtggaccaaggtggagggcgtgctggcctctgtgtctggcaccaacgtgaagatgcagatcgtgcggctgaggacagaagatggccagagaattgtgggcctcatcatcccagccaactgtgtgagccccctggtgaacctgctgagcaccagtgaccagagccagcagctggccgtgcagcagaagcagctgtggcagcagcaccacccccagagcatcaccaacctgagcaatgcctag

SEQ ID NO: 171849 - DNA, 2199 bp, Artificial Sequence
  Description of Artificial Sequence: Synthetic coding sequence
atggtggagcccggccaggacctgctgctggccgccctgtctgagagcggcatcagccccaatgacctgtttgatattgatggaggagatgctggcctggccacccccatgcccaccccatctgtgcagcagagcgtgcccctgagcgccctggagctgggcctggagacagaagctgctgtgcctgtgaagcaggagcctgagaccgtgcccaccccagccctgctgaatgtgcggcagccccccagcaccaccacctttgtgctgaaccagatcaaccacctgccccccctgggcagcaccatcgtgatgaccaagaccccacctgtgaccaccaaccggcagaccatcaccctgaccaagttcatccagaccacagccagcacccggcccagcgtgtctgcccccaccgtgagaaatgccatgaccagcgcccccagcaaggaccaggtgcagctgaaggacctgctgaagaacaacagcctgaatgagctgatgaagctgaagcccccagccaacatcgcccagcctgtggccacagctgccacagatgtgtccaatggaacagtgaagaaggagagcagcaacaaggagggcgccaggatgtggatcaatgacatgaagatgaggagcttcagccccaccatgaaggtgcctgtggtgaaggaggatgatgagcctgaggaggaggatgaggaggagatgggccacgccgagacctacgccgagtacatgcccatcaagctgaagattggcctgcggcacccagatgctgtggtggagaccagcagcctgagctctgtgaccccaccagatgtgtggtacaagaccagcatcagcgaggagaccatcgacaatggctggctgagcgccctgcagctggaggccatcacctacgccgcccagcagcacgagaccttcctgcccaacggggaccgggccggcttcctgattggagatggagctggggtgggcaagggccgcaccatcgccggcatcatctatgagaactacctgctgagcaggaagagggccctgtggttctctgtgtccaatgacctgaagtatgatgctgagcgggacctgcgggacattggagccaagaacatcctggtgcacagcctgaacaagttcaagtatggcaagatcagcagcaagcacaacggctctgtgaagaagggcgtcatctttgccacctacagcagcctcatcggggagagccagagcggcggcaagtacaagacccggctgaagcagctgctgcactggtgtggagatgactttgatggagtcatcgtgtttgatgagtgccacaaggccaagaacctgtgccctgtgggcagcagcaagcccaccaagacaggcctggccgtgctggagctgcagaacaagctgcccaaggcccgggtggtgtatgccagcgccaccggggccagcgagcccaggaacatggcctacatgaaccggctgggcatctggggcgagggcacccccttccgggagttcagtgacttcatccaggccgtggagaggagaggagtgggcgccatggagatcgtggccatggacatgaagctgcggggcatgtacatcgcccggcagctgtccttcaccggggtgaccttcaagattgaggaggtgctgctgagccagagctatgtgaagatgtacaacaaggctgtgaagctgtgggtgattgcccgggagcgcttccagcaggccgctgacctgattgatgctgagcagaggatgaagaagtccatgtggggccagttctggagcgcccaccagcgcttcttcaagtacctgtgcatcgccagcaaggtgaagagggtggtgcagctggcccgggaggagatcaagaatggaaaatgtgtggtgattggcctgcagagcactggagaggcccggaccctggaggccctggaggagggcggcggggagctgaatgactttgtgtccacagccaagggcgtgctgcagagcctcatcgagaagcacttccctgccccagacaggaagaagctgtacagcctgctgggcatcgacctgacagcccccagcaacaacagcagcccccgggacagcccctgcaaggagaacaagatcaagaagaggaaaggagaggagatcacccgggaggccaagaaggccaggaagatgagcctgatgaggatgatgaagatggtgagcagctag

SEQ ID NO: 171850 - DNA, 1632 bp, Artificial Sequence
  Description of Artificial Sequence: Synthetic coding sequence
atggagcaggtgaatgagctgaaggagaagggcaacaaggccctgtctgtgggcaacattgatgatgccctgcagtgctacagcgaggccatcaagctggacccccacaaccacgtgctgtacagcaacagatctgctgcctatgccaagaagggggactaccagaaggcctatgaagatggctgcaagacagtggacctgaagccagactggggcaagggctacagcaggaaggccgccgccctggagttcctgaacagatttgaggaggccaagaggacctatgaggagggcctgaagcatgaggccaacaacccccagctgaaggagggcctgcagaacatggaggcccggctggccgagaggaagttcatgaaccccttcaacatgcccaacctgtaccagaagctggagagtgaccccaggaccaggaccctgctgagtgaccccacctaccgggagctgattgagcagctgaggaacaagcccagcgacctgggcaccaagctgcaggacccccgcatcatgaccaccctgtctgtgctgctgggcgtggacctgggctccatggatgaggaggaggagatcgccaccccacctcctcctcctccacccaagaaggagaccaagccagagcccatggaggaggacctgcctgagaacaagaagcaggccctgaaggagaaggagctgggcaatgatgcctacaagaagaaggactttgacacagccctgaagcactatgacaaggccaaggagctggaccccaccaacatgacctacatcaccaaccaggccgctgtgtactttgagaagggggactacaacaagtgccgggagctgtgtgagaaggccatcgaggtgggcagagaaaatcgggaggactaccggcagatcgccaaggcctatgcccgcatcggcaacagctacttcaaggaggagaagtacaaggatgccatccacttctacaacaagagcctggccgagcacaggaccccagatgtgctgaagaagtgccagcaggccgagaagatcctgaaggagcaggagcggctggcctacatcaacccagacctggccctggaggagaagaacaagggaaatgaatgcttccagaagggggactacccccaggccatgaagcactacacagaggccatcaagaggaaccccaaggatgccaagctgtacagcaacagagctgcctgctacaccaagctgctggagttccagctggccctgaaggactgtgaggagtgcatccagctggagcccaccttcatcaagggctacaccaggaaggccgccgccctggaggccatgaaggactacaccaaggccatggatgtgtaccagaaggccctggacctggacagcagctgcaaggaggccgcagatggctaccagcgctgcatgatggcccagtacaacagacatgacagcccagaagatgtgaagagaagagccatggctgaccctgaggtgcagcagatcatgtctgaccctgccatgaggctcatcctggagcagatgcagaaggacccccaggccctgtctgagcacctgaagaaccctgtgattgcccagaagatccagaagctgatggatgtgggcctcatcgccatcagatag

SEQ ID NO: 171851 - DNA, 1359 bp, Artificial Sequence
  Description of Artificial Sequence: Synthetic coding sequence
atgaaccggcagctggtgaacatcctgacagccctgtttgccttcttcctggagaccaaccacttcagaacagccttctgcaaggaccatgacagccgcagcggcaagcagcccagccagaccctgagccccagcgacttcctggacaagctgatgggccgcaccagcggctatgatgcccgcatccggcccaacttcaagggcccccctgtgaatgtgacctgcaacatcttcatcaacagctttggatctgtgacagagaccaccatggactacagagtgaacatcttcctgcggcagcagtggaatgacagccggctggcctacagcgagtacccagatgacagcctggacctggaccccagcatgctggacagcatctggaagccagacctcttctttgccaatgagaagggggccaacttccatgatgtgaccacagacaacaagctgctgcgcatcagcaagaatggcaaggtgctgtacagcatccggctgaccctgaccctgagctgccccatggacctgaagaacttccccatggatgtgcagacctgcaccatgcagctggagagctttggctacaccatgaatgacctgatctttgagtggctgagtgatggccctgtgcaggtggccgagggcctgaccctgccccagttcatcctgaaggaggagaaggagctgggctactgcaccaagcactacaacacaggcaagttcacctgcatcgaggtgaagttccacctggagcggcagatgggctactacctgatccagatgtacatccccagcctgctgattgtcatcctgtcctgggtgtccttctggatcaacatggatgctgccccagcccgggtggccctgggcatcaccaccgtgctgaccatgaccacccagagcagcggcagccgggccagcctgcccaaggtgtcctatgtgaaggccatcgacatctggatggctgtgtgcctgctgtttgtgtttgctgccctgctggagtatgctgctgtgaactttgtgtcccggcagcacaaggagttcctgcggctgcggcggcggcagaagaggcagaacaaggaggaggatgtgacccgggagagccgcttcaacttcagcggctacggcatgggccactgcctgcaggtgaaggatggaacagctgtgaaggccaccccagccaaccccctgccccagccccccaaggatggagatgccatcaagaagaagtttgtggaccgggccaagagaattgacaccatcagccgggccgccttccccctggccttcctgatcttcaacatcttctactggatcacctacaagatcatcagacatgaagatgtgcacaagaagtag

SEQ ID NO: 171852 - DNA, 3489 bp, Artificial Sequence
  Description of Artificial Sequence: Synthetic coding sequence
atgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaagattctggggactaccccctgaccatggccggcccccagtggaagaagttcaagagcagcttctgtgagttcatcggcgtgctggtgcggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatcaacatggacaacacccagaggcagtatgaagctgagaggaacaagatgattggcaagagggccaatgaaaggctggagctgctgctgcagaagaggaaggagctgcaggagaaccaggatgaaattgagaacatgatgaatgccatcttcaagggcgtgtttgtgcaccgctacagagatgccatcgccgagatccgggccatctgcatcgaggagatcggcatctggatgaagatgtacagtgatgccttcctgaatgacagctacctgaagtatgtgggctggaccatgcatgacaagcagggcgaggtgcggctgaagtgcctgacagccctgcagggcctgtactacaacaaggagctgaacagcaagctggagctgttcaccagccgcttcaaggaccgcatcgtgtccatgaccctggacaaggagtatgatgtggccgtgcaggccatcaagctgctgaccctggtgctgcagagcagcgaggaggtgctgacagctgaggactgtgaaaatgtgtaccacctggtgtacagcgcccacaggcctgtggccgtggccgccggggagttcctgtacaagaagctgttcagccggcgggaccctgaagaagatggcatgatgaagagaagaggccggcagggccccaatgccaacctggtgaagaccctggtgttcttcttcctggagagcgagctgcatgaacatgctgcctacctggtggacagcatgtgggactgtgccacagagctgctgaaggactgggagtgcatgaacagcctgctgctggaggagcccctgtctggagaggaggccctgacagaccggcaggagagcgccctgattgagatcatgctgtgcaccatccggcaggccgctgagtgccacccccctgtgggccggggcaccgggaagagggtgctgacagccaaggagaagaagacccagctggatgacaggaccaagatcacagagctgtttgctgtggccctgccccagctgctggccaagtacagcgtggatgctgagaaggtgaccaacctgctgcagctgccccagtactttgacctggagatctacaccaccggccgcctggagaagcacctggatgccctgctgcggcagatccggaacatcgtggagaagcacacagacacagatgtgctggaggcctgcagcaagacctaccacgccctgtgcaatgaggagttcaccatcttcaacagagtggacatcagccgcagccagctgattgatgagctggccgacaagttcaaccggctgctggaggacttcctgcaggagggggaggagccagatgaagatgatgcctaccaggtgctgagcaccctgaagaggatcacagccttccacaatgcccatgacctgagcaagtgggacctgtttgcctgcaactacaagctgctgaagacaggaattgaaaatggagacatgcctgagcagatcgtcatccacgccctgcagtgcacccactacgtgatcctgtggcagctggccaagatcacagagagcagcagcaccaaggaggacctgctgcggctgaagaagcagatgagggtcttctgccagatctgccagcactacctgaccaacgtgaacaccaccgtgaaggagcaggccttcaccatcctgtgtgacatcctgatgatcttcagccaccagatcatgtctgggggccgggacatgctggagcccctggtgtacaccccagacagcagcctgcagagcgagctgctgtccttcatcctggaccacgtgttcatcgagcaggatgatgacaacaacagcgcagatggccagcaggaggatgaggccagcaagattgaggccctgcacaagagaagaaacctgctggccgccttctgcaagctgattgtgtacacagtggtggagatgaacacagctgctgacatcttcaagcagtacatgaagtactacaatgactatggagacatcatcaaggagaccatgagcaagacccggcagattgacaagatccagtgtgccaagaccctcatcctgagcctgcagcagctgttcaatgagatgatccaggagaatggctacaactttgacaggagcagcagcaccttcagcggcatcaaggagctggccaggagatttgccctgaccttcggcctggaccagctgaagacccgggaggccatcgccatgctgcacaaggatggcattgaatttgccttcaaggagcccaacccccagggcgagagccacccccccctgaacctggccttcctggacatcctgtctgagttcagcagcaagctgctgcggcaggacaagaggacagtgtatgtgtacctggagaagttcatgaccttccagatgagcctgcggcgggaggatgtgtggctgcccctgatgagctacagaaacagcctgctggccggaggagatgatgacaccatgtctgtcatcagcggcatcagcagccggggcagcacagtgcgcagcaagaagagcaagcccagcacaggcaagaggaaggtggtggagggcatgcagctgagcctgacagaggagagcagcagcagtgacagcatgtggctgagccgggagcagaccctgcacacccctgtgatgatgcagaccccccagctgaccagcaccatcatgagggagcccaagaggctgcggcctgaggacagcttcatgtctgtgtaccccatgcagacagagcaccaccagacccccctggactacaacagaagaggcaccagcctgatggaggatgatgaggagcccatcgtggaggatgtgatgatgagcagcgagggcagaattgaggacctgaatgaaggcatggactttgacaccatggacatcgacctgccccccagcaagaacagaagagagaggacagagctgaagccagacttctttgatcctgccagcatcatggatgaatctgtgctgggcgtgtccatgttttag

SEQ ID NO: 171853 - DNA, 3696 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaggacagcggggactaccccctgaccatggccggcccccagtggaagaagttcaagagcagcttctgtgagttcatcggcgtgctggtgcggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatcaacatggacaacacccagaggcagtatgaggccgagaggaacaagatgattggcaagagggccaatgaaaggctggagctgctgctgcagaagaggaaggagctgcaggagaaccaggatgaaattgagaacatgatgaatgccatcttcaagggcgtgtttgtgcaccgctacagagatgccatcgccgagatccgggccatctgcatcgaggagatcggcatctggatgaagatgtacagtgatgccttcctgaatgacagctacctgaagtatgtgggctggaccatgcatgacaagcagggcgaggtgcggctgaagtgcctgacagccctgcagggcctgtactacaacaaggagctgaacagcaagctggagctgttcaccagccgcttcaaggacagaattgtgtccatgaccctggacaaggagtatgatgtggccgtgcaggccatcaagctgctgaccctggtgctgcagagcagcgaggaggtgctgacagctgaggactgtgaaaatgtgtaccacctggtgtacagcgcccacaggcctgtggccgtggccgccggggagttcctgtacaagaagctgttcagcagaagagatcctgaggaggatggcatgatgaagaggcggggccggcagggccccaatgccaacctggtgaagaccctggtgttcttcttcctggagagcgagctgcacgagcacgccgcctacctggtggacagcatgtgggactgtgccacagagctgctgaaggactgggagtgcatgaacagcctgctgctggaggagcccctgagcggggaggaggccctgacagaccggcaggagagcgccctgattgagatcatgctgtgcaccatccggcaggccgctgagtgccacccccctgtgggccggggcaccgggaagagggtgctgacagccaaggagaagaagacccagctggatgacaggaccaagatcacagagctgtttgctgtggccctgccccagctgctggccaagtacagcgtggatgctgagaaggtgaccaacctgctgcagctgccccagtactttgacctggagatctacaccaccggccgcctggagaagcacctggatgccctgctgcggcagatcagaaatattgtggagaagcacacagacacagatgtgctggaggcctgcagcaagacctaccacgccctgtgcaatgaggagttcaccatcttcaacagagtggacatcagccgcagccagctgattgatgagctggccgacaagttcaaccggctgctggaggacttcctgcaggagggggaggagccagatgaagatgatgcctaccaggtgctgagcaccctgaagaggatcacagccttccacaatgcccatgacctgagcaagtgggacctgtttgcctgcaactacaagctgctgaagacaggaattgaaaatggagacatgcctgagcagatcgtcatccacgccctgcagtgcacccactacgtgatcctgtggcagctggccaagatcacagagagcagcagcaccaaggaggacctgctgcggctgaagaagcagatgagggtcttctgccagatctgccagcactacctgaccaacgtgaacaccaccgtgaaggagcaggccttcaccatcctgtgtgacatcctgatgatcttcagccaccagatcatgtctgggggccgggacatgctggagcccctggtgtacaccccagacagcagcctgcagagcgagctgctgtccttcatcctggaccacgtgttcatcgagcaggatgatgacaacaacagcgcagatggccagcaggaggatgaggccagcaagattgaggccctgcacaagagaagaaacctgctggccgccttctgcaagctgattgtgtacacagtggtggagatgaacacagctgctgacatcttcaagcagtacatgaagtactacaatgactatggagacatcatcaaggagaccatgagcaagacccggcagattgacaagatccagtgtgccaagaccctcatcctgagcctgcagcagctgttcaatgagatgatccaggagaatggctacaactttgacaggagcagcagcaccttcagcggcatcaaggagctggccaggagatttgccctgaccttcggcctggaccagctgaagacccgggaggccatcgccatgctgcacaaggatggcatcgagtttgccttcaaggagcccaacccccagggcgagagccacccccccctgaacctggccttcctggacatcctgtctgagttcagcagcaagctgctgcggcaggacaagaggacagtgtatgtgtacctggagaagttcatgaccttccagatgagcctgcggagagaagatgtgtggctgcccctgatgagctacagaaacagcctgctggccggaggagatgatgacaccatgtctgtcatcagcggcatcagcagccggggcagcacagtgcgcagcaagaagagcaagcccagcacaggcaagaggaaggtggtggagggcatgcagctgagcctgacagaggagagcagcagcagtgacagcatgtggctgagccgggagcagaccctgcacacccctgtgatgatgcagaccccccagctgaccagcaccatcatgagggagcccaagaggctgcggccagaagattccttcatgtctgtgtaccccatgcagacagagcaccaccagacccccctggactacaacagaagaggcaccagcctgatggaggatgatgaggagcccatcgtggaggatgtgatgatgagcagcgagggcagaattgaggacctgaatgaaggcatggactttgacaccatggacatcgacctgccccccagcaagaacagaagagagaggacagagctgaagccagacttctttgatcctgccagcatcatggatgagagcgtgctgggcgtgtccatgttttag

SEQ ID NO: 171854 - DNA, 3807 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaggacagcggggactaccccctgaccatggccggcccccagtggaagaagttcaagagcagcttctgtgagttcatcggcgtgctggtgcggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatcaacatggacaacacccagaggcagtatgaggccgagaggaacaagatgattggcaagagggccaatgaaaggctggagctgctgctgcagaagaggaaggagctgcaggagaaccaggatgaaattgagaacatgatgaatgccatcttcaagggcgtgtttgtgcaccgctacagagatgccatcgccgagatccgggccatctgcatcgaggagatcggcatctggatgaagatgtacagtgatgccttcctgaatgacagctacctgaagtatgtgggctggaccatgcatgacaagcagggcgaggtgcggctgaagtgcctgacagccctgcagggcctgtactacaacaaggagctgaacagcaagctggagctgttcaccagccgcttcaaggacagaattgtgtccatgaccctggacaaggagtatgatgtggccgtgcaggccatcaagctgctgaccctggtgctgcagagcagcgaggaggtgctgacagctgaggactgtgaaaatgtgtaccacctggtgtacagcgcccacaggcctgtggccgtggccgccggggagttcctgtacaagaagctgttcagcagaagagatcctgaggaggatggcatgatgaagaggcggggccggcagggccccaatgccaacctggtgaagaccctggtgttcttcttcctggagagcgagctgcacgagcacgccgcctacctggtggacagcatgtgggactgtgccacagagctgctgaaggactgggagtgcatgaacagcctgctgctggaggagcccctgagcggggaggaggccctgacagaccggcaggagagcgccctgattgagatcatgctgtgcaccatccggcaggccgctgagtgccacccccctgtgggccggggcaccgggaagagggtgctgacagccaaggagaagaagacccagctggatgacaggaccaagatcacagagctgtttgctgtggccctgccccagctgctggccaagtacagcgtggatgctgagaaggtgaccaacctgctgcagctgccccagtactttgacctggagatctacaccaccggccgcctggagaagcacctggatgccctgctgcggcagatcagaaatattgtggagaagcacacagacacagatgtgctggaggcctgcagcaagacctaccacgccctgtgcaatgaggagttcaccatcttcaacagagtggacatcagccgcagccagctgattgatgagctggccgacaagttcaaccggctgctggaggacttcctgcaggagggggaggagccagatgaagatgatgcctaccaggtgctgagcaccctgaagaggatcacagccttccacaatgcccatgacctgagcaagtgggacctgtttgcctgcaactacaagctgctgaagacaggaattgaaaatggagacatgcctgagcagatcgtcatccacgccctgcagtgcacccactacgtgatcctgtggcagctggccaagatcacagagagcagcagcaccaaggaggacctgctgcggctgaagaagcagatgagggtcttctgccagatctgccagcactacctgaccaacgtgaacaccaccgtgaaggagcaggccttcaccatcctgtgtgacatcctgatgatcttcagccaccagatcatgtctgggggccgggacatgctggagcccctggtgtacaccccagacagcagcctgcagagcgagctgctgtccttcatcctggaccacgtgttcatcgagcaggatgatgacaacaacagcgcagatggccagcaggaggatgaggccagcaagattgaggccctgcacaagagaagaaacctgctggccgccttctgcaagctgattgtgtacacagtggtggagatgaacacagctgctgacatcttcaagcagtacatgaagtactacaatgactatggagacatcatcaaggagaccatgagcaagacccggcagattgacaagatccagtgtgccaagaccctcatcctgagcctgcagcagctgttcaatgagatgatccaggagaatggctacaactttgacaggagcagcagcaccttcagcggcatcaaggagctggccaggagatttgccctgaccttcggcctggaccagctgaagacccgggaggccatcgccatgctgcacaaggatggcatcgagtttgccttcaaggagcccaacccccagggcgagagccacccccccctgaacctggccttcctggacatcctgtctgagttcagcagcaagctgctgcggcaggacaagaggacagtgtatgtgtacctggagaagttcatgaccttccagatgagcctgcggagagaagatgtgtggctgcccctgatgagctacagaaacagcctgctggccggaggagatgatgacaccatgtctgtcatcagcggcatcagcagccggggcagcacagtgcgcagcaagaagagcaagcccagcacaggcaagaggaaggtggtggagggcatgcagctgagcctgacagaggagagcagcagcagtgacagcatgtggctgagccgggagcagaccctgcacacccctgtgatgatgcagaccccccagctgaccagcaccatcatgagggagcccaagaggctgcggccagaagattccttcatgtctgtgtaccccatgcagacagagcaccaccagacccccctggactacaacacccaggtgacctggatgctggcccagaggcagcaggaggaggcccggcagcagcaggagcgggccgccatgtcctatgtgaagctgcggaccaacctgcagcacgccatccggcggggcaccagcctgatggaggatgatgaggagcccatcgtggaggatgtgatgatgagcagcgagggcagaattgaggacctgaatgaaggcatggactttgacaccatggacatcgacctgccccccagcaagaacagaagagagaggacagagctgaagccagacttctttgatcctgccagcatcatggatgaatctgtgctgggcgtgtccatgttttag

SEQ ID NO: 171855 - DNA, 3696 bp, Artificial Sequence; identical to SEQ ID NO: 171853
  Description of Artificial Sequence: Synthetic coding sequence

SEQ ID NO: 171856 - DNA, 3696 bp, Artificial Sequence; identical to SEQ ID NO: 171853
  Description of Artificial Sequence: Synthetic coding sequence

SEQ ID NO: 171857 - DNA, 213 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgtag

SEQ ID NO: 171858 - DNA, 348 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctgtag

SEQ ID NO: 171859 - DNA, 510 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaggacagcggggactaccccctgaccatggccggcccccagtggaagtag

SEQ ID NO: 171860 - DNA, 465 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaatag

SEQ ID NO: 171861 - DNA, 627 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaggacagcggggactaccccctgaccatggccggcccccagtggaagaagttcaagagcagcttctgtgagttcatcggcgtgctggtgcggcagtgccagtacagcatcatctatgatgagtacatgatggacaccgtcatcagcctgctgaccggcctgtcctag

SEQ ID NO: 171862 - DNA, 1647 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaggacagcggggactaccccctgaccatggccggcccccagtggaagaagttcaagagcagcttctgtgagttcatcggcgtgctggtgcggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatcaacatggacaacacccagaggcagtatgaggccgagaggaacaagatgattggcaagagggccaatgaaaggctggagctgctgctgcagaagaggaaggagctgcaggagaaccaggatgaaattgagaacatgatgaatgccatcttcaagggcgtgtttgtgcaccgctacagagatgccatcgccgagatccgggccatctgcatcgaggagatcggcatctggatgaagatgtacagtgatgccttcctgaatgacagctacctgaagtatgtgggctggaccatgcatgacaagcagggcgaggtgcggctgaagtgcctgacagccctgcagggcctgtactacaacaaggagctgaacagcaagctggagctgttcaccagccgcttcaaggacagaattgtgtccatgaccctggacaaggagtatgatgtggccgtgcaggccatcaagctgctgaccctggtgctgcagagcagcgaggaggtgctgacagctgaggactgtgaaaatgtgtaccacctggtgtacagcgcccacaggcctgtggccgtggccgccggggagttcctgtacaagaagctgttcagcagaagagatcctgaggaggatggcatgatgaagaggcggggccggcagggccccaatgccaacctggtgaagaccctggtgttcttcttcctggagagcgagctgcacgagcacgccgcctacctggtggacagcatgtgggactgtgccacagagctgctgaaggactgggagtgcatgaacagcctgctgctggaggagcccctgagcggggaggaggccctgacagaccggcaggagagcgccctgattgagatcatgctgtgcaccatccggcaggccgctgagtgccacccccctgtgggccggggcaccgggaagagggtgctgtag

SEQ ID NO: 171863 - DNA, 123 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaaaggatag

SEQ ID NO: 171864 - DNA, 3678 bp, Artificial Sequence
  Description of Artificial Sequence: Synthetic coding sequence
atgagcagccccctgcagagagctgtgggggacaccaagagggccctgagcgccagcagcagcagcagcgccagcctgccctttgatgaccgggacagcaaccacaccagcgagggcaatggagacagcctgctggctgatgaggacacagactttgaggacagcctgaacagaaatgtgaagaagagagctgccaagaggcctcccaagaccacccctgtggccaagcaccccaagaagggcagccgggtggtgcaccgccacagcaggaagcagagcgagcccccagccaatgacctcttcaatgctgtgaaggccgccaagagtgacatgcagagcctggtggatgagtggctggacagctacaagcaggaccaggatgctggcttcctggagctggtgaacttcttcatccagagctgtggctgcaagggcatcgtgaccccagagatgttcaagaagatgagcaacagcgagatcatccagcacctgacagagcagttcaatgaagacagcggggactaccccctcatcgcccctggccccagctggaagaagttccagggcagcttctgtgaatttgtgaggaccctggtgtgccagtgccagtacagcctgctgtatgatggcttccccatggatgacctgatcagcctgctgaccggcctgagtgacagccaggtgcgggccttccgccacaccagcaccctggccgccatgaagctgatgaccagcctggtgaaggtggccctgcagctgtctgtgcaccaggacaacaaccagaggcagtatgaggccgagaggaacaagggccctggccagagggcccctgagcggctggagagcctgctggagaagaggaaggagctgcaggagcaccaggaggagattgagggcatgatgaatgccctcttccggggcgtgtttgtgcaccgctacagagatgtgctgcctgagatccgggccatctgcatcgaggagatcggctgctggatgcagagctacagcaccagcttcctgacagacagctacctgaagtacatcggctggaccctgcatgacaagcaccgggaggtgcggctgaagtgtgtgaaggccctgaagggcctgtatggcaacagagacctgaccacccggctggagctgttcaccagccgcttcaaggacaggatggtgtccatggtgatggaccgggagtatgatgtggccgtggaggccgtgcggctgctgatcctgatcctgaagaacatggagggcgtgctgacagatgctgactgtgagagcgtgtaccctgtggtgtatgccagccaccggggcctggccagcgctgctggggagttcctgtactggaagctgttctacccagaatgtgagatccgcatgatgggcggccgggagcagaggcagagccctggggcccagaggaccttcttccagctgctgctgtccttctttgtggagagcgagctgcatgaccacgccgcctacctggtggacagcctgtgggactgtgccggggcccggctgaaggactgggagggcctgaccagcctgctgctggagaaggaccagaacctgggagatgtgcaggagagcaccctgattgagatcctggtgtcctctgcccggcaggccagcgagggccacccccctgtgggccgggtgacaggcaggaagggcctgaccagcaaggagaggaagacccaggctgatgacagagtgaagctgacagagcacctgatccccctgctgccccagctgctggccaagttcagcgcagatgctgagaaggtgacccccctgctgcagctgctgagctgctttgacctgcacatctactgcaccggccgcctggagaagcacctggagctgttcctgcagcagctgcaggaggtggtggtgaagcatgctgagcctgctgtgctggaggccggggcccacgccctgtacctgctgtgcaaccctgagttcaccttcttcagcagagctgactttgcccggagccagctggtggacctgctgacagaccgcttccagcaggagctggaggagctgctgcagagcagcttcctggatgaagatgaggtgtacaacctggccgccaccctgaagaggctgagcgccttctacaacacccatgacctgacccgctgggagctgtatgagccctgctgccagctgctgcagaaggctgtggacaccggggaggtgccccaccaggtgatcctgcctgccctgaccctggtgtacttcagcatcctgtggaccctgacccacatcagcaagagtgatgccagccagaagcagctgagcagcctgcgggacaggatggtggccttctgtgagctgtgccagagctgcctgagtgatgtggacacagagatccaggagcaggcctttgtgctgctgagtgacctgctgctgatcttcagcccccagatgattgtgggcggccgggacttcctgcggcccctggtgttcttccctgaggccaccctgcagagcgagctggccagcttcctgatggaccacgtgttcatccagcccggggacctgggcagcggggacagccaggaggaccacctgcagatcgagcggctgcaccagaggcggcggctgctggccggcttctgcaagctgctgctgtatggagtgctggagatggatgctgccagtgatgtgttcaagcactacaacaagttctacaatgactatggagacatcatcaaggagaccctgacccgggcccggcagattgacaggagccactgcagccgcatcctgctgctgagcctgaagcagctgtacacagagctgctgcaggagcacggcccccagggcctgaatgagctgcctgccttcatcgagatgagggacctggccaggagatttgccctgagctttggcccccagcagctgcagaacagagacctggtggtgatgctgcacaaggagggcatccagttcagcctgtctgagctgcccccagctggcagcagcaaccagccccccaacctggccttcctggagctgctgtctgagttcagccccaggctcttccaccaggacaagcagctgctgctgagctacctggagaagtgcctgcagcacgtgtcccaggcccctggccacccctggggccctgtgaccacctactgccacagcctgagccctgtggagaacacagctgagaccagcccccaggtgctgcccagcagcaagagaagaagagtggagggccctgccaagcccaacagagaagatgtgagcagcagccaggaggagagcctgcagctgaacagcatcccccccacccccaccctgaccagcacagctgtgaagagccggcagcccctgtggggcctgaaggagatggaggaggaggatggcagcgagctggactttgcccagggccagcctgtggccggcacagagaggagccgcttcctgggcccccagtacttccagaccccccacaaccccagcggccctggcctgggcaaccagctgatgaggctgagcctgatggaggaggatgaggaggaggagctggagatccaggatgagagcaatgaggagcggcaggacacagacatgcaggccagcagctacagcagcaccagcgagcggggcctggacctgctggacagcacagagctggacatcgaggacttctag

SEQ ID NO: 171865 - DNA, 2667 bp, Artificial Sequence
  Description of Artificial Sequence: Synthetic coding sequence
atgagcagccccctgcagagagctgtgggggacaccaagagggccctgagcgccagcagcagcagcagcgccagcctgccctttgatgaccgggacagcaaccacaccagcgagggcaatggagacagcctgctggctgatgaggacacagactttgaggacagcctgaacagaaatgtgaagaagagagctgccaagaggcctcccaagaccacccctgtggccaagcaccccaagaagggcagccgggtggtgcaccgccacagcaggaagcagagcgagcccccagccaatgacctcttcaatgctgtgaaggccgccaagagtgacatgcagagcctggtggatgagtggctggacagctacaagcaggaccaggatgctggcttcctggagctggtgaacttcttcatccagagctgtggctgcaagggcatcgtgaccccagagatgttcaagaagatgagcaacagcgagatcatccagcacctgacagagcagttcaatgagatggatgacctgatcagcctgctgaccggcctgagtgacagccaggtgcgggccttccgccacaccagcaccctggccgccatgaagctgatgaccagcctggtgaaggtggccctgcagctgtctgtgcaccaggacaacaaccagaggcagtatgaggccgagaggaacaagggccctggccagagggcccctgagcggctggagagcctgctggagaagaggaaggagctgcaggagcaccaggaggagattgagggcatgatgaatgccctcttccggggcgtgtttgtgcaccgctacagagatgtgctgcctgagatccgggccatctgcatcgaggagatcggctgctggatgcagagctacagcaccagcttcctgacagacagctacctgaagtacatcggctggaccctgcatgacaagcaccgggaggtgcggctgaagtgtgtgaaggccctgaagggcctgtatggcaacagagacctgaccacccggctggagctgttcaccagccgcttcaaggacaggatggtgtccatggtgatggaccgggagtatgatgtggccgtggaggccgtgcggctgctgatcctgatcctgaagaacatggagggcgtgctgacagatgctgactgtgagagcgtgtaccctgtggtgtatgccagccaccggggcctggccagcgctgctggggagttcctgtactggaagctgttctacccagaatgtgagatccgcatgatgggcggccgggagcagaggcagagccctggggcccagaggaccttcttccagctgctgctgtccttctttgtggagagcgagctgcatgaccacgccgcctacctggtggacagcctgtgggactgtgccggggcccggctgaaggactgggagggcctgaccagcctgctgctggagaaggaccagaacctgggagatgtgcaggagagcaccctgattgagatcctggtgtcctctgcccggcaggccagcgagggccacccccctgtgggccgggtgacaggcaggaagggcctgaccagcaaggagaggaagacccaggctgatgacagagtgaagctgacagagcacctgatccccctgctgccccagctgctggccaagttcagcgcagatgctgagaaggtgacccccctgctgcagctgctgagctgctttgacctgcacatctactgcaccggccgcctggagaagcacctggagctgttcctgcagcagctgcaggaggtggtggtgaagcatgctgagcctgctgtgctggaggccggggcccacgccctgtacctgctgtgcaaccctgagttcaccttcttcagcagagctgactttgcccggagccagctggtggacctgctgacagaccgcttccagcaggagctggaggagctgctgcagagcagcttcctggatgaagatgaggtgtacaacctggccgccaccctgaagaggctgagcgccttctacaacacccatgacctgacccgctgggagctgtatgagccctgctgccagctgctgcagaaggctgtggacaccggggaggtgccccaccaggtgatcctgcctgccctgaccctggtgtacttcagcatcctgtggaccctgacccacagcctgagccctgtggagaacacagctgagaccagcccccaggtgctgcccagcagcaagagaagaagagtggagggccctgccaagcccaaccgggaggatgtgagcagcagccaggaggagagcctgcagctgaacagcatcccccccacccccaccctgaccagcacagctgtgaagagccggcagcccctgtggggcctgaaggagatggaggaggaggatggcagcgagctggactttgcccagggccagcctgtggccggcacagagaggagccgcttcctgggcccccagtacttccagaccccccacaaccccagcggccctggcctgggcaaccagctgatgaggctgagcctgatggaggaggatgaggaggaggagctggagatccaggatgagagcaatgaggagcggcaggacacagacatgcaggccagcagctacagcagcaccagcgagcggggcctggacctgctggacagcacagagctggacatcgaggacttctag

SEQ ID NO: 171866 - DNA, 789 bp, Artificial Sequence
  Description of Artificial Sequence: Synthetic coding sequence
atgctgcacaaggagggcatccagttcagcctgtctgagctgcccccagctggcagcagcaaccagccccccaacctggccttcctggagctgctgtctgagttcagccccaggctcttccaccaggacaagcagctgctgctgagctacctggagaagtgcctgcagcacgtgtcccaggcccctggccacccctggggccctgtgaccacctactgccacagcctgagccctgtggagaacacagctgagaccagcccccaggtgctgcccagcagcaagagaagaagagtggagggccctgccaagcccaacagagaagatgtgagcagcagccaggaggagagcctgcagctgaacagcatcccccccacccccaccctgaccagcacagctgtgaagagccggcagcccctgtggggcctgaaggagatggaggaggaggatggcagcgagctggactttgcccagggcagccagcctgtggccggcacagagaggagccgcttcctgggcccccagtacttccagaccccccacaaccccagcggccctggcctgggcaaccagctgatgaggctgagcctgatggaggaggatgaggaggaggagctggagatccaggatgagagcaatgaggagcggcaggacacagacatgcaggccagcagctacagcagcaccagcgagcggggcctggacctgctggacagcacagagctggacatcgagatcacagagagcctgcccctgctgggcaagagcccccacccctacaacagcaggtag

SEQ ID NO: 171867 - DNA, 438 bp, Artificial Sequence
  Description of Artificial Sequence: Synthetic coding sequence
atgagcagccccctgcagagagctgtgggggacaccaagagggccctgagcgccagcagcagcagcagcgccagcctgccctttgatgaccgggacagcaaccacaccagcgagggcaatggagacagcctgctggctgatgaggacacagactttgaggacagcctgaacagaaatgtgaagaagagagctgccaagaggcctcccaagaccacccctgtggccaagcaccccaagaagggcagccgggtggtgcaccgccacagcaggaagcagagcgagcccccagccaatgacctcttcaatgctgtgaaggccgccaagagtgacatgcagagcctggtggatgagtggctggacagctacaagcaggaccaggatgctggcttcctggagctggtgaacttcttcatccagagctgtggctgcaagggctag

SEQ ID NO: 171868 - DNA, 339 bp, Artificial Sequence
  Description of Artificial Sequence: Synthetic coding sequence
atgagcagccccctgcagagagctgtgggggacaccaagagggccctgagcgccagcagcagcagcagcgccagcctgccctttgatgaccgggacagcaaccacaccagcgagggcaatggagacagcctgctggctgatgaggacacagactttgaggacagcctgaacagaaatgtgaagaagagagctgccaagaggcctcccaagaccacccctgtggccaagcaccccaagaagggcagccgggtggtgcaccgccacagcaggaagcagagcgagcccccagccaatgacctcttcaatgctgtgaaggccgccaagagtgacatgcagtag

SEQ ID NO: 171869 - DNA, 3678 bp, Artificial Sequence; identical to SEQ ID NO: 171864
  Description of Artificial Sequence: Synthetic coding sequence

SEQ ID NO: 171870 - DNA, 567 bp, Artificial Sequence
  Description of Artificial Sequence: Synthetic coding sequence
atgagcagccccctgcagagagctgtgggggacaccaagagggccctgagcgccagcagcagcagcagcgccagcctgccctttgatgaccgggacagcaaccacaccagcgagggcaatggagacagcctgctggctgatgaggacacagactttgaggacagcctgaacagaaatgtgaagaagagagctgccaagaggcctcccaagaccacccctgtggccaagcaccccaagaagggcagccgggtggtgcaccgccacagcaggaagcagagcgagcccccagccaatgacctcttcaatgctgtgaaggccgccaagagtgacatgcaggacagcggggactaccccctcatcgcccctggccccagctggaagaagttccagggcagcttctgtgaatttgtgaggaccctggtgtgccagtgccagtacagcctgctgtatgatggcttccccatggatgacctgatcagcctgctgaccggcctgagtgacagccaggtgcgggccttccgccacaccagcaccctggccgccatgaagctgatgaccagcctgtag

SEQ ID NO: 171871 - DNA, 1047 bp, Artificial Sequence
  Description of Artificial Sequence: Synthetic coding sequence
atggtgtggccctgggtggccatggccagccgctggggccccctcatcggcctggccccctgctgcctgtggctgctgggcgctgtgctgctgatggatgccagcgcccggcctgccaaccacagcagcacccgggagcgggtggccaaccgggaggagaatgagatcctgcccccagaccacctgaatggagtgaagctggagatggatggccacctgaacagaggcttccaccaggaggtgttcctgggcaaggacctgggcggctttgatgaagatgctgagcccaggaggagcaggaggaagctgatggtgatcttcagcaaggtggatgtgaacacagacaggaagatcagcgccaaggagatgcagcgctggatcatggagaagacagctgagcacttccaggaggccatggaggagagcaagacccacttccgggctgtggaccctgatggagatggccacgtgtcctgggatgagtacaaggtgaagttcctggccagcaagggccacagcgagaaggaggtggctgatgccatccggctgaatgaggagctgaaggtggatgaggagacccaggaggtgctggagaacctgaaggaccgctggtaccaggccgacagccccccagctgacctgctgctgacagaggaggagttcctgtccttcctgcaccctgagcacagccggggcatgctgcgcttcatggtgaaggagatcgtgcgggacctggaccaggatggagacaagcagctgtctgtgcctgagttcatcagcctgcctgtgggcaccgtggagaaccagcagggccaggacattgatgacaactgggtgaaggacaggaagaaggagtttgaggagctgattgacagcaaccatgatggcatcgtgacagctgaggagctggagaatgtgcccaccctgcccctgcagcccatcggcaccctgaacagccactttgtgcggctggccgctgagctgggcggcggcaaggccaccctgacctgtgcccccctggcccggcgggccacctggaccccctag

SEQ ID NO: 171872 - DNA, 1089 bp, Artificial Sequence
  Description of Artificial Sequence: Synthetic coding sequence
atggtgtggccctgggtggccatggccagccgctggggccccctcatcggcctggccccctgctgcctgtggctgctgggcgctgtgctgctgatggatgccagcgcccggcctgccaaccacagcagcacccgggagcgggtggccaaccgggaggagaatgagatcctgcccccagaccacctgaatggagtgaagctggagatggatggccacctgaacagaggcttccaccaggaggtgttcctgggcaaggacctgggcggctttgatgaagatgctgagcccaggaggagcaggaggaagctgatggtgatcttcagcaaggtggatgtgaacacagacaggaagatcagcgccaaggagatgcagcgctggatcatggagaagacagctgagcacttccaggaggccatggaggagagcaagacccacttccgggctgtggaccctgatggagatggccacgtgtcctgggatgagtacaaggtgaagttcctggccagcaagggccacagcgagaaggaggtggctgatgccatccggctgaatgaggagctgaaggtggatgaggagacccaggaggtgctggagaacctgaaggaccgctggtaccaggccgacagccccccagctgacctgctgctgacagaggaggagttcctgtccttcctgcaccctgagcacagccggggcatgctgcgcttcatggtgaaggagatcgtgcgggacctggaccaggatggagacaagcagctgtctgtgcctgagttcatcagcctgcctgtgggcaccgtggagaaccagcagggccaggacattgatgacaactgggtgaaggacaggaagaaggagtttgaggagctgattgacagcaaccatgatggcatcgtgacagctgaggagctggagagctacatggaccccatgaatgagtacaatgccctgaatgaggccaagcagatgattgctgtggctgatgagaaccagaaccaccacctggagcctgaggaggtgctgaagtacagcgagttcttcaccggcagcaagctggtggactatgcccggtctgtgcatgaggagttctag

SEQ ID NO: 171873 - DNA, 732 bp, Artificial Sequence
  Description of Artificial Sequence: Synthetic coding sequence
tgactggagatggatggccacctgaacagaggcttccaccaggaggtgttcctgggcaaggacctgggcggctttgatgaagatgctgagccccggcgcagcaggaggaagctgatggtgatcttcagcaaggtggatgtgaacacagacaggaagatcagcgccaaggagatgcagcgctggatcatggagaagacagctgagcacttccaggaggccatggaggagagcaagacccacttccgggctgtggaccctgatggagatggccacgtgtcctgggatgagtacaaggtgaagttcctggccagcaagggccacagcgagaaggaggtggctgatgccatccggctgaatgaggagctgaaggtggatgaggagagcagcaccagcaggaacttcctggacctgcgggccggcgtgtgccggccccgctacccccaggccgcccccctgagcgcccaggaggtgctggagaacctgaaggaccgctggtaccaggccgacagccccccagctgacctgctgctgacagaggaggagttcctgtccttcctgcaccctgagcacagccggggcatgctgcgcttcatggtgaaggagatcgtgcgggacctggaccaggatggagacaagcagctgtctgtgcctgagttcatcagcctgcctgtgggcaccgtggagaaccagcagggccaggacattgatgacaactgggtgaaggacagatag

SEQ ID NO: 171874 - DNA, 609 bp, Artificial Sequence
  Description of Artificial Sequence: Synthetic coding sequence
atggtgtggccctgggtggccatggccagccgctggggccccctcatcggcctggccccctgctgcctgtggctgctgggcgctgtgctgctgatggatgccagcgcccggcctgccaaccacagcagcacccgggagcgggtggccaaccgggaggagaatgagatcctgcccccagaccacctgaatggagtgaagctggagatggatggccacctgaacagaggcttccaccaggaggtgttcctgggcaaggacctgggcggctttgatgaagatgctgagcccaggaggagcaggaggaagctgatggtgatcttcagcaaggtggatgtgaacacagacaggaagatcagcgccaaggagatgcagcgctggatcatggagaagacagctgagcacttccaggaggccatggaggagagcaagacccacttccgggctgtggaccctgatggagatggccacgtgtcctgggatgagtacaaggtgaagttcctggccagcaagggccacagcgagaaggaggtggctgatgccatccggctgaatgaggagctgaaggtggatgaggagcggcacggccccccaggcccccgggccctgtag

SEQ ID NO: 171875 - DNA, 636 bp, Artificial Sequence
  Description of Artificial Sequence: Synthetic coding sequence
atggctgtggtgcccctgctgctgctgggcggcctgtggagcgctgtgggcgccagcagcctgggcgtggtgacctgtggctctgtggtgaagctgctgaacaccaggcacaacgtgcggctgcacagccatgatgtgcgctatggcagcggcagcggccagcagagcgtgactggagtgacctctgtggatgacagcaacagctactggaggatccggggcaagagcgccaccgtgtgtgagcggggcacccccatcaagtgtggccagcccatccggctgacccacgtgaacacaggaagaaacctgcacagccaccacttcaccagccccctgagcggcaaccaggaggtgtctgcctttggagaggagggggagggggactacctggatgactggacagtgctgtgcaatggcccctactgggtgagagatggagaggtgcgcttcaagcacagcagcacagaggtgctgctgtctgtgactggagagcagtatggccggcccatcagcggccagaaggaggtgcacggcatggcccagcccagccagaacaactactggaaggccatggagggcatcttcatgaagcccagcgagctgctgaaggccgaggcccaccacgccgagctgtag

SEQ ID NO: 171876 - DNA, 666 bp, Artificial Sequence
  Description of Artificial Sequence: Synthetic coding sequence
atgtggagcgctggccggggcggggccgcctggcctgtgctgctgggcctgctgctggccctgctggtgcctgggggcggggccgccaagacaggagctgagctggtgacctgtggctctgtgctgaagctgctgaacacccaccaccgggtgcggctgcacagccatgacatcaagtatggcagcggcagcggccagcagagcgtgactggagtggaggccagtgatgatgccaacagctactggaggatccggggcggcagcgagggcggctgcccccggggcagccctgtgcgctgtggccaggccgtgcggctgacccacgtgctgaccgggaagaacctgcacacccaccacttccccagccccctgagcaacaaccaggaggtgtctgcctttggagaagatggagaaggagatgacctggacctgtggacagtgcgctgcagcggccagcactgggagcgggaggccgctgtgcgcttccagcacgtgggcaccagcgtcttcctgtctgtgactggagagcagtatggcagccccatccggggccagcacgaggtgcacggcatgcccagcgccaacacccacaacacctggaaggccatggagggcatcttcatcaagcccagcgtggagcccagcgctggccatgatgagctgtag

SEQ ID NO: 171877 - DNA, 2058 bp, Artificial Sequence
  Description of Artificial Sequence: Synthetic coding sequence
atggatgtgtgtgtgcggctggccctgtggctgctgtggggcctgctgctgcaccagggccagagcctgagccacagccacagcgagaaggccaccggcaccagcagcggggccaacagcgaggagagcacagctgctgagttctgcagaattgacaagcccctgtgccacagtgaagatgagaagctgagctttgaagctgtgaggaacatccacaagctgatggatgatgatgccaatggagatgtggatgtggaggagagtgatgagttcctgcgggaggacctgaactaccatgaccccaccgtgaagcacagcaccttccatggagaggacaagctgatctctgtggaggacctgtggaaggcctggaagagcagcgaggtgtacaactggacagtggatgaggtggtgcagtggctgatcacctacgtggagctgccccagtatgaggagaccttcaggaagctgcagctgagcggccacgccatgccccggctggccgtgaccaacaccaccatgactggaacagtgctgaagatgacagacaggagccaccggcagaagctgcagctgaaggccctggacacagtgctgtttggcccccccctgctgaccaggcacaaccacctgaaggacttcatgctggtggtgtccatcgtcatcggcgtgggcggctgctggtttgcctacatccagaaccgctacagcaaggagcacatgaagaagatgatgaaggacctggagggcctgcacagagctgagcagagcctgcatgacctgcaggagcggctgcacaaggcccaggaggagcacaggacagtggaggtggagaaggtgcacctggagaagaagctgagagatgagatcaacctggccaagcaggaggcccagaggctgaaggagctgcgggagggcacagaaaatgaaagaagccggcagaagtatgcagaggaggagctggagcaggtgcgggaggccctgaggaaggccgagaaggagctggagagccacagctcctggtacgcccctgaggccctgcagaagtggctgcagctgacccatgaggtggaggtgcagtactacaacatcaagaagcagaatgctgagaagcagctgctggtggccaaggagggcgctgagaagatcaagaagaagaggaacaccctgtttggcaccttccacgtggcccacagcagcagcctggatgatgtggaccacaagatcctgacagccaagcaggccctgtctgaggtgacagctgccctgcgggagcggctgcaccgctggcagcagatcgagatcctgtgtggcttccagatcgtgaacaaccctggcatccacagcctggtggccgccctgaacatcgaccccagctggatgggcagcacccggcccaacccagcccacttcatcatgacagatgatgtggatgacatggatgaggagatcgtgagccccctgtccatgcagagccccagcctgcagagctctgtgcggcagaggctgacagagccccagcacggcctgggcagccagagggacctgacccacagcgacagcgagagcagcctgcacatgtctgaccggcagagggtggcccccaagccaccccagatgagcagagctgctgatgaggccctgaatgccatgaccagcaatggcagccacaggctcatcgagggcgtgcaccctggcagcctggtggagaagctgcctgacagccctgccctggccaagaaggccctgctggccctgaaccacggcctggacaaggcccacagcctgatggagctgagccccagcgcccctcctgggggcagcccccacctggacagcagccgcagccacagccccagcagcccagaccctgacacccccagccctgtgggggacagccgggccctgcaggccagcaggaacacccgcatcccccacctggccggcaagaaggctgtggccgaggaggacaatggcagcattggagaggagacagacagcagccctggcaggaagaagttccccctgaagatcttcaagaagcccctgaagaagtag

SEQ ID NO: 171878 - DNA, 2502 bp, Artificial Sequence
  Description of Artificial Sequence: Synthetic coding sequence
atgaatgctgctggcatccgggcccctgaggccgccggggctgatggcacccggctggcccctgggggcagcccctgcctgcggcggcggggccggcctgaggagagccctgctgctgtggtggcccccaggggggccggggagctgcaggccgccggggcccccctgcgcttccacccagccagcccccggcggctgcacccagccagcaccccaggccctgcctggggctggctgctgcggcggcggcgctgggccgccctgctggtgctgggcctgctggtggccggggctgctgatggctgtgagctggtgcccaggcacctgcggggccggcgggccactggatctgctgccacagctgccagcagccctgctgctgctgctggggacagccctgccctgatgacagacccctgcatgagcctgagccccccctgcttcacagaagaagatcgcttcagcctggaggccctgcagaccatccacaagcagatggatgatgacaaggatggcggcatcgaggtggaggagagtgatgagttcatccgggaggacatgaagtacaaggatgccaccaacaagcacagccacctgcaccgggaggacaagcacatcaccatcgaggacctgtggaagcgctggaagaccagcgaggtgcacaactggaccctggaggacaccctgcagtggctgattgaatttgtggagctgccccagtatgagaagaacttccgggacaacaacgtgaagggcaccaccctgcccagaattgctgtgcatgagcccagcttcatgatcagccagctgaagatcagtgacaggagccaccggcagaagctgcagctgaaggccctggatgtggtgctgtttggccccctgaccaggcctccccacaactggatgaaggacttcatcctgactgtgtccatcgtgattggagtgggcggctgctggtttgcctacacccagaacaagaccagcaaggagcacgtggccaagatgatgaaggacctggagagcctgcagacagctgagcagagcctgatggacctgcaggagcggctggagaaggcccaggaggagaacagaaatgtggccgtggagaagcagaacctggagaggaagatgatggatgagatcaactatgccaaggaggaggcctgccgcctgcgggagctgcgggagggcgcagaatgtgagctgagccggcggcagtatgcagagcaggagctggagcaggtgaggatggccctgaagaaggccgagaaggagtttgagctgcggagctcctggagcgtgcctgatgccctgcagaagtggctgcagctgacccatgaggtggaggtgcagtactacaacatcaagaggcagaatgctgagatgcagctggccatcgccaaggatgaagctgagaagatcaagaagaagaggagcacagtgtttggcaccctgcacgtggcccacagcagcagcctggatgaggtggaccacaagatcctggaggccaagaaggccctgtctgagctgaccacctgcctgcgggagcggctcttccgctggcagcagatcgagaagatctgtggcttccagatcgcccacaacagcggcctgcccagcctgaccagcagcctgtacagcgaccacagctgggtggtgatgccccgggtgtccatccccccctaccccatcgccggcggcgtggatgacctggatgaggacaccccacccatcgtgtcccagtttcctggcaccatggccaagcccccaggcagcctggcccggagcagcagcctgtgccgcagcagaagaagcatcgtgcccagcagcccccagccccagagggcccagctggcccctcatgccccccaccccagccaccccaggcacccccaccacccccagcacaccccccacagcctgcccagcccagaccctgacatcctgtctgtgagcagctgcccagccctgtacagaaatgaggaggaggaggaggccatctacttctctgctgagaagcagtgggaggtgcctgacacagcctctgaatgtgacagcctgaacagcagcattggaaggaagcagagcccccccctgagcctggagatctaccagaccctgagccccaggaagatcagcagagatgaggtgtccctggaggacagcagcagaggagacagccctgtgacagtggatgtgtcctggggcagcccagactgtgtgggcctgacagagaccaagtccatgatcttctccccagccagcaaggtgtacaacggcatcctggagaagagctgcagcatgaaccagctgagcagcggcatccctgtgcccaagcccaggcacaccagctgcagcagcgctggaaatgacagcaagcctgtgcaggaggcccccagcgtggcccgcatcagcagcatcccccatgacctgtgccacaacggggagaagagcaagaagcccagcaagatcaagagcctcttcaagaagaagagcaagtag

SEQ ID NO: 171879 - DNA, 2526 bp, Artificial Sequence
  Description of Artificial Sequence: Synthetic coding sequence
atgaatgctgctggcatccgggcccctgaggccgccggggctgatggcacccggctggcccctgggggcagcccctgcctgcggcggcggggccggcctgaggagagccctgctgctgtggtggcccccaggggggccggggagctgcaggccgccggggcccccctgcgcttccacccagccagcccccggcggctgcacccagccagcaccccaggccctgcctggggctggctgctgcggcggcggcgctgggccgccctgctggtgctgggcctgctggtggccggggctgctgatggctgtgagctggtgcccaggcacctgcggggccggcgggccactggatctgctgccacagctgccagcagccctgctgctgctgctggggacagccctgccctgatgacagacccctgcatgagcctgagccccccctgcttcacagaagaagatcgcttcagcctggaggccctgcagaccatccacaagcagatggatgatgacaaggatggcggcatcgaggtggaggagagtgatgagttcatccgggaggacatgaagtacaaggatgccaccaacaagcacagccacctgcaccgggaggacaagcacatcaccatcgaggacctgtggaagcgctggaagaccagcgaggtgcacaactggaccctggaggacaccctgcagtggctgattgaatttgtggagctgccccagtatgagaagaacttccgggacaacaacgtgaagggcaccaccctgcccagaattgctgtgcatgagcccagcttcatgatcagccagctgaagatcagtgacaggagccaccggcagaagctgcagctgaaggccctggatgtggtgctgtttggccccctgaccaggcctccccacaactggatgaaggacttcatcctgactgtgtccatcgtgattggagtgggcggctgctggtttgcctacacccagaacaagaccagcaaggagcacgtggccaagatgatgaaggacctggagagcctgcagacagctgagcagagcctgatggacctgcaggagcggctggagaaggcccaggaggagaacagaaatgtggccgtggagaagcagaacctggagaggaagatgatggatgagatcaactatgccaaggaggaggcctgccgcctgcgggagctgcgggagggcgcagaatgtgagctgagccggcggcagtatgcagagcaggagctggagcaggtgaggatggccctgaagaaggccgagaaggagtttgagctgcggagctcctggagcgtgcctgatgccctgcagaagtggctgcagctgacccatgaggtggaggtgcagtactacaacatcaagaggcagaatgctgagatgcagctggccatcgccaaggatgaggtggccgccagctacctgatccaggccgagaagatcaagaagaagaggagcacagtgtttggcaccctgcacgtggcccacagcagcagcctggatgaggtggaccacaagatcctggaggccaagaaggccctgtctgagctgaccacctgcctgcgggagcggctcttccgctggcagcagatcgagaagatctgtggcttccagatcgcccacaacagcggcctgcccagcctgaccagcagcctgtacagcgaccacagctgggtggtgatgccccgggtgtccatccccccctaccccatcgccggcggcgtggatgacctggatgaggacaccccacccatcgtgtcccagtttcctggcaccatggccaagcccccaggcagcctggcccggagcagcagcctgtgccgcagcagaagaagcatcgtgcccagcagcccccagccccagagggcccagctggcccctcatgccccccaccccagccaccccaggcacccccaccacccccagcacaccccccacagcctgcccagcccagaccctgacatcctgtctgtgagcagctgcccagccctgtacagaaatgaggaggaggaggaggccatctacttctctgctgagaagcagtgggaggtgcctgacacagcctctgaatgtgacagcctgaacagcagcattggaaggaagcagagcccccccctgagcctggagatctaccagaccctgagccccaggaagatcagcagagatgaggtgtccctggaggacagcagcagaggagacagccctgtgacagtggatgtgtcctggggcagcccagactgtgtgggcctgacagagaccaagtccatgatcttctccccagccagcaaggtgtacaacggcatcctggagaagagctgcagcatgaaccagctgagcagcggcatccctgtgcccaagcccaggcacaccagctgcagcagcgctggaaatgacagcaagcctgtgcaggaggcccccagcgtggcccgcatcagcagcatcccccatgacctgtgccacaacggggagaagagcaagaagcccagcaagatcaagagcctcttcaagaagaagagcaagtag

SEQ ID NO: 171880 - DNA, 2061 bp, Artificial Sequence
  Description of Artificial Sequence: Synthetic coding sequence
atgaatgctgctggcatccgggcccctgaggccgccggggctgatggcacccggctggcccctgggggcagcccctgcctgcggcggcggggccggcctgaggagagccctgctgctgtggtggcccccaggggggccggggagctgcaggccgccggggcccccctgcgcttccacccagccagcccccggcggctgcacccagccagcaccccaggccctgcctggggctggctgctgcggcggcggcgctgggccgccctgctggtgctgggcctgctggtggccggggctgctgatggctgtgagctggtgcccaggcacctgcggggccggcgggccactggatctgctgccacagctgccagcagccctgctgctgctgctggggacagccctgccctgatgacagacccctgcatgagcctgagccccccctgcttcacagaagaagatcgcttcagcctggaggccctgcagaccatccacaagcagatggatgatgacaaggatggcggcatcgaggtggaggagagtgatgagttcatccgggaggacatgaagtacaaggatgccaccaacaagcacagccacctgcaccgggaggacaagcacatcaccatcgaggacctgtggaagcgctggaagaccagcgaggtgcacaactggaccctggaggacaccctgcagtggctgattgaatttgtggagctgccccagtatgagaagaacttccgggacaacaacgtgaagggcaccaccctgcccagaattgctgtgcatgagcccagcttcatgatcagccagctgaagatcagtgacaggagccaccggcagaagctgcagctgaaggccctggatgtggtgctgtttggccccctgaccaggcctccccacaactggatgaaggacttcatcctgactgtgtccatcgtgattggagtgggcggctgctggtttgcctacacccagaacaagaccagcaaggagcacgtggccaagatgatgaaggacctggagagcctgcagacagctgagcagagcctgatggacctgcaggagcggctggagaaggcccaggaggagaacagaaatgtggccgtggagaagcagaacctggagaggaagatgatggatgagatcaactatgccaaggaggaggcctgccgcctgcgggagctgcgggagggcgcagaatgtgagctgagccggcggcagtatgcagagcaggagctggagcaggtgaggatggccctgaagaaggccgagaaggagtttgagctgcggagctcctggagcgtgcctgatgccctgcagaagtggctgcagctgacccatgaggtggaggtgcagtactacaacatcaagaggcagaatgctgagatgcagctggccatcgccaaggatgaagctgagaagatcaagaagaagaggagcacagtgtttggcaccctgcacgtggcccacagcagcagcctggatgaggtggaccacaagatcctggaggccaagaaggccctgtctgagctgaccacctgcctgcgggagcggctcttccgctggcagcagatcgagaagatctgtggcttccagatcgcccacaacagcggcctgcccagcctgaccagcagcctgtacagcgaccacagctgggtggtgatgccccgggtgtccatccccccctaccccatcgccggcggcgtggatgacctggatgaggacaccccacccatcgtgtcccagtttcctggcaccatggccaagcccccaggcagcctggcccggagcagcagcctgtgccgcagcagaagaagcatcgtgcccagcagcccccagccccagagggcccagctggcccctcatgccccccaccccagccaccccaggcacccccaccacccccagcacaccccccacagcctgcccagcccagaccctgacatcctgtctgtgagcagctgcccagccctgtacagaaatgaggaggaggaggaggccatctacttctctgctgagaagcagtgcatccacctgggcctgggcgcctgcaagtctgagtag

SEQ ID NO: 171881 - DNA, 2241 bp, Artificial Sequence
  Description of Artificial Sequence: Synthetic coding sequence
ctgctggtgctgggcctgctggtggccggggctgctgatggctgtgagctggtgcccaggcacctgcggggcagaagagccaccggcagcgctgccacagctgccagcagccctgctgctgctgctggggacagccctgccctgatgacagacccctgcatgagcctgagccccccctgcttcacagaggaggaccgcttcagcctggaggccctgcagaccatccacaagcagatggatgatgacaaggatggcggcatcgaggtggaggagagtgatgagttcatccgggaggacatgaagtacaaggatgccaccaacaagcacagccacctgcaccgggaggacaagcacatcaccatcgaggacctgtggaagcgctggaagaccagcgaggtgcacaactggaccctggaggacaccctgcagtggctgattgaatttgtggagctgccccagtatgagaagaacttccgggacaacaacgtgaagggcaccaccctgcccagaattgctgtgcatgagcccagcttcatgatcagccagctgaagatcagtgacaggagccaccggcagaagctgcagctgaaggccctggatgtggtgctgtttggccccctgacccggcccccccacaactggatgaaggacttcatcctgactgtgtccatcgtcatcggcgtgggcggctgctggtttgcctacacccagaacaagaccagcaaggagcacgtggccaagatgatgaaggacctggagagcctgcagacagctgagcagagcctgatggacctgcaggagcggctggagaaggcccaggaggagaacagaaatgtggccgtggagaagcagaacctggagaggaagatgatggatgagatcaactatgccaaggaggaggcctgccgcctgcgggagctgcgggagggcgcagaatgtgagctgagccggcggcagtatgcagagcaggagctggagcaggtgaggatggccctgaagaaggccgagaaggagtttgagctgcggagctcctggagcgtgcctgatgccctgcagaagtggctgcagctgacccatgaggtggaggtgcagtactacaacatcaagaggcagaatgctgagatgcagctggccatcgccaaggatgaggccgagaagatcaagaagaagaggagcacagtgtttggcaccctgcacgtggcccacagcagcagcctggatgaggtggaccacaagatcctggaggccaagaaggccctgtctgagctgaccacctgcctgcgggagcggctcttccgctggcagcagatcgagaagatctgtggcttccagatcgcccacaacagcggcctgcccagcctgaccagcagcctgtacagcgaccacagctgggtggtgatgccccgggtgtccatccccccctaccccatcgccggcggcgtggatgacctggatgaggacaccccacccatcgtgtcccagtttcctggcaccatggccaagcccccaggcagcctggcccggagcagcagcctgtgccgcagccgccgcagcatcgtgcccagcagcccccagccccagagggcccagctggccccccacgccccccaccccagccaccccaggcacccccaccacccccagcacaccccccacagcctgcccagcccagaccctgacatcctgtctgtgagcagctgcccagccctgtacagaaatgaggaggaggaggaggccatctacttctctgctgagaagcagtgggaggtgcctgacacagcctctgaatgtgacagcctgaacagcagcatcggcaggaagcagagcccccccctgagcctggagatctaccagaccctgagccccaggaagatcagcagagatgaggtgtccctggaggacagcagcagaggagacagccctgtgacagtggatgtgtcctggggcagcccagactgtgtgggcctgacagagaccaagtccatgatcttcagccctgccagcaaggtgtacaacggcatcctggagaagagctgcagcatgaaccagctgagcagcggcatccctgtgcccaagcccaggcacaccagctgcagcagcgctggaaatgacagcaagcctgtgcaggaggcccccagcgtggcccgcatcagcagcatcccccatgacctgtgccacaatggagagaagagcaagaagcccagcaagatcaagagcctcttcaagaagaagagcaagtag

SEQ ID NO: 171882 - DNA, 2265 bp, Artificial Sequence
  Description of Artificial Sequence: Synthetic coding sequence
ctgctggtgctgggcctgctggtggccggggctgctgatggctgtgagctggtgcccaggcacctgcggggcagaagagccaccggcagcgctgccacagctgccagcagccctgctgctgctgctggggacagccctgccctgatgacagacccctgcatgagcctgagccccccctgcttcacagaggaggaccgcttcagcctggaggccctgcagaccatccacaagcagatggatgatgacaaggatggcggcatcgaggtggaggagagtgatgagttcatccgggaggacatgaagtacaaggatgccaccaacaagcacagccacctgcaccgggaggacaagcacatcaccatcgaggacctgtggaagcgctggaagaccagcgaggtgcacaactggaccctggaggacaccctgcagtggctgattgaatttgtggagctgccccagtatgagaagaacttccgggacaacaacgtgaagggcaccaccctgcccagaattgctgtgcatgagcccagcttcatgatcagccagctgaagatcagtgacaggagccaccggcagaagctgcagctgaaggccctggatgtggtgctgtttggccccctgacccggcccccccacaactggatgaaggacttcatcctgactgtgtccatcgtcatcggcgtgggcggctgctggtttgcctacacccagaacaagaccagcaaggagcacgtggccaagatgatgaaggacctggagagcctgcagacagctgagcagagcctgatggacctgcaggagcggctggagaaggcccaggaggagaacagaaatgtggccgtggagaagcagaacctggagaggaagatgatggatgagatcaactatgccaaggaggaggcctgccgcctgcgggagctgcgggagggcgcagaatgtgagctgagccggcggcagtatgcagagcaggagctggagcaggtgaggatggccctgaagaaggccgagaaggagtttgagctgcggagctcctggagcgtgcctgatgccctgcagaagtggctgcagctgacccatgaggtggaggtgcagtactacaacatcaagaggcagaatgctgagatgcagctggccatcgccaaggatgaggtggccgccagctacctgatccaggccgagaagatcaagaagaagaggagcacagtgtttggcaccctgcacgtggcccacagcagcagcctggatgaggtggaccacaagatcctggaggccaagaaggccctgtctgagctgaccacctgcctgcgggagcggctcttccgctggcagcagatcgagaagatctgtggcttccagatcgcccacaacagcggcctgcccagcctgaccagcagcctgtacagcgaccacagctgggtggtgatgccccgggtgtccatccccccctaccccatcgccggcggcgtggatgacctggatgaggacaccccacccatcgtgtcccagtttcctggcaccatggccaagcccccaggcagcctggcccggagcagcagcctgtgccgcagccgccgcagcatcgtgcccagcagcccccagccccagagggcccagctggccccccacgccccccaccccagccaccccaggcacccccaccacccccagcacaccccccacagcctgcccagcccagaccctgacatcctgtctgtgagcagctgcccagccctgtacagaaatgaggaggaggaggaggccatctacttctctgctgagaagcagtgggaggtgcctgacacagcctctgaatgtgacagcctgaacagcagcatcggcaggaagcagagcccccccctgagcctggagatctaccagaccctgagccccaggaagatcagcagagatgaggtgtccctggaggacagcagcagaggagacagccctgtgacagtggatgtgtcctggggcagcccagactgtgtgggcctgacagagaccaagtccatgatcttcagccctgccagcaaggtgtacaacggcatcctggagaagagctgcagcatgaaccagctgagcagcggcatccctgtgcccaagcccaggcacaccagctgcagcagcgctggaaatgacagcaagcctgtgcaggaggcccccagcgtggcccgcatcagcagcatcccccatgacctgtgccacaatggagagaagagcaagaagcccagcaagatcaagagcctcttcaagaagaagagcaagtag

SEQ ID NO: 171883 - DNA, 1800 bp, Artificial Sequence
  Description of Artificial Sequence: Synthetic coding sequence
ctgctggtgctgggcctgctggtggccggggctgctgatggctgtgagctggtgcccaggcacctgcggggcagaagagccaccggcagcgctgccacagctgccagcagccctgctgctgctgctggggacagccctgccctgatgacagacccctgcatgagcctgagccccccctgcttcacagaggaggaccgcttcagcctggaggccctgcagaccatccacaagcagatggatgatgacaaggatggcggcatcgaggtggaggagagtgatgagttcatccgggaggacatgaagtacaaggatgccaccaacaagcacagccacctgcaccgggaggacaagcacatcaccatcgaggacctgtggaagcgctggaagaccagcgaggtgcacaactggaccctggaggacaccctgcagtggctgattgaatttgtggagctgccccagtatgagaagaacttccgggacaacaacgtgaagggcaccaccctgcccagaattgctgtgcatgagcccagcttcatgatcagccagctgaagatcagtgacaggagccaccggcagaagctgcagctgaaggccctggatgtggtgctgtttggccccctgacccggcccccccacaactggatgaaggacttcatcctgactgtgtccatcgtcatcggcgtgggcggctgctggtttgcctacacccagaacaagaccagcaaggagcacgtggccaagatgatgaaggacctggagagcctgcagacagctgagcagagcctgatggacctgcaggagcggctggagaaggcccaggaggagaacagaaatgtggccgtggagaagcagaacctggagaggaagatgatggatgagatcaactatgccaaggaggaggcctgccgcctgcgggagctgcgggagggcgcagaatgtgagctgagccggcggcagtatgcagagcaggagctggagcaggtgaggatggccctgaagaaggccgagaaggagtttgagctgcggagctcctggagcgtgcctgatgccctgcagaagtggctgcagctgacccatgaggtggaggtgcagtactacaacatcaagaggcagaatgctgagatgcagctggccatcgccaaggatgaggccgagaagatcaagaagaagaggagcacagtgtttggcaccctgcacgtggcccacagcagcagcctggatgaggtggaccacaagatcctggaggccaagaaggccctgtctgagctgaccacctgcctgcgggagcggctcttccgctggcagcagatcgagaagatctgtggcttccagatcgcccacaacagcggcctgcccagcctgaccagcagcctgtacagcgaccacagctgggtggtgatgccccgggtgtccatccccccctaccccatcgccggcggcgtggatgacctggatgaggacaccccacccatcgtgtcccagtttcctggcaccatggccaagcccccaggcagcctggcccggagcagcagcctgtgccgcagccgccgcagcatcgtgcccagcagcccccagccccagagggcccagctggccccccacgccccccaccccagccaccccaggcacccccaccacccccagcacaccccccacagcctgcccagcccagaccctgacatcctgtctgtgagcagctgcccagccctgtacagaaatgaggaggaggaggaggccatctacttctctgctgagaagcagtgcatccacctgggcctgggcgcctgcaagtctgagtag

SEQ ID NO: 171884 - DNA, 3654 bp, Artificial Sequence
  Description of Artificial Sequence: Synthetic coding sequence
atgtacatcaagcaggtgatcatccagggcttccgcagctacagagaccagaccatcgtggaccccttcagcagcaagcacaacgtcatcgtgggcagaaatggcagcggcaagagcaacttcttctacgccatccagtttgtgctgagtgatgagttcagccacctgcggcctgagcagaggctggccctgctgcacgagggcaccggccccagggtcatcagcgcctttgtggagatcatctttgacaacagcgacaaccggctgcccatcgacaaggaggaggtgtccctgcggcgggtcatcggggccaagaaggaccagtacttcctggacaagaagatggtgaccaagaatgatgtgatgaacctgctggagagcgctggcttcagccgcagcaacccctactacatcgtgaagcagggcaagatcaaccagatggccacagccccagacagccagaggctgaagctgctgcgggaggtggccggcaccagggtgtatgatgagaggaaggaggagagcatcagcctgatgaaggagacagagggcaagcgggagaagatcaatgagctgctgaagtacatcgaggagcggctgcacaccctggaggaggagaaggaggagctggcccagtaccagaagtgggacaagatgaggcgggccctggagtacaccatctacaaccaggagctgaatgagacccgggccaagctggatgagctgagcgccaagcgggagaccagcggggagaagagccggcagctgagagatgcccagcaggatgcccgggacaagatggaggacatcgagcggcaggtgcgggagctgaagaccaagatcagcgccatgaaggaggagaaggagcagctgtctgctgagcggcaggagcagatcaagcagaggaccaagctggagctgaaggccaaggacctgcaggatgagctggccggcaacagcgagcagaggaagaggctgctgaaggagcggcagaagctgctggagaagattgaggagaagcagaaggagctggccgagacagagcccaagttcaacagcgtgaaggagaaggaggagcggggcatcgcccggctggcccaggccacccaggagaggacagacctgtatgccaagcagggccggggcagccagttcaccagcaaggaggagcgggacaagtggatcaagaaggagctgaagagcctggaccaggccatcaatgacaagaagaggcagattgctgccatccacaaggacctggaggacacagaggccaacaaggagaagaacctggagcagtacaacaagctggaccaggacctgaatgaggtgaaggcccgggtggaggagctggacaggaagtactatgaggtgaagaacaagaaggatgagctgcagagcgagaggaactacctgtggagggaggagaatgctgagcagcaggccctggccgccaagcgggaggacctggagaagaagcagcagctgctgcgggccgccaccgggaaggccatcctgaatggaattgacagcatcaacaaggtgctggaccacttccggaggaagggcatcaaccagcacgtgcagaatggctaccatggaattgtgatgaacaactttgaatgtgagcccgccttctacacctgtgtggaggtgacagctggcaacagactcttctaccacatcgtggacagtgatgaggtgtccaccaagatcctgatggagttcaacaagatgaacctgcccggggaggtgaccttcctgcccctgaacaagctggatgtgcgggacacagcctacccagagaccaatgatgccatccccatgatcagcaagctgcgctacaaccccaggtttgacaaggccttcaagcacgtgtttgggaagaccctcatctgccgctccatggaggtgtccacccagctggcccgggccttcaccatggactgcatcaccctggagggggaccaggtgagccacagaggagccctgactggaggctactatgacaccaggaagagccggctggagctgcagaaggatgtgaggaaggccgaggaggagctgggggagctggaggccaagctgaatgaaaacctgcggaggaacatcgagcgcatcaacaatgaaattgaccagctgatgaaccagatgcagcagatcgagacccagcagaggaagttcaaggccagccgggacagcatcctgtctgagatgaagatgctgaaggagaagaggcagcagagcgagaagaccttcatgcccaagcagaggagcctgcagagcctggaggccagcctgcacgccatggagagcacccgggagagcctgaaggccgagctgggcacagacctgctgagccagctgagcctggaggaccagaagagggtggatgccctgaatgatgagatccggcagctgcagcaggagaaccggcagctgctgaatgaaagaatcaagctggagggcatcatcaccagggtggagacctacctgaatgaaaacctgaggaagaggctggaccaggtggagcaggagctgaatgagctgcgggagacagaaggaggcaccgtgctgacagccaccaccagcgagctggaggccatcaacaagagggtgaaggacaccatggcccggtctgaggacctggacaacagcattgacaagacagaggccggcatcaaggagctgcagaagtccatggagcgctggaagaacatggagaaggagcacatggatgccatcaaccacgacaccaaggagctggagaagatgaccaaccggcagggcatgctgctgaagaagaaggaggagtgcatgaagaagatccgggagctgggcagcctgccccaggaggcctttgagaagtaccagaccctgagcctgaagcagctgttcaggaagctggagcagtgcaacacagagctgaagaagtacagccacgtgaacaagaaggccctggaccagtttgtgaacttcagcgagcagaaggagaagctgatcaagaggcaggaggagctggaccggggctacaagagcatcatggagctgatgaatgtgctggagctgaggaaatatgaggccatccagctgaccttcaagcaggtgtccaagaacttcagcgaggtgttccagaagctggtgcctgggggcaaggccaccctggtgatgaagaagggagatgtggagggcagccagagccaggatgaaggagagggcagcggggagagcgagcggggcagcggcagccagagctctgtgcccagcgtggaccagttcaccggggtgggcatccgggtgtccttcaccgggaagcagggcgagatgagggagatgcagcagctgagcggcggccagaagagcctggtggccctggccctgatctttgccatccagaagtgtgaccctgcccccttctacctgtttgatgaaattgaccaggccctggatgcccagcacaggaaggctgtgtctgacatgatcatggagctggccgtgcacgcccagttcatcaccaccaccttccggcctgagctgctggagagcgctgacaagttctatggagtgaagttcaggaacaaggtgagccacattgatgtgatcacagctgagatggccaaggactttgtggaggatgacaccacccacggctag

SEQ ID NO: 171885 - DNA, 3306 bp, Artificial Sequence
  Description of Artificial Sequence: Synthetic coding sequence
atggccacccccagcaagaagaccagcacccccagcccccagcccagcaagagggccctgccccgggaccccagcagcgaggtgcccagcaagaggaagaacagcgccccccagctgcccctgctgcagagcagcggcccctttgtggagggcagcatcgtgcgcatctccatggagaacttcctgacctatgacatctgtgaggtgtccccaggcccccacctgaacatgattgtgggcgccaacggcaccgggaagagcagcatcgtgtgtgccatctgcctgggcctggccggcaagccagccttcatgggccgggctgacaaggtgggcttctttgtgaagaggggctgcagccggggcatggtggagattgagctgttccgggccagcggcaacctggtgatcacccgggagattgatgtggccaagaaccagagcttctggttcatcaacaagaagagcaccacccagaagatcgtggaggagaaggtggccgccctgaacatccaggtgggcaacctgtgccagttcctgccccaggacaaggtgggggagtttgccaagctgagcaagattgagctgctggaggccacagagaagagcatcggccccccagagatgcacaagtaccactgtgagctgaagaacctgcgggagaaggagaagcagctggagaccagctgcaaggagaagacagagtacctgcagaagatggtgcagagaaatgaaagatacaagcaggatgtggagcgcttctatgaaaggaagaggcacctggacctgattgagatgctggaggccaagaggccctgggtggagtatgaaaatgtgcggcaggagtatgaggaggtgaagctggtgcgggacagagtgaaggaggaggtgaggaagctgaaggagggccagatccctgtgacctgccgcatcgaggagatggagaatgaaagacacaacctggaggcccgcatcaaggagaaggccacagacatcaaggaggccagccagaagtgcaagcagaagcaggatgtgattgaaaggaaggacaagcacatcgaggagctgcagcaggccctgattgtgaagcagaatgaggagctggaccggcagaggagaattggcaacaccaggaagatgattgaggacctgcagaatgagctgaagaccacagagaactgtgagaacctgcagccccagattgatgccatcaccaatgacctgcggcgcatccaggatgagaaggccctgtgtgagggggagatcatcgacaagagaagagagcgggagaccctggagaaggagaagaagtctgtggatgaccacatcgtgcgctttgacaacctgatgaaccagaaggaggacaagctgcggcagcgcttccgggacacctatgatgctgtgctgtggctgaggaacaacagagacaagttcaagcagagggtgtgtgagcccatcatgctgaccatcaacatgaaggacaacaagaatgccaagtacatcgagaaccacatccccagcaatgacctgcgggcctttgtgtttgagagccaggaggacatggaggtgttcctgaaggaggtgcgggacaacaagaagctgcgggtgaatgctgtgattgcccccaagagcagctatgctgacaaggcccccagccgcagcctgaatgagctgaagcagtatggcttcttctcctacctgcgggagctgtttgatgccccagaccctgtgatgagctacctgtgctgccagtaccacatccacgaggtgcctgtgggcacagagaagacccgggagcgcatcgagagggtcatccaggagacccggctgaagcagatctacacagctgaggagaagtatgtggtgaagaccagcttctacagcaacaaggtgatcagcagcaacaccagcctgaaggtggcccagttcctgactgtgacagtggacctggagcagaggaggcacctggaggagcagctgaaggagatccacaggaagctgcaggccgtggacagcggcctcatcgccctgcgggagaccagcaagcacctggagcacaaggacaatgagctgcggcagaagaagaaggagctgctggagaggaagaccaagaagaggcagctggagcagaagatcagcagcaagctgggcagcctgaagctgatggagcaggacacctgcaacctggaggaggaggagaggaaggccagcaccaagatcaaggagatcaacgtgcagaaggccaagctggtgacagagctgaccaacctgatcaagatctgcaccagcctgcacatccagaaggtggacctgatcctgcagaacaccaccgtcatcagcgagaagaacaagctggagagtgactacatggccgccagcagccagctgcggctgacagagcagcacttcatcgagctggatgaaaatcggcagaggctgctgcagaagtgcaaggagctgatgaagagggcccggcaggtgtgcaacctgggcgctgagcagaccctgccccaggagtaccagacccaggtgcccaccatccccaacggccacaacagcagcctgcccatggtgttccaggacctgcccaacaccctggatgaaattgatgccctgctgacagaggagaggagccgggccagctgcttcaccggcctgaaccccaccatcgtgcaggagtacaccaagcgggaggaggagattgagcagctgacagaggagctgaagggcaagaaggtggagctggaccagtaccgggagaacatcagccaggtgaaggagcgctggctgaaccccctgaaggagctggtggagaagatcaatgagaagttcagcaacttcttcagctccatgcagtgtgccggggaggtggacctgcacacagaaaatgaggaggactatgacaagtatggcatccgcatccgggtgaagttccgcagcagcacccagctgcacgagctgaccccccaccaccagagcggcggggagaggtctgtgtccaccatgctgtacctgatggccctgcaggagctgaaccgctgccccttccgggtggtggatgagatcaaccagggcatggaccccatcaatgaaagaagagtgtttgagatggtggtgaacacagcctgcaaggagaacaccagccagtacttcttcatcacccccaagctgctgcagaacctgccctacagcgagaagatgacagtgctgtttgtgtacaacggcccccacatgctggagcccaacacctggaacctgaaggccttccagaggagaagaagacgcatcaccttcacccagcccagctag

SEQ ID NO: 171886 - DNA, 3276 bp, Artificial Sequence
  Description of Artificial Sequence: Synthetic coding sequence
atggccaagaggaaggaggagaacttcagcagccccaagaatgccaagaggccccggcaggaggagctggaggactttgacaaggatggagatgaagatgagtgcaagggcaccaccctgacagctgctgaggtgggcatcatcgagagcatccacctgaagaacttcatgtgccacagcatgctgggccccttcaagtttggcagcaatgtgaactttgtggtgggcaacaacggcagcggcaagtctgctgtgctgacagccctgattgtgggcctgggcggccgggctgtggccaccaacagaggcagcagcctgaagggctttgtgaaggatggccagaacagcgctgacatcagcatcaccctgaggaacagaggagatgatgccttcaaggcctctgtgtatggcaacagcatcctgatccagcagcacatcagcattgatggcagccgcagctacaagctgaagagcgccaccggctctgtggtgtccaccaggaaggaggagctgattgccatcctggaccacttcaacatccaggtggacaaccctgtgtctgtgctgacccaggagatgagcaagcagttcctgcagagcaagaatgaaggagacaagtacaagttcttcatgaaggccacccagctggagcagatgaaggaggactacagctacatcatggagaccaaggagaggaccaaggagcagatccaccagggcgaggagcggctgacagagctgaagaggcagtgtgtggagaaggaggagcgcttccagagcattgctggcctgagcaccatgaagaccaacctggagagcctgaagcatgagatggcctgggccgtggtgaatgaaattgagaagcagctgaatgccatccgggacaacatcaagattggagaagatcgggccgcccggctggacaggaagatggaggagcagcaggtgcggctgaatgaagctgagcagaagtacaaggacatccaggacaagctggagaagatcagcgaggagaccaatgcccgggcccctgagtgcatggccctgaaggcagatgtggtggccaagaagagggcctacaatgaagctgaggtgctgtacaacagaagcctgaatgagtacaaggccctgaagaaggatgatgagcagctgtgcaagagaattgaggagctgaagaagagcacagaccagagcctggagcctgagcggctggagcggcagaagaagatctcctggctgaaggagcgggtgaaggccttccagaaccaggagaacagcgtgaaccaggagattgagcagttccagcaggccatcgagaaggacaaggaggagcacggcaagatcaagcgggaggagctggatgtgaagcacgccctgagctacaaccagaggcagctgaaggagctgaaggacagcaagacagaccggctgaagcgcttcggccccaacgtgcctgccctgctggaggccattgatgatgcctaccggcagggccacttcacctacaagcctgtgggccccctgggcgcctgcatccacctgcgggaccctgagctggccctggccatcgagagctgcctgaagggcctgctgcaggcctactgctgccacaaccacgcagatgagcgggtgctgcaggccctgatgaagcgcttctacctgcccggcaccagccggccccccatcatcgtgtctgagttcagaaatgagatctatgatgtgcgccaccgggccgcctaccacccagacttccccaccgtgctgacagccctggagattgacaatgctgtggtggccaacagcctgattgacatgaggggcatcgagaccgtgctgctgatcaagaacaacagcgtggcccgggctgtgatgcagagccagaagccacccaagaactgccgggaggccttcaccgcagatggagaccaggtgtttgctggccgctactacagcagcgagaacacccggcccaagttcctgagcagagatgtggacagcgagatcagtgacctggagaatgaggtggagaacaagacagcccagatcctgaacctgcagcagcacctgagcgccctggagaaggacatcaagcacaatgaggagctgctgaagcgctgccagctgcactacaaggagctgaagatgaagatcaggaagaacatcagcgagatccgggagctggagaacatcgaggagcaccagagcgtggacatcgccaccctggaggatgaggcccaggagaacaagagcaagatgaagatggtggaggagcacatggagcagcagaaggagaacatggagcacctgaagagcctgaagattgaagctgagaacaagtatgatgccatcaagttcaagatcaaccagctgtctgagctggccgaccccctgaaggatgagctgaacctggccgacagcgaggtggacaaccagaagaggggcaagaggcactatgaggagaagcagaaggagcacctggacaccctgaacaagaagaagcgggagctggacatgaaggagaaggagctggaggagaagatgagccaggcccggcagatctgcccagagcgcatcgaggtggagaagagcgccagcatcctggacaaggagatcaaccggctgcggcagaagatccaggccgagcacgccagccatggagaccgggaggagatcatgaggcagtaccaggaggcccgggagacctacctggacctggacagcaaggtgaggaccctgaagaagttcatcaagctgctgggggagatcatggagcaccgcttcaagacctaccagcagttccgccgctgcctgaccctgcgctgcaagctgtactttgacaacctgctgagccagagggcctactgcggcaagatgaactttgaccacaagaatgagaccctgagcatctctgtgcagcctggagagggcaacaaggccgccttcaatgacatgagggccctgagcggcggggagaggagcttcagcacagtgtgcttcatcctgagcctgtggagcattgctgagagccccttccgctgcctggatgaatttgatgtgtacatggacatggtgaacagacgcatcgccatggacctgatcctgaagatggctgacagccagcgcttccggcagttcatcctgctgaccccccagagcatgagcagcctgcccagcagcaagctgatccgcatcctgaggatgtctgaccctgagcggggccagaccaccctgcccttccggcctgtgacccaggaggaggatgatgaccagaggtag

SEQ ID NO: 171887 - DNA, 3354 bp, Artificial Sequence
  Description of Artificial Sequence: Synthetic coding sequence
atggccaagaggaaggaggagaacttcagcagccccaagaatgccaagaggccccggcaggaggagctggaggactttgacaaggatggagatgaagatgagtgcaagggcaccaccctgacagctgctgaggtgggcatcatcgagagcatccacctgaagaacttcatgtgccacagcatgctgggccccttcaagtttggcagcaatgtgaactttgtggtgggcaacaacggctcctggagcgctgtggtgcgcagccggctgaatgccaccagcgccagccaggtgcaggccatcctgctcttccagccctgtgggaagtctgctgtgctgacagccctgattgtgggcctgggcggccgggctgtggccaccaacagaggcagcagcctgaagggctttgtgaaggatggccagaacagcgctgacatcagcatcaccctgaggaacagaggagatgatgccttcaaggcctctgtgtatggcaacagcatcctgatccagcagcacatcagcattgatggcagccgcagctacaagctgaagagcgccaccggctctgtggtgtccaccaggaaggaggagctgattgccatcctggaccacttcaacatccaggtggacaaccctgtgtctgtgctgacccaggagatgagcaagcagttcctgcagagcaagaatgaaggagacaagtacaagttcttcatgaaggccacccagctggagcagatgaaggaggactacagctacatcatggagaccaaggagaggaccaaggagcagatccaccagggcgaggagcggctgacagagctgaagaggcagtgtgtggagaaggaggagcgcttccagagcattgctggcctgagcaccatgaagaccaacctggagagcctgaagcatgagatggcctgggccgtggtgaatgaaattgagaagcagctgaatgccatccgggacaacatcaagattggagaagatcgggccgcccggctggacaggaagatggaggagcagcaggtgcggctgaatgaagctgagcagaagtacaaggacatccaggacaagctggagaagatcagcgaggagaccaatgcccgggcccctgagtgcatggccctgaaggcagatgtggtggccaagaagagggcctacaatgaagctgaggtgctgtacaacagaagcctgaatgagtacaaggccctgaagaaggatgatgagcagctgtgcaagagaattgaggagctgaagaagagcacagaccagagcctggagcctgagcggctggagcggcagaagaagatctcctggctgaaggagcgggtgaaggccttccagaaccaggagaacagcgtgaaccaggagattgagcagttccagcaggccatcgagaaggacaaggaggagcacggcaagatcaagcgggaggagctggatgtgaagcacgccctgagctacaaccagaggcagctgaaggagctgaaggacagcaagacagaccggctgaagcgcttcggccccaacgtgcctgccctgctggaggccattgatgatgcctaccggcagggccacttcacctacaagcctgtgggccccctgggcgcctgcatccacctgcgggaccctgagctggccctggccatcgagagctgcctgaagggcctgctgcaggcctactgctgccacaaccacgcagatgagcgggtgctgcaggccctgatgaagcgcttctacctgcccggcaccagccggccccccatcatcgtgtctgagttcagaaatgagatctatgatgtgcgccaccgggccgcctaccacccagacttccccaccgtgctgacagccctggagattgacaatgctgtggtggccaacagcctgattgacatgaggggcatcgagaccgtgctgctgatcaagaacaacagcgtggcccgggctgtgatgcagagccagaagccacccaagaactgccgggaggccttcaccgcagatggagaccaggtgtttgctggccgctactacagcagcgagaacacccggcccaagttcctgagcagagatgtggacagcgagatcagtgacctggagaatgaggtggagaacaagacagcccagatcctgaacctgcagcagcacctgagcgccctggagaaggacatcaagcacaatgaggagctgctgaagcgctgccagctgcactacaaggagctgaagatgaagatcaggaagaacatcagcgagatccgggagctggagaacatcgaggagcaccagagcgtggacatcgccaccctggaggatgaggcccaggagaacaagagcaagatgaagatggtggaggagcacatggagcagcagaaggagaacatggagcacctgaagagcctgaagattgaagctgagaacaagtatgatgccatcaagttcaagatcaaccagctgtctgagctggccgaccccctgaaggatgagctgaacctggccgacagcgaggtggacaaccagaagaggggcaagaggcactatgaggagaagcagaaggagcacctggacaccctgaacaagaagaagcgggagctggacatgaaggagaaggagctggaggagaagatgagccaggcccggcagatctgcccagagcgcatcgaggtggagaagagcgccagcatcctggacaaggagatcaaccggctgcggcagaagatccaggccgagcacgccagccatggagaccgggaggagatcatgaggcagtaccaggaggcccgggagacctacctggacctggacagcaaggtgaggaccctgaagaagttcatcaagctgctgggggagatcatggagcaccgcttcaagacctaccagcagttccgccgctgcctgaccctgcgctgcaagctgtactttgacaacctgctgagccagagggcctactgcggcaagatgaactttgaccacaagaatgagaccctgagcatctctgtgcagcctggagagggcaacaaggccgccttcaatgacatgagggccctgagcggcggggagaggagcttcagcacagtgtgcttcatcctgagcctgtggagcattgctgagagccccttccgctgcctggatgaatttgatgtgtacatggacatggtgaacagacgcatcgccatggacctgatcctgaagatggctgacagccagcgcttccggcagttcatcctgctgaccccccagagcatgagcagcctgcccagcagcaagctgatccgcatcctgaggatgtctgaccctgagcggggccagaccaccctgcccttccggcctgtgacccaggaggaggatgatgaccagaggtag

SEQ ID NO: 171888 - DNA, 3276 bp, Artificial Sequence; identical to SEQ ID NO: 171886
  Description of Artificial Sequence: Synthetic coding sequence

SEQ ID NO: 171889 - DNA, 174 bp, Artificial Sequence
  Description of Artificial Sequence: Synthetic coding sequence
atggccaagaggaaggaggagaacttcagcagccccaagaatgccaagaggccccggcaggaggagctggaggactttgacaaggatggagatgaagatgagtgcaagggcaccaccctgacagctgctgaggtgggcatcatcgagagcatccacctgaagaacttcatgtag

SEQ ID NO: 171890 - DNA, 3276 bp, Artificial Sequence; identical to SEQ ID NO: 171886
  Description of Artificial Sequence: Synthetic coding sequence

SEQ ID NO: 171891 - DNA, 2130 bp, Artificial Sequence
  Description of Artificial Sequence: Synthetic coding sequence
atggccgagaccctggagttcaatgatgtgtaccaggaggtgaagggctccatgaatgatggccgcctgcggctgagccggcagggcatcatcttcaagaacagcaagacaggcaaggtggacaacatccaggccggggagctgacagagggcatctggaggagagtggccctgggccacggcctgaagctgctgaccaagaatggccacgtgtacaagtatgatggcttccgggagagcgagtttgagaagctgagtgacttcttcaagacccactaccgcctggagctgatggagaaggacctgtgtgtgaagggctggaactggggcaccgtgaagtttggaggccagctgctgagctttgatattggagaccagcctgtgtttgagatccccctgagcaatgtgtcccagtgcaccaccgggaagaatgaggtgaccctggagttccaccagaatgatgatgctgaggtgtccctgatggaggtgcgcttctacgtgccccccacccaggaggatggagtggaccctgtggaggcctttgcccagaatgtgctgagcaaggcagatgtgatccaggccactggagatgccatctgcatcttccgggagctgcagtgcctgaccccccggggccgctatgacatccgcatctaccccaccttcctgcacctgcacggcaagacctttgactacaagatcccctacaccaccgtgctgcggctcttcctgctgccccacaaggaccagaggcagatgttctttgtgatcagcctggacccccccatcaagcagggccagacccgctaccacttcctgatcctgctcttcagcaaggatgaggacatcagcctgaccctgaacatgaatgaggaggaggtggagaagagatttgagggccgcctgaccaagaacatgagcggcagcctgtatgagatggtgtcccgggtgatgaaggccctggtgaacaggaagatcaccgtgcccggcaacttccagggccacagcggggcccagtgcatcacctgcagctacaaggccagcagcggcctgctgtaccccctggagcggggcttcatctacgtgcacaagccccctgtgcacatccgctttgatgagatcagctttgtgaactttgcccggggcaccaccaccaccaggagctttgattttgaaattgagaccaagcagggcacccagtacaccttcagcagcattgaaagagaggagtatggcaagctgtttgattttgtgaatgccaagaagctgaacatcaagaacagaggcctgaaggagggcatgaaccccagctatgatgaatatgctgacagtgatgaggaccagcatgatgcctacctggagaggatgaaggaggagggcaagatccgggaggagaatgccaatgacagcagtgatgacagcggggaggagacagatgagagcttcaaccctggagaggaggaggaggatgtggccgaggagtttgacagcaatgccagcgccagcagcagcagcaatgaaggagacagcgacagagatgagaagaagaggaagcagctgaagaaggccaagatggccaaggacaggaagagcaggaagaagcctgtggaggtgaagaagggcaaggaccccaatgcccccaagaggcccatgtctgcctacatgctgtggctgaatgccagccgggagaagatcaagagtgaccaccctggcatcagcatcacagacctgagcaagaaggccggggagatctggaagggcatgagcaaggagaagaaggaggagtgggacaggaaggcagaagatgcccggcgggactatgagaaggccatgaaggagtatgagggcggccgcggggagagcagcaagagggacaagagcaagaagaagaagaaggtgaaggtgaagatggagaagaagagcacccccagccggggcagcagcagcaagagcagcagccggcagctgtctgagagcttcaagagcaaggagtttgtgtccagtgatgagagcagcagtggagagaacaagagcaagaagaagagaagaagaagtgaggacagcgaggaggaggagctggccagcaccccacccagcagtgaagattctgccagcggcagtgatgaatag

SEQ ID NO: 171892 - DNA, 240 bp, Artificial Sequence
  Description of Artificial Sequence: Synthetic coding sequence
atgaagagcctgacctggatcctgggcctgtgggccctggccgcctgcttcaccccaggagagagccagaggggcccccggggcccctacccacctggccccctggccccaccccagccctttggacctggctttgtgcccccacctcctcctccaccctacggccctggccgcatccccccacctcctccagccccctacggccctggcatcttccccccacctccaccccagccctag

SEQ ID NO: 171893 - DNA, 324 bp, Artificial Sequence
  Description of Artificial Sequence: Synthetic coding sequence
atgaagagcctgacctggatcctgggcctgtgggccctggccgcctgcttcaccccaggagagagccagaggggcccccggggcccctacccacctggccccctggccccaccccagccctttggacctggctttgtgcccccacctcctcctccaccctacggccctggccgcatccccccaccaccctacagctgcacccccaacatgaacaactgcagccgctgccaccaccaccacaagaggcaccactacccctgcaactactgcttctactaccccaagtatgagttccagcactgcttccaggagaccttcacctag

SEQ ID NO: 171894 - DNA, 240 bp, Artificial Sequence; identical to SEQ ID NO: 171892
  Description of Artificial Sequence: Synthetic coding sequence

SEQ ID NO: 171895 - DNA, 348 bp, Artificial Sequence
  Description of Artificial Sequence: Synthetic coding sequence
atgagccgccacagccggctgcagaggcaggtgctgagcctgtacagagacctgctgcgggccggccggggcaagccaggagctgaggcccgggtgcgggcagagttccggcagcacgccggcctgcccaggagtgatgtgctgcgcatcgagtacctgtacagaagaggccggcggcagctgcagctgctgcggagcggccacgccacagccatgggcgcctttgtgcggccccgggcccccaccggggagcctggaggagtgggctgccagccagatgatggagacagccccaggaacccccatgacagcactggagcccctgagaccaggccagatggaagatag

SEQ ID NO: 171896 - DNA, 501 bp, Artificial Sequence
  Description of Artificial Sequence: Synthetic coding sequence
atggctgtgtccacagtgttcagcaccagcagcctgatgctggccctgagccgccacagcctgctgagccccctgctgtctgtgaccagcttccgccgcttctacagaggagacagccccacagacagccagaaggacatgattgagatccccctgcccccctggcaggagaggacagatgagagcattgagaccaagagggcccggctgctgtatgagagcaggaagaggggcatgctggagaactgcatcctgctgagcctgtttgccaaggagcacctgcagcacatgacagagaagcagctgaacctgtatgacaggctcatcaatgagcccagcaatgactgggacatctactactgggccacagaggccaagccagcccctgagatctttgaaaatgaggtgatggccctgctgcgggactttgccaagaacaagaacaaggagcagaggctgcgggccccagacctggagtacctgtttgagaagcccaggtag

SEQ ID NO: 171897 - DNA, 843 bp, Artificial Sequence
  Description of Artificial Sequence: Synthetic coding sequence
atggctgctgtggtggccctgagcctgcggcggcggctgcctgccaccaccctgggcggggcctgcctgcaggccagcagaggagcccagacagctgctgccacagccccccgcatcaagaagtttgccatctaccgctgggaccctgacaaggccggggacaagccccacatgcagacctatgaggtggacctgaacaagtgtggccccatggtgctggatgccctgatcaagatcaagaatgaggtggacagcaccctgaccttccgccgcagctgccgggagggcatctgtggcagctgtgccatgaacatcaatggaggcaacaccctggcctgcaccaggagaattgacaccaacctgaacaaggtgtccaagatctaccccctgccccacatgtatgtgatcaaggacctggtgcctgacctgagcaacttctacgcccagtacaagagcattgagccctacctgaagaagaaggatgagagccaggagggcaagcagcagtacctgcagagcattgaggagcgggagaagctggatggcctgtatgagtgcatcctgtgtgcctgctgcagcaccagctgccccagctactggtggaatggagacaagtacctgggccctgctgtgctgatgcaggcctaccgctggatgattgacagcagagatgacttcacagaggagcggctggccaagctgcaggaccccttcagcctgtaccgctgccacaccatcatgaactgcaccaggacctgccccaagggcctgaaccctgggaaggccatcgccgagatcaagaagatgatggccacctacaaggagaagaaggcctctgtgtag

SEQ ID NO: 171898 - DNA, 453 bp, Artificial Sequence
  Description of Artificial Sequence: Synthetic coding sequence
atggccgccctgctgctgcggcacgtgggccgccactgcctgcgggcccacttcagcccccagctgtgcatcagaaatgctgtgcccctgggcaccacagccaaggaggagatggagcgcttctggaacaagaacatcggcagcaaccggcccctgagcccccacatcaccatctacagctggagcctgcccatggccatgagcatctgccaccggggcaccggcatcgccctgtctgcagatgtgggccccaggaagaggcctgaggacagccctgccatccctgtgtggagcggctgccccggcagctactgtgtggtgctgtatggagctggcagccacgtgaagaagggcggcagccagcaccacctgcccacccactactacatccaccccagcttctgcctgtccttcctgagccctgcctgggagaagttcagcctgtttgtgtag

SEQ ID NO: 171899 - DNA, 510 bp, Artificial Sequence
  Description of Artificial Sequence: Synthetic coding sequence
atggccgccctgctgctgcggcacgtgggccgccactgcctgcgggcccacttcagcccccagctgtgcatcagaaatgctgtgcccctgggcaccacagccaaggaggagatggagcgcttctggaacaagaacatcggcagcaaccggcccctgagcccccacatcaccatctacagctggagcctgcccatggccatgagcatctgccaccggggcaccggcatcgccctgtctgctggggtgtccctgtttggcatgtctgccctgctgctgcccggcaactttgagagctacctggagctggtgaagagcctgtgcctgggccctgccctgatccacacagccaagtttgccctggtgttccccctgatgtaccacacctggaatggcatccgccacctgatgtgggacctgggcaagggcctgaagatcccccagctgtaccagagcggcgtggtggtgctggtgctgactgtgctgagctccatgggcctggccgccatgtag

SEQ ID NO: 171900 - DNA, 351 bp, Artificial Sequence
  Description of Artificial Sequence: Synthetic coding sequence
atggccgccctgctgctgtcctggagcctgcccatggccatgagcatctgccaccggggcactggaattgccctgtctgctggggtgtccctgtttggcatgtctgccctgctgctgcccggcaactttgagagctacctggagctggtgaagagcctgtgcctgggccctgccctgatccacacagccaagtttgccctggtgttccccctgatgtaccacacctggaatggcatccgccacctgatgtgggacctgggcaagggcctgaagatcccccagctgtaccagagcggcgtggtggtgctggtgctgactgtgctgagctccatgggcctggccgccatgtag

SEQ ID NO: 171901 - DNA, 408 bp, Artificial Sequence
  Description of Artificial Sequence: Synthetic coding sequence
atggccgccctgctgctgcggcacgtgggccgccactgcctgcgggcccacttcagcccccagctgtgcatccggaactggagcctgcccatggccatgagcatctgccaccggggcaccggcatcgccctgtctgctggggtgtccctgtttggcatgtctgccctgctgctgcccggcaactttgagagctacctggagctggtgaagagcctgtgcctgggccctgccctgatccacacagccaagtttgccctggtgttccccctgatgtaccacacctggaatggcatccgccacctgatgtgggacctgggcaagggcctgaagatcccccagctgtaccagagcggcgtggtggtgctggtgctgactgtgctgagctccatgggcctggccgccatgtag

SEQ ID NO: 171902 - DNA, 480 bp, Artificial Sequence
  Description of Artificial Sequence: Synthetic coding sequence
atggctgtgctgtggaggctgtctgctgtgtgtggggccctgggcggccgggccctgctgctgcggacccctgtggtgcggcctgcccacatcagcgccttcctgcaggaccggcccatccctgagtggtgtggggtgcagcacatccacctgagccccagccaccacagcggcagcaaggccgccagcctgcactggaccagcgagcgggtggtgtctgtgctgctgctgggcctgctgcctgctgcctacctgaacccctgcagcgccatggactacagcctggccgccgccctgaccctgcacggccactggggcctgggccaggtggtgacagattatgtgcatggagatgccctgcagaaggccgccaaggccggcctgctggccctgagcgccctgacctttgctggcctgtgctacttcaactaccatgatgtgggcatctgcaaggctgtggccatgctgtggaagctgtag

SEQ ID NO: 171903 - DNA, 465 bp, Artificial Sequence
  Description of Artificial Sequence: Synthetic coding sequence
atggccgcctccatgttttatggccgcctggtggccgtggccaccctgaggaaccaccggcccaggacagcccagagagctgctgcccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaagtag

SEQ ID NO: 171904 - DNA, 897 bp, Artificial Sequence
  Description of Artificial Sequence: Synthetic coding sequence
tctggccggggccaccccagcgagcccccagccagtgatggccctgctggctgctgcagcggcagcaaggatgtggtgatcaaggcccaggtgctggccggcggccggggcaagggcacctttgaaagtggcctgaagggcggcgtgaagatcgtgttcagccctgaggaggccaaggctgtgagcagccagatgattggcaagaagctgttcaccaagcagacaggagagaagggccgcatctgcaaccaggtgctggtgtgtgagaggaagtacccccggcgggagtactactttgccatcaccatggagaggagcttccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaaggatgctgccaaggccaacctgaactacatcggcctggatggcaacatcggctgcctggtgaatggagctggcctggccatggccaccatggacatcatcaagctgcacggcggcaccccagccaacttcctggatgtgggcggcggggccaccgtgcaccaggtgacagaggccttcaagctgatcaccagtgacaagtag

SEQ ID NO: 171905 - DNA, 1326 bp, Artificial Sequence
  Description of Artificial Sequence: Synthetic coding sequence
atggccgcctccatgttttatggccgcctggtggccgtggccaccctgaggaaccaccggcccaggacagcccagcagcagcagaggaacctgagcctgcacgagtacatgtccatggagctgctgcaggaggccggcgtgtctgtgcccaagggctacgtggccaagagcccagatgaggcctatgccatcgccaagaagctgggcagcaaggatgtggtgatcaaggcccaggtgctggccggcggccggggcaagggcacctttgaaagtggcctgaagggcggcgtgaagatcgtgttcagccctgaggaggccaaggctgtgagcagccagatgattggcaagaagctgttcaccaagcagacaggagagaagggccgcatctgcaaccaggtgctggtgtgtgagaggaagtacccccggcgggagtactactttgccatcaccatggagaggagcttccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaaggatgctgccaaggccaacctgaactacatcggcctggatggcaacatcggctgcctggtgaatggagctggcctggccatggccaccatggacatcatcaagctgcacggcggcaccccagccaacttcctggatgtgggcggcggggccaccgtgcaccaggtgacagaggccttcaagctgatcaccagtgacaagaaggtgctggccatcctggtgaacatctttggaggcatcatgagatgtgatgtgattgcccagggcatcgtgatggctgtgaaggacctggagatcaagatccctgtggtggtgcggctgcagggcaccagggtggatgatgccaaggccctgattgctgacagcggcctgaagatcctggcctgtgatgacctggatgaggccgccaggatggtggtgaagctgtctgagatcgtgaccctggccaagcaggcccacgtggatgtgaagttccagctgcccatctag

SEQ ID NO: 171906 - DNA, 1392 bp, Artificial Sequence
  Description of Artificial Sequence: Synthetic coding sequence
atggccgcctccatgttttatggccgcctggtggccgtggccaccctgaggaaccaccggcccaggacagcccagagagctgctgcccaggtgctgggcagcagcggcctcttcaacaaccacggcctgcaggtgcagcagcagcagcagaggaacctgagcctgcacgagtacatgtccatggagctgctgcaggaggccggcgtgtctgtgcccaagggctacgtggccaagagcccagatgaggcctatgccatcgccaagaagctgggcagcaaggatgtggtgatcaaggcccaggtgctggccggcggccggggcaagggcacctttgaaagtggcctgaagggcggcgtgaagatcgtgttcagccctgaggaggccaaggctgtgagcagccagatgattggcaagaagctgttcaccaagcagacaggagagaagggccgcatctgcaaccaggtgctggtgtgtgagaggaagtacccccggcgggagtactactttgccatcaccatggagaggagcttccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaaggatgctgccaaggccaacctgaactacatcggcctggatggcaacatcggctgcctggtgaatggagctggcctggccatggccaccatggacatcatcaagctgcacggcggcaccccagccaacttcctggatgtgggcggcggggccaccgtgcaccaggtgacagaggccttcaagctgatcaccagtgacaagaaggtgctggccatcctggtgaacatctttggaggcatcatgagatgtgatgtgattgcccagggcatcgtgatggctgtgaaggacctggagatcaagatccctgtggtggtgcggctgcagggcaccagggtggatgatgccaaggccctgattgctgacagcggcctgaagatcctggcctgtgatgacctggatgaggccgccaggatggtggtgaagctgtctgagatcgtgaccctggccaagcaggcccacgtggatgtgaagttccagctgcccatctag

SEQ ID NO: 171907 - DNA, 1218 bp, Artificial Sequence
  Description of Artificial Sequence: Synthetic coding sequence
atgtccatggagctgctgcaggaggccggcgtgtctgtgcccaagggctacgtggccaagagcccagatgaggcctatgccatcgccaagaagctgggcagcaaggatgtggtgatcaaggcccaggtgctggccggcggccggggcaagggcacctttgaaagtggcctgaagggcggcgtgaagatcgtgttcagccctgaggaggccaaggctgtgagcagccagatgattggcaagaagctgttcaccaagcagacaggagagaagggccgcatctgcaaccaggtgctggtgtgtgagaggaagtacccccggcgggagtactactttgccatcaccatggagaggagcttccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaaggatgctgccaaggccaacctgaactacatcggcctggatggcaacatcggctgcctggtgaatggagctggcctggccatggccaccatggacatcatcaagctgcacggcggcaccccagccaacttcctggatgtgggcggcggggccaccgtgcaccaggtgacagaggccttcaagctgatcaccagtgacaagaaggtgctggccatcctggtgaacatctttggaggcatcatgagatgtgatgtgattgcccagggcatcgtgatggctgtgaaggacctggagatcaagatccctgtggtggtgcggctgcagggcaccagggtggatgatgccaaggccctgattgctgacagcggcctgaagatcctggcctgtgatgacctggatgaggccgccaggatggtggtgaagctgtctgagatcgtgaccctggccaagcaggcccacgtggatgtgaagttccagctgcccatctag

SEQ ID NO: 171908 - DNA, 876 bp, Artificial Sequence
  Description of Artificial Sequence: Synthetic coding sequence
atggagaggagcttccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaaggatgctgccaaggccaacctgaactacatcggcctggatggcaacatcggctgcctggtgaatggagctggcctggccatggccaccatggacatcatcaagctgcacggcggcaccccagccaacttcctggatgtgggcggcggggccaccgtgcaccaggtgacagaggccttcaagctgatcaccagtgacaagaaggtgctggccatcctggtgaacatctttggaggcatcatgagatgtgatgtgattgcccagggcatcgtgatggctgtgaaggacctggagatcaagatccctgtggtggtgcggctgcagggcaccagggtggatgatgccaaggccctgattgctgacagcggcctgaagatcctggcctgtgatgacctggatgaggccgccaggatggtggtgaagctgtctgagatcgtgaccctggccaagcaggcccacgtggatgtgaagttccagctgcccatctag

SEQ ID NO: 171909 - DNA, 1218 bp, Artificial Sequence; identical to SEQ ID NO: 171907
  Description of Artificial Sequence: Synthetic coding sequence

SEQ ID NO: 171910 - DNA, 990 bp, Artificial Sequence
  Description of Artificial Sequence: Synthetic coding sequence
atgattggcaagaagctgttcaccaagcagacaggagagaagggccgcatctgcaaccaggtgctggtgtgtgagaggaagtacccccggcgggagtactactttgccatcaccatggagaggagcttccagggccctgtgctgattggcagcagccatggaggagtgaacattgaagatgtggccgctgagagccctgaggccatcatcaaggagcccatcgacatcgaggagggcatcaagaaggagcaggccctgcagctggcccagaagatgggcttcccccccaacatcgtggagagcgctgctgagaacatggtgaagctgtacagcctcttcctgaagtatgatgccaccatgattgagatcaaccccatggtggaggacagtgatggagctgtgctgtgcatggatgccaagatcaactttgacagcaacagcgcctaccggcagaagaagatctttgacctgcaggactggacccaggaggatgagcgggacaaggatgctgccaaggccaacctgaactacatcggcctggatggcaacatcggctgcctggtgaatggagctggcctggccatggccaccatggacatcatcaagctgcacggcggcaccccagccaacttcctggatgtgggcggcggggccaccgtgcaccaggtgacagaggccttcaagctgatcaccagtgacaagaaggtgctggccatcctggtgaacatctttggaggcatcatgagatgtgatgtgattgcccagggcatcgtgatggctgtgaaggacctggagatcaagatccctgtggtggtgcggctgcagggcaccagggtggatgatgccaaggccctgattgctgacagcggcctgaagatcctggcctgtgatgacctggatgaggccgccaggatggtggtgaagctgtctgagatcgtgaccctggccaagcaggcccacgtggatgtgaagttccagctgcccatctag

SEQ ID NO: 171911 - DNA, 1041 bp, Artificial Sequence
  Description of Artificial Sequence: Synthetic coding sequence
atgacagccaccctggccgctgctgctgacatcgccaccatggtgtctggcagcagcggcctggccgccgcccggctgctgagccgctccttcctgctgccccagaatggcatccgccactgcagctacacagccagccggcagcacctgtatgtggacaagaacaccaagatcatctgccagggcttcaccgggaagcagggcaccttccacagccagcaggccctggagtatggcaccaagctggtgggcggcaccacccctgggaagggcggccagacccacctgggcctgcctgtgttcaacacagtgaaggaggccaaggagcagacaggagccacagccagcgtcatctacgtgcccccaccatttgctgctgctgccatcaatgaggccattgaagctgagatccccctggtggtgtgcatcacagagggcatcccccagcaggacatggtgcgggtgaagcacaagctgctgcggcaggagaagaccaggctcatcggccccaactgccctggggtcatcaaccctggagagtgcaagattggcatcatgcctggccacatccacaagaagggccgcatcggcatcgtgagccgcagcggcaccctgacctatgaagctgtgcaccagaccacccaggtgggcctgggccagagcctgtgtgtgggcatcggcggggaccccttcaacggcacagacttcatcgactgcctggagatcttcctgaatgattctgccacagagggcatcatcctgattggagagatcggcggcaatgctgaggagaatgctgctgagttcctgaagcagcacaacagcggccccaacagcaagcctgtggtgtccttcatcgccggcctgacagcccctcctggaagaaggatgggccacgccggggccatcatcgccggcggcaagggcggggccaaggagaagatcagcgccctgcagagcgctggggtggtggtgtccatgagccctgcccagctgggcaccaccatctacaaggagtttgagaagaggaagatgctgtag

SEQ ID NO: 171912 - DNA, 5484 bp, Artificial Sequence
  Description of Artificial Sequence: Synthetic coding sequence
atggccaggaagaagttcagcggcctggagatcagcctcatcgtgctgtttgtgattgtgaccatcatcgccatcgccctgattgtggtgctggccaccaagaccccagctgtggatgagatcagtgacagcaccagcaccccagccaccaccagggtgaccaccaaccccagcgacagcggcaagtgccccaacgtgctgaatgaccctgtgaatgtgcgcatcaactgcatccctgagcagttccccacagagggcatctgtgcccagaggggctgctgctggaggccctggaatgacagcctcatcccctggtgcttctttgtggacaaccacggctacaacgtgcaggacatgaccaccaccagcattggagtggaggccaagctgaaccgcatccccagccccaccctgtttggaaatgacatcaacagcgtgctcttcaccacccagaaccagacccccaaccgcttccgcttcaagatcacagaccccaacaacagaagatatgaggtgccccaccagtatgtgaaggagttcaccggccccaccgtgtctgacaccctgtatgatgtgaaggtggcccagaaccccttcagcatccaggtgatcaggaagagcaatggcaagaccctgtttgacaccagcatcggccccctggtgtacagcgaccagtacctgcagatcagcacccggctgcccagcgactacatctatggaattggagagcaggtgcacaagcgcttcagacatgacctgtcctggaagacctggcccatcttcacccgggaccagctgcccggggacaacaacaacaacctgtatggccaccagaccttcttcatgtgcatcgaggacaccagcggcaagagctttggagtcttcctgatgaacagcaatgccatggagatcttcatccagcccacccccatcgtgacctacagagtgactggaggcatcctggacttctacatcctgctgggggacaccccagagcaggtggtgcagcagtaccagcagctggtgggcctgcctgccatgcctgcctactggaacctgggcttccagctgagccgctggaactacaagagcctggatgtggtgaaggaggtggtgagaagaaaccgggaggccggcatcccctttgacacccaggtgacagacatcgactacatggaggacaagaaggacttcacctatgaccaggtggccttcaacggcctgccccagtttgtgcaggacctgcatgaccacggccagaagtatgtgatcatcctggaccctgccatcagcatcggccggcgggccaacggcaccacctacgccacctatgaaagaggcaacacccagcacgtgtggatcaatgaaagtgatggcagcacccccatcatcggggaggtgtggccaggcctgactgtgtacccagacttcaccaaccccaactgcatcgactggtgggccaatgaatgttccatcttccaccaggaggtgcagtatgatggcctgtggattgacatgaatgaggtgtcctccttcatccagggcagcaccaagggctgcaatgtgaacaagctgaactacccacccttcaccccagacatcctggacaagctgatgtacagcaagaccatctgcatggatgctgtgcagaactggggcaagcagtatgatgtgcacagcctgtatggctacagcatggccatcgccacagagcaggccgtgcagaaggtgttccccaacaagaggagcttcatcctgaccaggagcacctttgctggcagcggcagacatgctgcccactggctgggggacaacacagcctcctgggagcagatggagtggagcatcaccggcatgctggagttcagcctgtttggcatccccctggtgggcgctgacatctgtggctttgtggccgagaccacagaggagctgtgccgccgctggatgcagctgggcgccttctaccccttcagcaggaaccacaacagtgatggctatgagcaccaggaccctgccttcttcggccagaacagcctgctggtgaagagcagccggcagtacctgaccatccgctacaccctgctgcccttcctgtacaccctcttctacaaggcccacgtgtttggagagaccgtggcccggcctgtgctgcacgagttctatgaggacaccaacagctggattgaggacacagagttcctgtggggccctgccctgctgatcacccctgtgctgaagcagggcgctgacacagtgtctgcctacatcccagatgccatctggtatgactatgaaagtggggccaagaggccctggaggaagcagagggtggacatgtacctgcctgctgacaagattggcctgcacctgcggggcggctacatcatccccatccaggagccagatgtgaccaccacagccagcaggaagaaccccctgggcctgattgtggccctgggggagaacaacacagccaagggggacttcttctgggatgatggagagaccaaggacaccatccagaatggaaactacatcctgtacaccttctctgtgagcaacaacaccctggacatcgtgtgcacccacagcagctaccaggagggcaccaccctggccttccagacagtgaagatcctgggcctgacagacagcgtgacagaggtgcgggtggccgagaacaaccagcccatgaatgcccacagcaacttcacctatgatgccagcaaccaggtgctgctgattgctgacctgaagctgaacctgggcaggaacttctctgtgcagtggaaccagatcttctctgaaaatgaacgcttcaactgctacccagatgctgacctggccacagagcagaagtgcacccagaggggctgtgtgtggaggacaggcagcagcctgagcaaggcccctgagtgctacttcccccggcaggacaacagctacagcgtgaacagcgcccgctacagctccatgggcatcacagctgacctgcagctgaacacagccaatgcccgcatcaagctgcccagcgaccccatcagcaccctgcgggtggaggtgaagtaccacaagaatgacatgctgcagttcaagatctatgacccccagaagaagagatatgaggtgcctgtgcccctgaacatccccaccacccccatcagcacctatgaagatcggctgtatgatgtggagatcaaggagaaccccttcggcatccagatcagaagaagaagcagcggccgggtcatctgggacagctggctgcccggctttgccttcaatgaccagttcatccagatcagcacccggctgcccagcgagtacatctacggctttggagaggtggagcacacagccttcaagagggacctgaactggaacacctggggcatgttcacccgggaccagcccccaggctacaagctgaacagctatggcttccacccctactacatggccctggaggaggagggcaatgcccatggagtcttcctgctgaacagcaatgccatggatgtgaccttccagcccaccccagccctgacctacagaacagtgggcggcatcctggacttctacatgttcctgggccccaccccagaggtggccaccaagcagtaccacgaggtgattggccaccctgtgatgcctgcctactgggccctgggcttccagctgtgccgctatggctacgccaacaccagcgaggtgcgggagctgtatgatgccatggtggccgccaacatcccctatgatgtgcagtacacagacatcgactacatggagcggcagctggacttcaccatcggggaggccttccaggacctgccccagtttgtggacaagatccggggggagggcatgagatacatcatcatcctggaccctgccatctctggaaatgagaccaagacctacccagcctttgagcggggccagcagaatgatgtgtttgtgaagtggcccaacaccaatgacatctgctgggccaaggtgtggccagacctgcccaacatcaccatcgacaagaccctgacagaagatgaggccgtgaatgccagccgggcccacgtggccttcccagacttcttccgcaccagcacagctgagtggtgggcccgggagatcgtggacttctacaatgagaagatgaagtttgatggcctgtggattgacatgaatgagcccagcagctttgtgaatggcaccaccaccaaccagtgcagaaatgatgagctgaactacccaccctacttccctgagctgaccaagaggacagatggcctgcacttccgcaccatctgcatggaggccgagcagatcctgagtgatggcacctctgtgctgcactatgatgtgcacaacctgtatggctggagccagatgaagcccacccatgatgccctgcagaagaccaccgggaagaggggcatcgtcatcagccgcagcacctaccccaccagcggccgctggggcggccactggctgggggacaactatgcccgctgggacaacatggacaagagcatcatcggcatgatggagttcagcctgtttggcatgagctacaccggggctgacatctgtggcttcttcaacaacagcgagtaccacctgtgcacccgctggatgcagctgggcgccttctacccctacagcaggaaccacaacatcgccaacacccggcggcaggaccctgcctcctggaatgagacctttgctgagatgagcaggaacatcctgaacatccgctacaccctgctgccctacttctacacccagatgcatgagatccacgccaatggaggcaccgtcatccggcccctgctgcacgagttctttgatgagaagcccacctgggacatcttcaagcagttcctgtggggccctgccttcatggtgacccctgtgctggagccctacgtgcagacagtgaatgcctacgtgcccaatgcccgctggtttgactaccacacaggcaaggacattggagtgcggggccagttccagaccttcaatgccagctatgacaccatcaacctgcacgtgcggggcggccacatcctgccctgccaggagcccgcccagaacaccttctacagccggcagaagcacatgaagctgattgtggccgcagatgacaaccagatggcccagggcagcctcttctgggatgatggagagagcattgacacctatgagcgggacctgtacctgtctgtgcagttcaacctgaaccagaccaccctgaccagcaccatcctgaagaggggctacatcaacaagtctgagacccggctgggcagcctgcacgtgtggggcaagggcaccacccctgtgaatgctgtgaccctgacctacaacggcaacaagaacagcctgcccttcaatgaagacaccaccaacatgatcctgagaattgacctgaccacccacaacgtgaccctggaggagcccatcgagatcaactggagctag

SEQ ID NO: 171913 - DNA, 2616 bp, Artificial Sequence
  Description of Artificial Sequence: Synthetic coding sequence
atgaagtacagctgctgtgccctggtgctggccgtgctgggcacagagctgctgggcagcctgtgcagcacagtgcgcagcccccgcttccggggccgcatccagcaggagaggaagaacatccggcccaacatcatcctggtgctgacagatgaccaggatgtggagctgggcagcctgcaggtgatgaacaagaccaggaagatcatggagcacggcggggccaccttcatcaatgcctttgtgaccacccccatgtgctgccccagccgcagctccatgctgaccgggaagtatgtgcacaaccacaacgtgtacaccaacaatgaaaactgcagcagccccagctggcaggccatgcatgagcccaggacctttgctgtgtacctgaacaacacaggctacagaacagccttcttcggcaagtacctgaatgagtacaacggcagctacatccccccaggctggagggagtggctgggcctcatcaagaacagccgcttctacaactacacagtgtgcagaaatggcatcaaggagaagcacggctttgattatgccaaggactacttcacagacctgatcaccaatgaaagcatcaactacttcaagatgagcaagaggatgtacccccacaggcctgtgatgatggtgatcagccacgccgcccctcatggccctgaggacagcgccccccagttcagcaagctgtacccaaatgccagccagcacatcacccccagctacaactatgcccccaacatggacaagcactggatcatgcagtacacaggccccatgctgcccatccacatggagttcaccaacatcctgcagaggaagaggctgcagaccctgatgtctgtggatgacagcgtggagcggctgtacaacatgctggtggagactggagagctggagaacacctacatcatctacacagctgaccacggctaccacatcggccagtttggcctggtgaagggcaagtccatgccctatgactttgacatccgggtgcccttcttcatccggggccccagcgtggagcccggcagcatcgtgccccagatcgtgctgaacatcgacctggcccccaccatcctggacattgctggcctggacaccccaccagatgtggatggcaagtctgtgctgaagctgctggaccctgagaagccaggcaaccgcttccgcaccaacaagaaggccaagatctggagggacaccttcctggtggagcggggcaagttcctgaggaagaaggaggagagcagcaagaacatccagcagagcaaccacctgcccaagtatgaaagagtgaaggagctgtgccagcaggcccgctaccagacagcctgtgagcagcccggccagaagtggcagtgcatcgaggacaccagcggcaagctgcgcatccacaagtgcaagggccccagcgacctgctgactgtgcggcagagcaccaggaacctgtatgcccggggcttccatgacaaggacaaggaatgtagctgccgggagagcggctaccgggccagccgcagccagaggaagagccagaggcagttcctgaggaaccagggcacccccaagtacaagcccaggtttgtgcacacccggcagaccaggagcctgtctgtggagtttgaaggagagatctatgacatcaacctggaggaggaggaggagctgcaggtgctgcagcccagaaatattgccaagagacatgatgagggccacaagggcccccgggacctgcaggccagcagcggcggcaacagaggaaggatgctggccgacagcagcaatgctgtgggcccccccaccaccgtgcgggtgacccacaagtgcttcatcctgcccaatgacagcatccactgtgagcgggagctgtaccagagcgcccgggcctggaaggaccacaaggcctacatcgacaaggagattgaggccctgcaggacaagatcaagaacctgcgggaggtgcggggccacctgaagaggaggaagccagaggagtgcagctgcagcaagcagagctactacaacaaggagaagggcgtgaagaagcaggagaagctgaagagccacctgcaccccttcaaggaggccgcccaggaggtggacagcaagctgcagctgttcaaggagaacaacagaagaaggaagaaggagaggaaggagaagaggcggcagaggaaaggagaggagtgcagcctgcccggcctgacctgcttcacccatgacaacaaccactggcagacagcccccttctggaacctgggcagcttctgtgcctgcaccagcagcaacaacaacacctactggtgcctgaggacagtgaatgagacccacaacttcctgttctgtgaatttgccaccggcttcctggagtactttgacatgaacacagacccctaccagctgaccaacacagtgcacacagtggagcggggcatcctgaaccagctgcacgtgcagctgatggagctgcggagctgccagggctacaagcagtgcaacccccggcccaagaacctggatgtgggcaacaaggatggcggcagctatgacctgcaccggggccagctgtgggatggctgggagggctag

SEQ ID NO: 171914 - DNA, 2616 bp, Artificial Sequence; identical to SEQ ID NO: 171913
  Description of Artificial Sequence: Synthetic coding sequence

SEQ ID NO: 171915 - DNA, 2616 bp, Artificial Sequence; identical to SEQ ID NO: 171913
  Description of Artificial Sequence: Synthetic coding sequence

SEQ ID NO: 171916 - DNA, 2616 bp, Artificial Sequence; identical to SEQ ID NO: 171913
  Description of Artificial Sequence: Synthetic coding sequence

SEQ ID NO: 171917 - DNA, 90 bp, Artificial Sequence
  Description of Artificial Sequence: Synthetic coding sequence
atgaagtacagctgctgtgccctggtgctggccgtgctgggcacagagctgctgggcagcctgtgcagcacagtgcgcagccccaggtag

SEQ ID NO: 171918 - DNA, 519 bp, Artificial Sequence
  Description of Artificial Sequence: Synthetic coding sequence
atgaagtacagctgctgtgccctggtgctggccgtgctgggcacagagctgctgggcagcctgtgcagcacagtgcgcagcccccgcttccggggccgcatccagcaggagaggaagaacatccggcccaacatcatcctggtgctgacagatgaccaggatgtggagctgggcagcctgcaggtgatgaacaagaccaggaagatcatggagcacggcggggccaccttcatcaatgcctttgtgaccacccccatgtgctgccccagccgcagctccatgctgaccgggaagtatgtgcacaaccacaacgtgtacaccaacaatgaaaactgcagcagccccagctggcaggccatgcatgagcccaggacctttgctgtgtacctgaacaacacaggctacagaacagccttcttcggcaagtacctgaatgagtacaacggcagctacatccccccaggctggagggagtggctgggcctcatcaagaacagccgcttctacaactacacctag

SEQ ID NO: 171919 - DNA, 231 bp, Artificial Sequence
  Description of Artificial Sequence: Synthetic coding sequence
atgaagtacagctgctgtgccctggtgctggccgtgctgggcacagagctgctgggcagcctgtgcagcacagtgcgcagcccccgcttccggggccgcatccagcaggagaggaagaacatccggcccaacatcatcctggtgctgacagatgaccaggatgtggagctgggcagcctgcaggtgatgaacaagaccaggaagatcatggagcacggcggggccacctag

SEQ ID NO: 171920 - DNA, 258 bp, Artificial Sequence
  Description of Artificial Sequence: Synthetic coding sequence
atgaagtacagctgctgtgccctggtgctggccgtgctgggcacagagctgctgggcagcctgtgcagcacagtgcgcagcccccgcttccggggccgcatccagcaggagaggaagaacatccggcccaacatcatcctggtgctgacagatgaccaggatgtggagctgggcagcctgcaggtgatgaacaagaccaggaagatcatggagcacggcggggccaccttcatcaatgcctttgtgaccaccccctag

SEQ ID NO: 171921 - DNA, 171 bp, Artificial Sequence
  Description of Artificial Sequence: Synthetic coding sequence
atgaagtacagctgctgtgccctggtgctggccgtgctgggcacagagctgctgggcagcctgtgcagcacagtgcgcagcccccgcttccggggccgcatccagcaggagaggaagaacatccggcccaacatcatcctggtgctgacagatgaccaggatgtggagtag

SEQ ID NO: 171922 - DNA, 2613 bp, Artificial Sequence
  Description of Artificial Sequence: Synthetic coding sequence
atgggcccccccagcctggtgctgtgcctgctgagcgccaccgtcttcagcctgctgggcggcagcagcgccttcctgagccaccaccggctgaagggccgcttccagagggacagaagaaacatccggcccaacatcatcctggtgctgacagatgaccaggatgtggagctgggctccatgcaggtgatgaacaagacccggcgcatcatggagcagggcggggcccacttcatcaatgcctttgtgaccacccccatgtgctgccccagccgcagcagcatcctgaccgggaagtatgtgcacaaccacaacacctacaccaacaatgaaaactgcagcagccccagctggcaggcccagcacgagagcaggacctttgctgtgtacctgaacagcacaggctacagaacagccttcttcggcaagtacctgaatgagtacaacggcagctatgtgcccccaggctggaaggagtgggtgggcctgctgaagaacagccgcttctacaactacaccctgtgcagaaatggagtgaaggagaagcacggcagtgactacagcaaggactacctgacagacctgatcaccaatgacagcgtgtccttcttccgcaccagcaagaagatgtacccccacaggcctgtgctgatggtgatcagccatgctgccccccacggcccagaagattctgccccccagtacagccgcctcttccccaatgccagccagcacatcacccccagctacaactatgcccccaacccagacaagcactggatcatgagatacacaggccccatgaagcccatccacatggagttcaccaacatgctgcagaggaagaggctgcagaccctgatgtctgtggatgacagcatggagaccatctacaacatgctggtggagaccggggagctggacaacacctacatcgtgtacacagctgaccacggctaccacatcggccagtttggcctggtgaagggcaagtccatgccctatgaatttgacatccgggtgcccttctacgtgcggggccccaacgtggaggccggctgcctgaacccccacatcgtgctgaacatcgacctggcccccaccatcctggacattgctggcctggacatcccagctgacatggatggcaagagcatcctgaagctgctggacacagagaggcctgtgaaccgcttccacctgaagaagaagatgagggtgtggagggacagcttcctggtggagcggggcaagctgctgcacaagagggacaatgacaaggtggatgcccaggaggagaacttcctgcccaagtaccagagggtgaaggacctgtgccagagagctgagtaccagacagcctgtgagcagctgggccagaagtggcagtgtgtggaggatgccaccgggaagctgaagctgcacaagtgcaagggccccatgaggctgggcggcagccgggccctgagcaacctggtgcccaagtactacggccagggcagcgaggcctgcacctgtgacagcggggactacaagctgagcctggccggccgcaggaagaagctgttcaagaagaagtacaaggccagctatgtgcgcagccgcagcatccgctctgtggccatcgaggtggatggccgggtgtaccacgtgggcctgggagatgctgcccagcccaggaacctgaccaagaggcactggccaggggcccctgaggaccaggatgacaaggatggaggagacttctctggaactggaggcctgcctgactacagcgctgccaaccccatcaaggtgacccaccgctgctacatcctggagaatgacacagtgcagtgtgacctggacctgtacaagagcctgcaggcctggaaggaccacaagctgcacatcgaccatgaaattgagaccctgcagaacaagatcaagaacctgcgggaggtgcggggccacctgaagaagaagaggccagaagaatgtgactgccacaagatctcctaccacacccagcacaagggccgcctgaagcaccggggcagcagcctgcaccccttcaggaagggcctgcaggagaaggacaaggtgtggctgctgcgggagcagaagaggaagaagaagctgaggaagctgctgaagaggctgcagaacaatgacacctgcagcatgcctggcctgacctgcttcacccatgacaaccagcactggcagacagcccccttctggaccctgggccccttctgtgcctgcaccagcgccaacaacaacacctactggtgcatgaggaccatcaatgagacccacaacttcctgttctgtgaatttgccaccggcttcctggagtactttgacctgaacacagacccctaccagctgatgaatgctgtgaacaccctggacagagatgtgctgaaccagctgcacgtgcagctgatggagctgcggagctgcaagggctacaagcagtgcaaccccaggaccaggaacatggacctgggcctgaaggatggcggcagctatgagcagtaccggcagttccagaggaggaagtggccagagatgaagaggcccagcagcaagagcctgggccagctgtgggagggctgggagggctag

SEQ ID NO: 171923 - DNA, 2559 bp, Artificial Sequence
  Description of Artificial Sequence: Synthetic coding sequence
atgggcccccccagcctggtgctgtgcctgctgagcgccaccgtcttcagcctgctgggcggcagcagcgccttcctgagccaccaccggctgaagggccgcttccagagggacagaagaaacatccggcccaacatcatcctggtgctgacagatgaccaggatgtggagctgggctccatgcaggtgatgaacaagacccggcgcatcatggagcagggcggggcccacttcatcaatgcctttgtgaccacccccatgtgctgccccagccgcagcagcatcctgaccgggaagtatgtgcacaaccacaacacctacaccaacaatgaaaactgcagcagccccagctggcaggcccagcacgagagcaggacctttgctgtgtacctgaacagcacaggctacagaacagccttcttcggcaagtacctgaatgagtacaacggcagctatgtgcccccaggctggaaggagtgggtgggcctgctgaagaacagccgcttctacaactacaccctgtgcagaaatggagtgaaggagaagcacggcagtgactacagcaaggactacctgacagacctgatcaccaatgacagcgtgtccttcttccgcaccagcaagaagatgtacccccacaggcctgtgctgatggtgatcagccatgctgccccccacggcccagaagattctgccccccagtacagccgcctcttccccaatgccagccagcacatcacccccagctacaactatgcccccaacccagacaagcactggatcatgagatacacaggccccatgaagcccatccacatggagttcaccaacatgctgcagaggaagaggctgcagaccctgatgtctgtggatgacagcatggagaccatctacaacatgctggtggagaccggggagctggacaacacctacatcgtgtacacagctgaccacggctaccacatcggccagtttggcctggtgaagggcaagtccatgccctatgaatttgacatccgggtgcccttctacgtgcggggccccaacgtggaggccggctgcctgaacccccacatcgtgctgaacatcgacctggcccccaccatcctggacattgctggcctggacatcccagctgacatggatggcaagagcatcctgaagctgctggacacagagaggcctgtgaaccgcttccacctgaagaagaagatgagggtgtggagggacagcttcctggtggagcggggcaagctgctgcacaagagggacaatgacaaggtggatgcccaggaggagaacttcctgcccaagtaccagagggtgaaggacctgtgccagagagctgagtaccagacagcctgtgagcagctgggccagaagtggcagtgtgtggaggatgccaccgggaagctgaagctgcacaagtgcaagggccccatgaggctgggcggcagccgggccctgagcaacctggtgcccaagtactacggccagggcagcgaggcctgcacctgtgacagcggggactacaagctgagcctggccggccgcaggaagaagctgttcaagaagaagtacaaggccagctatgtgcgcagccgcagcatccgctctgtggccatcgaggtggatggccgggtgtaccacgtgggcctgggagatgctgcccagcccaggaacctgaccaagaggcactggccaggggcccctgaggaccaggatgacaaggatggaggagacttctctggaactggaggcctgcctgactacagcgctgccaaccccatcaaggtgacccaccgctgctacatcctggagaatgacacagtgcagtgtgacctggacctgtacaagagcctgcaggcctggaaggaccacaagctgcacatcgaccatgaaattgagaccctgcagaacaagatcaagaacctgcgggaggtgcggggccacctgaagaagaagaggccagaagaatgtgactgccacaagatctcctaccacacccagcacaagggccgcctgaagcaccggggcagcagcctgcaccccttcaggaagggcctgcaggagaaggacaaggtgtggctgctgcgggagcagaagaggaagaagaagctgaggaagctgctgaagaggctgcagaacaatgacacctgcagcatgcctggcctgacctgcttcacccatgacaaccagcactggcagacagcccccttctggaccctgggccccttctgtgcctgcaccagcgccaacaacaacacctactggtgcatgaggaccatcaatgagacccacaacttcctgttctgtgaatttgccaccggcttcctggagtactttgacctgaacacagacccctaccagctgatgaatgctgtgaacaccctggacagagatgtgctgaaccagctgcacgtgcagctgatggagctgcggagctgcaagggctacaagcagtgcaaccccaggaccaggaacatggacctgggcctgaaggatggcggcagctatgagcagtaccggggccagctgtgggagggctgggagggctag

SEQ ID NO: 171924 - DNA, 870 bp, Artificial Sequence
  Description of Artificial Sequence: Synthetic coding sequence
ttcagcggcaccggcggcctgcctgactacagcgctgccaaccccatcaaggtgacccaccgctgctacatcctggagaatgacacagtgcagtgtgacctggacctgtacaagagcctgcaggcctggaaggaccacaagctgcacatcgaccacgagattgagaccctgcagaacaagatcaagaacctgcgggaggtgcggggccacctgaagaagaagaggcctgaggagtgtgactgccacaagatctcctaccacacccagcacaagggccgcctgaagcaccggggcagcagcctgcaccccttcaggaagggcctgcaggagaaggacaaggtgtggctgctgcgggagcagaagaggaagaagaagctgaggaagctgctgaagaggctgcagaacaatgacacctgcagcatgcctggcctgacctgcttcacccatgacaaccagcactggcagacagcccccttctggaccctgggccccttctgtgcctgcaccagcgccaacaacaacacctactggtgcatgaggaccatcaatgagacccacaacttcctgttctgtgaatttgccaccggcttcctggagtactttgacctgaacacagacccctaccagctgatgaatgctgtgaacaccctggacagagatgtgctgaaccagctgcacgtgcagctgatggagctgcggagctgcaagggctacaagcagtgcaaccccaggaccaggaacatggacctgggcctgaaggatggcggcagctatgagcagtaccggcagttccagaggaggaagtggccagagatgaagaggcccagcagcaagagcctgggccagctgtgggagggctgggagggctag

SEQ ID NO: 171925 - DNA, 2604 bp, Artificial Sequence
  Description of Artificial Sequence: Synthetic coding sequence
atgggcccccccagcctggtgctgtgcctgctgagcgccaccgtcttcagcctgctgggcggcagcagcgccttcctgagccaccaccggctgaagggccgcttccagagggacagaagaaacatccggcccaacatcatcctggtgctgacagatgaccaggatgtggagctgggctccatgcaggtgatgaacaagacccggcgcatcatggagcagggcggggcccacttcatcaatgcctttgtgaccacccccatgtgctgccccagccgcagcagcatcctgaccgggaagtatgtgcacaaccacaacacctacaccaacaatgaaaactgcagcagccccagctggcaggcccagcacgagagcaggacctttgctgtgtacctgaacagcacaggctacagaacagccttcttcggcaagtacctgaatgagtacaacggcagctatgtgcccccaggctggaaggagtgggtgggcctgctgaagaacagccgcttctacaactacaccctgtgcagaaatggagtgaaggagaagcacggcagtgactacagcaaggactacctgacagacctgatcaccaatgacagcgtgtccttcttccgcaccagcaagaagatgtacccccacaggcctgtgctgatggtgatcagccatgctgccccccacggcccagaagattctgccccccagtacagccgcctcttccccaatgccagccagcacatcacccccagctacaactatgcccccaacccagacaagcactggatcatgagatacacaggccccatgaagcccatccacatggagttcaccaacatgctgcagaggaagaggctgcagaccctgatgtctgtggatgacagcatggagaccatctacaacatgctggtggagaccggggagctggacaacacctacatcgtgtacacagctgaccacggctaccacatcggccagtttggcctggtgaagggcaagtccatgccctatgaatttgacatccgggtgcccttctacgtgcggggccccaacgtggaggccggctgcctgaacccccacatcgtgctgaacatcgacctggcccccaccatcctggacattgctggcctggacatcccagctgacatggatggcaagagcatcctgaagctgctggacacagagaggcctgtgaaccgcttccacctgaagaagaagatgagggtgtggagggacagcttcctggtggagcggggcaagctgctgcacaagagggacaatgacaaggtggatgcccaggaggagaacttcctgcccaagtaccagagggtgaaggacctgtgccagagagctgagtaccagacagcctgtgagcagctgggccagaagtggcagtgtgtggaggatgccaccgggaagctgaagctgcacaagtgcaagggccccatgaggctgggcggcagccgggccctgagcaacctggtgcccaagtactacggccagggcagcgaggcctgcacctgtgacagcggggactacaagctgagcctggccggccgcaggaagaagctgttcaagaagaagtacaaggccagctatgtgcgcagccgcagcatccgctctgtggccatcgaggtggatggccgggtgtaccacgtgggcctgggagatgctgcccagcccaggaacctgaccaagaggcactggccaggggcccctgaggaccaggatgacaaggatggaggagacttctctggaactggaggcctgcctgactacagcgctgccaaccccatcaaggtgacccaccgctgctacatcctggagaatgacacagtgcagtgtgacctggacctgtacaagagcctgcaggcctggaaggaccacaagctgcacatcgaccatgaaattgagaccctgcagaacaagatcaagaacctgcgggaggtgcggggccacctgaagaagaagaggccagaagaatgtgactgccacaagatctcctaccacacccagcacaagggccgcctgaagcaccggggcagcagcctgcaccccttcaggaagggcctgcaggagaaggacaaggtgtggctgctgcgggagcagaagaggaagaagaagctgaggaagctgctgaagaggctgcagaacaatgacacctgcagcatgcctggcctgacctgcttcacccatgacaaccagcactggcagacagcccccttctggaccctgggccccttctgtgcctgcaccagcgccaacaacaacacctactggtgcatgaggaccatcaatgagacccacaacttcctgttctgtgaatttgccaccggcttcctggagtactttgacctgaacacagacccctaccagctgatgaatgctgtgaacaccctggacagagatgtgctgaaccagctgcacgtgcagctgatggagctgcggagctgcaagggctacaagcagtgcaaccccaggaccaggaacatggacctggatggcggcagctatgagcagtaccggcagttccagaggaggaagtggccagagatgaagaggcccagcagcaagagcctgggccagctgtgggagggctgggagggctag

SEQ ID NO: 171926 - DNA, 2613 bp, Artificial Sequence; identical to SEQ ID NO: 171922
  Description of Artificial Sequence: Synthetic coding sequence

SEQ ID NO: 171927 - DNA, 1125 bp, Artificial Sequence
  Description of Artificial Sequence: Synthetic coding sequence
atggccgccccagccctgggcctggtgtgtggccgctgcccagagctgggcctggtgctgctgctgctgctgctgagcctgctgtgtggggccgccggcagccaggaggccggcactggagctggagctggcagcctggccggcagctgtggctgcggcaccccccagaggcctggggcccacggcagcagcgctgctgcccaccgctacagccgggaggccaatgcccctggccctgtgcctggagagcggcagctggcccacagcaagatggtgcccatcccagctggggtcttcaccatgggcacagatgacccccagatcaagcaggatggagaggccccagcccggcgggtgaccattgatgccttctacatggatgcctatgaggtgagcaacacagaatttgagaagtttgtgaacagcacaggctacctgacagaagctgagaagtttggagacagctttgtgtttgagggcatgctgtctgagcaggtgaagaccaacatccagcaggccgtggccgccgccccctggtggctgcctgtgaagggggccaactggaggcaccctgagggccctgacagcaccatcctgcacaggccagaccaccctgtgctgcacgtgtcctggaatgatgctgtggcctactgcacctgggccggcaagaggctgcccacagaagctgagtgggagtacagctgccggggcggcctgcacaacagactcttcccctggggcaacaagctgcagcccaagggccagcactacgccaacatctggcagggcgagttccctgtgaccaacacaggagaagatggcttccagggcacagcccctgtggatgccttccccccaaatggctacggcctgtacaacatcgtgggcaatgcctgggagtggaccagtgactggtggacagtgcaccacagcgtggaggagaccctgaaccccaagggccccccatctgggaaggacagagtgaagaagggcggcagctacatgtgccacaggagctactgctaccgctaccgctgtgccgcccggagccagaacaccccagacagcagcgccagcaacctgggcttccgctgtgccgctgaccggctgcccaccatggactag

SEQ ID NO: 171928 - DNA, 1281 bp, Artificial Sequence
  Description of Artificial Sequence: Synthetic coding sequence
atggccgccccagccctgggcctggtgtgtggccgctgcccagagctgggcctggtgctgctgctgctgctgctgagcctgctgtgtggggccgccggcagccaggaggccggcactggagctggagctggcagcctggccggcagctgtggctgcggcaccccccagaggcctggggcccacggcagcagcgctgctgcccaccgctacagccgggaggccaatgcccctggccctgtgcctggagagcggcagctggcccacagcaagatggtgcccatcccagctggggtcttcaccatgggcacagatgacccccagatcaagcaggatggagaggccccagcccggcgggtgaccattgatgccttctacatggatgcctatgaggtgagcaacacagaatttgagaagtttgtgaacagcacaggctacctgacagaagctgagaagtttggagacagctttgtgtttgagggcatgctgtctgagcaggtgaagaccaacatccagcaggccgtggccgccgccccctggtggctgcctgtgaagggggccaactggaggcaccctgagggccctgacagcaccatcctgcacaggccagaccaccctgtgctgcacgtgtcctggaatgatgctgtggcctactgcacctgggccggcaagaggctgcccacagaagctgagtgggagtacagctgccggggcggcctgcacaacagactcttcccctggggcaacaagctgcagcccaagggccagcactacgccaacatctggcagggcgagttccctgtgaccaacacaggagaagatggcttccagggcacagcccctgtggatgccttccccccaaatggctacggcctgtacaacatcgtgggcaatgcctgggagtggaccagtgactggtggacagtgcaccacagcgtggaggagaccctgaaccccaagggccccccatctgggaaggacagagtgaagaagggcggcagctacatgtgccacaggagccaggagtactatgacccctacttccaggatgtggccagcgagatgctgcggcggcacacagccagccgctggaaggccttcagcagcctggagccctgctgcagcatccgccgccaccagcagtatgctgccatcgagcggctgacctgtgggaagtttgagctgcgctgtgccagcctgaggaagattgactgcctgaacaccaacatcgcctgcagctacagcatgaggcaggacggcccccggctgcactgtgtggactag

SEQ ID NO: 171929 - DNA, 1287 bp, Artificial Sequence
  Description of Artificial Sequence: Synthetic coding sequence
atggccgccccagccctgggcctggtgtgtggccgctgcccagagctgggcctggtgctgctgctgctgctgctgagcctgctgtgtggggccgccggcagccaggaggccggcactggagctggagctggcagcctggccggcagctgtggctgcggcaccccccagaggcctggggcccacggcagcagcgctgctgcccaccgctacagccgggaggccaatgcccctggccctgtgcctggagagcggcagctggcccacagcaagatggtgcccatcccagctggggtcttcaccatgggcacagatgacccccagatcaagcaggatggagaggccccagcccggcgggtgaccattgatgccttctacatggatgcctatgaggtgagcaacacagaatttgagaagtttgtgaacagcacaggctacctgacagaagctgagaagtttggagacagctttgtgtttgagggcatgctgtctgagcaggtgaagaccaacatccagcaggccgtggccgccgccccctggtggctgcctgtgaagggggccaactggaggcaccctgagggccctgacagcaccatcctgcacaggccagaccaccctgtgctgcacgtgtcctggaatgatgctgtggcctactgcacctgggccggcaagaggctgcccacagaagctgagtgggagtacagctgccggggcggcctgcacaacagactcttcccctggggcaacaagctgcagcccaagggccagcactacgccaacatctggcagggcgagttccctgtgaccaacacaggagaagatggcttccagggcacagcccctgtggatgccttccccccaaatggctacggcctgtacaacatcgtgggcaatgcctgggagtggaccagtgactggtggacagtgcaccacagcgtggaggagaccctgaaccccaagggccccccatctgggaaggacagagtgaagaagggcggcctgagcaaggcccaccagaggatcagccaggagtactatgacccctacttccaggatgtggccagcgagatgctgcggcggcacacagccagccgctggaaggccttcagcagcctggagccctgctgcagcatccgccgccaccagcagtatgctgccatcgagcggctgacctgtgggaagtttgagctgcgctgtgccagcctgaggaagattgactgcctgaacaccaacatcgcctgcagctacagcatgaggcaggacggcccccggctgcactgtgtggactag

SEQ ID NO: 171930 - DNA, 1050 bp, Artificial Sequence
  Description of Artificial Sequence: Synthetic coding sequence
atggccgccccagccctgggcctggtgtgtggccgctgcccagagctgggcctggtgctgctgctgctgctgctgagcctgctgtgtggggccgccggcagccaggaggccggcactggagctggagctggcagcctggccggcagctgtggctgcggcaccccccagaggcctggggcccacggcagcagcgctgctgcccaccgctacagccgggaggccaatgcccctggccctgtgcctggagagcggcagctggcccacagcaagatggtgcccatcccagctggggtcttcaccatgggcacagatgacccccagatcaagcaggatggagaggccccagcccggcgggtgaccattgatgccttctacatggatgcctatgaggtgagcaacacagaatttgagaagtttgtgaacagcacaggctacctgacagaggtggccgccgccccctggtggctgcctgtgaagggggccaactggaggcaccctgagggccctgacagcaccatcctgcacaggccagaccaccctgtgctgcacgtgtcctggaatgatgctgtggcctactgcacctgggccggcaagaggctgcccacagaggccgagtgggagtacagctgccggggcggcctgcacaacagactcttcccctggggcaacaagctgcagcccaagggccagcactacgccaacatctggcagggcgagttccctgtgaccaacacaggagaagatggcttccagggcacagcccctgtggatgccttcccccccaacggctacggcctgtacaacatcgtgggcaatgcctgggagtggaccagtgactggtggacagtgcaccacagcgtggaggagaccctgaaccccaagggcccccccagcggcaaggacagagtgaagaagggcggcagctacatgtgccacaggagctactgctaccgctaccgctgtgccgcccggagccagaacaccccagacagcagcgccagcaacctgggcttccgctgtgccgctgaccggctgcccaccatggactag

SEQ ID NO: 171931 - DNA, 1065 bp, Artificial Sequence
  Description of Artificial Sequence: Synthetic coding sequence
atggccgccccagccctgggcctggtgtgtggccgctgcccagagctgggcctggtgctgctgctgctgctgctgagcctgctgtgtggggccgccggcagccaggaggccggcactggagctggagctggcagcctggccggcagctgtggctgcggcaccccccagaggcctggggcccacggcagcagcgctgctgcccaccgctacagccgggaggccaatgcccctggccctgtgcctggagagcggcagctggcccacagcaagatggtgcccatcccagctggggtcttcaccatgggcacagatgacccccagatcaagcaggatggagaggccccagcccggcgggtgaccattgatgccttctacatggatgcctatgaggtgagcaacacagaatttgagaagtttgtgaacagcacaggctacctgacagaagctgagaagtttggagacagctttgtgtttgagggcatgctgtctgagcaggtgaagaccaacatccagcaggccgtggccgccgccccctggtggctgcctgtgaagggggccaactggaggcaccctgagggccctgacagcaccatcctgcacaggccagaccaccctgtgctgcacgtgtcctggaatgatgctgtggcctactgcacctgggccggcaagaggctgcccacagaagctgagtgggagtacagctgccggggcggcctgcacaacagactcttcccctggggcaacaagctgcagcccaagggccagcactacgccaacatctggcagggcgagttccctgtgaccaacacaggagaagatggcttccagggcacagcccctgtggatgccttccccccaaatggctacggcctgtacaacatcgtgggcaatgcctgggagtggaccagtgactggtggacagtgcaccacagcgtggaggagaccctgaaccccagctactgctaccgctaccgctgtgccgcccggagccagaacaccccagacagcagcgccagcaacctgggcttccgctgtgccgctgaccggctgcccaccatggactag

SEQ ID NO: 171932 - DNA, 1638 bp, Artificial Sequence
  Description of Artificial Sequence: Synthetic coding sequence
atgctgctgctgcacagagctgtggtgctgcggctgcagcaggcctgccgcctgaagagcatccccagccgcatctgcatccaggcctgcagcaccaatgacagcttccagccccagaggcccagcctgaccttcagcggggacaacagcagcacccagggctggagggtgatgggcaccctgctgggcctgggcgctgtgctggcctaccaggaccaccgctgcagagctgcccaggagagcacccacatctacaccaaggaggaggtgagcagccacaccagccctgagaccggcatctgggtgaccctgggcagcgaggtgtttgatgtgacagaatttgtggacctgcaccctgggggccccagcaagctgatgctggccgccggcggccccctggagcccttctgggccctgtatgctgtgcacaaccagagccacgtgcgggagctgctggcccagtacaagattggagagctgaaccctgaggacaaggtggcccccaccgtggagaccagtgacccctatgcagatgatcctgtgcgccacccagccctgaaggtgaacagccagaggcccttcaatgctgagcccccacctgagctgctgacagagaactacatcacccccaaccccatcttcttcaccaggaaccacctgcctgtgcccaacctggaccctgacacctaccgcctgcacgtggtgggcgcccctgggggccagagcctgagcctgagcctggatgacctgcacaacttccccaggtatgagatcaccgtgaccctgcagtgtgccggcaacagaagaagtgagatgacccaggtgaaggaggtgaagggcctggagtggaggactggagccatcagcacagcccgctgggccggggcccggctgtgtgatgtgctggcccaggccggccaccagctgtgtgaaacagaggcccacgtgtgctttgagggcctggacagcgaccccaccggcacagcctacggggccagcatccccctggcccgggccatggaccctgaggccgaggtgctgctggcctatgagatgaatggccagcccctgccccgggaccacggcttccctgtgcgggtggtggtgcctggggtggtgggcgcccggcacgtgaagtggctgggccgggtgtctgtgcagcctgaggagagctacagccactggcagaggcgggactacaagggcttcagccccagcgtggactgggagaccgtggactttgacagcgcccccagcatccaggagctgcctgtgcagagcgccatcacagagcccagagatggagaaacagtggagagcggggaggtgaccatcaagggctacgcctggagcggcggcggccgggccgtcatccgggtggatgtgtccctggatggcggcctgacctggcaggtggccaagctggatggagaggagcagaggcccaggaaggcctgggcctggaggctgtggcagctgaaggcccctgtgcctgctggccagaaggagctgaacatcgtgtgcaaggctgtggatgatggctacaacgtgcagcctgacacagtggcccccatctggaacctgcggggcgtgctgagcaatgcctggcaccgggtgcacgtgtatgtgagcccctag

SEQ ID NO: 171933 - DNA, 1638 bp, Artificial Sequence; identical to SEQ ID NO: 171932
  Description of Artificial Sequence: Synthetic coding sequence

SEQ ID NO: 171934 - DNA, 1638 bp, Artificial Sequence; identical to SEQ ID NO: 171932
  Description of Artificial Sequence: Synthetic coding sequence

SEQ ID NO: 171935 - DNA, 1638 bp, Artificial Sequence; identical to SEQ ID NO: 171932
  Description of Artificial Sequence: Synthetic coding sequence

SEQ ID NO: 171936 - DNA, 489 bp, Artificial Sequence
  Description of Artificial Sequence: Synthetic coding sequence
atgctgctgctgcacagagctgtggtgctgcggctgcagcaggcctgccgcctgaagagcatccccagccgcatctgcatccaggcctgcagcaccaatgacagcttccagccccagaggcccagcctgaccttcagcggggacaacagcagcacccagggctggagggtgatgggcaccctgctgggcctgggcgctgtgctggcctaccaggaccaccgctgcagagctgcccaggagagcacccacatctacaccaaggaggaggtgagcagccacaccagccctgagaccggcatctgggtgaccctgggcagcgaggtgtttgatgtgacagaatttgtggacctgcaccctgggggccccagcaagctgatgctggccgccggcggccccctggagcccttctgggccctgtatgctgtgcacaaccagagccacgtgcgggagctgctggcccagtacaagattggagagctgaacccctag

SEQ ID NO: 171937 - DNA, 132 bp, Artificial Sequence
  Description of Artificial Sequence: Synthetic coding sequence
atgctgctgctgcacagagctgtggtgctgcggctgcagcaggcctgccgcctgaagagcatccccagccgcatctgcatccaggcctgcagcaccaatgacagcttccagccccagaggcccagcctgtag

SEQ ID NO: 171938 - DNA, 1638 bp, Artificial Sequence; identical to SEQ ID NO: 171932
  Description of Artificial Sequence: Synthetic coding sequence

SEQ ID NO: 171939 - DNA, 1638 bp, Artificial Sequence; identical to SEQ ID NO: 171932
  Description of Artificial Sequence: Synthetic coding sequence

SEQ ID NO: 171940 - DNA, 366 bp, Artificial Sequence
  Description of Artificial Sequence: Synthetic coding sequence
atgctgctgctgcacagagctgtggtgctgcggctgcagcaggcctgccgcctgaagagcatccccagccgcatctgcatccaggcctgcagcaccaatgacagcttccagccccagaggcccagcctgaccttcagcggggacaacagcagcacccagggctggagggtgatgggcaccctgctgggcctgggcgctgtgctggcctaccaggaccaccgctgcagagctgcccaggagagcacccacatctacaccaaggaggaggtgagcagccacaccagccctgagaccggcatctgggtgaccctgggcagcgaggtgtttgatgtgacagaatttgtggacctgcaccctgggggctag

SEQ ID NO: 171941 - DNA, 783 bp, Artificial Sequence
  Description of Artificial Sequence: Synthetic coding sequence
atggccgagagcgaggccgagacccccagcaccccaggagaatttgagagcaagtactttgagttccatggagtgcggctgccccccttctgccggggcaagatggaggagatcgccaacttccctgtgcggcccagtgatgtgtggatcgtgacctaccccaagagcggcaccagcctgctgcaggaggtggtgtacctggtgtcccagggcgctgaccctgatgaaattggcctgatgaacattgatgagcagctgcctgtgctggagtacccccagcccggcctggacatcatcaaggagctgaccagccccaggctcatcaagagccacctgccctaccgcttcctgcccagcgacctgcacaatggagacagcaaggtgatctacatggccaggaaccccaaggacctggtggtgtcctactaccagttccacaggagcctgcggaccatgagctaccggggcaccttccaggagttctgccgccgcttcatgaatgacaagctgggctacggctcctggtttgagcacgtgcaggagttctgggagcacaggatggacagcaatgtgctcttcctgaagtatgaggacatgcaccgggacctggtgaccatggtggagcagctggcccgcttcctgggcgtgtcctgtgacaaggcccagctggaggccctgacagagcactgccaccagctggtggaccagtgctgcaatgctgaggccctgcctgtgggccgggcccactgtgtgtttgccaggaagatcttcctgtcctggtag

SEQ ID NO: 171942 - DNA, 855 bp, Artificial Sequence
  Description of Artificial Sequence: Synthetic coding sequence
atggccgagagcgaggccgagacccccagcaccccaggagaatttgagagcaagtactttgagttccatggagtgcggctgccccccttctgccggggcaagatggaggagatcgccaacttccctgtgcggcccagtgatgtgtggatcgtgacctaccccaagagcggcaccagcctgctgcaggaggtggtgtacctggtgtcccagggcgctgaccctgatgaaattggcctgatgaacattgatgagcagctgcctgtgctggagtacccccagcccggcctggacatcatcaaggagctgaccagccccaggctcatcaagagccacctgccctaccgcttcctgcccagcgacctgcacaatggagacagcaaggtgatctacatggccaggaaccccaaggacctggtggtgtcctactaccagttccacaggagcctgcggaccatgagctaccggggcaccttccaggagttctgccgccgcttcatgaatgacaagctgggctacggctcctggtttgagcacgtgcaggagttctgggagcacaggatggacagcaatgtgctcttcctgaagtatgaggacatgcaccgggacctggtgaccatggtggagcagctggcccgcttcctgggcgtgtcctgtgacaaggcccagctggaggccctgacagagcactgccaccagctggtggaccagtgctgcaatgctgaggccctgcctgtgggccggggccgggtgggcctgtggaaggacatcttcaccgtgtccatgaatgagaagtttgacctggtgtacaagcagaagatgggcaaatgtgacctgacctttgacttctacctgtag

SEQ ID NO: 171943 - DNA, 516 bp, Artificial Sequence
  Description of Artificial Sequence: Synthetic coding sequence
atggccgagagcgaggccgagacccccagcaccccaggagaatttgagagcaagtactttgagttccatggagtgcggctgccccccttctgccggggcaagatggaggagatcgccaacttccctgtgcggcccagtgatgtgtggatcgtgacctaccccaagtctgtgggctacggctcctggtttgaacatgtgcaggagttctgggagcacaggatggacagcaatgtgctcttcctgaagtatgaggacatgcaccgggacctggtgaccatggtggagcagctggcccgcttcctgggcgtgtcctgtgacaaggcccagctggaggccctgacagagcactgccaccagctggtggaccagtgctgcaatgctgaggccctgcctgtgggccggggccgggtgggcctgtggaaggacatcttcaccgtgtccatgaatgagaagtttgacctggtgtacaagcagaagatgggcaaatgtgacctgacctttgacttctacctgtag

SEQ ID NO: 171944 - DNA, 171 bp, Artificial Sequence
  Description of Artificial Sequence: Synthetic coding sequence
atgctggccaagctgctgtgtgaccaggtggtgggcgcccccatcgctgtgtctgccttctacgccggcatgagcatcctgcagggcaaggatgacatcttcctggacctgaagcagaagttctggaacacctacatgcagacccagagctggctgtggaggagcctgtag

SEQ ID NO: 171945 - DNA, 888 bp, Artificial Sequence
  Description of Artificial Sequence: Synthetic coding sequence
atggagctgatccaggacaccagccggccccccctggagtatgtgaagggcgtgcccctcatcaagtactttgctgaggccctgggccccctgcagagcttccaggcccggccagatgacctgctgatcagcacctaccccaagagcggcaccacctgggtgtcccagatcctggacatgatctaccagggcggggacctggagaagtgccaccgggcccccatcttcatgagggtgcccttcctggagttcaaggcccctggcatccccagcggcatggagaccctgaaggacaccccagccccccggctgctgaagacccacctgcccctggccctgctgccccagaccctgctggaccagaaggtgaaggtggtgtatgtggccagaaatgccaaggatgtggccgtgtcctactaccacttctaccacatggccaaggtgcaccctgagcccggcacctgggacagcttcctggagaagttcatggtgggggaggtgtcctatggctcctggtaccagcacgtgcaggagtggtgggagctgagcaggacccaccctgtgctgtacctgttctatgaggacatgaaggagaaccccaagcgggagatccagaagatcctggagtttgtgggccgcagcctgcctgaggagaccgtggactttgtggtgcagcacaccagcttcaaggagatgaagaagaaccccatgaccaactacaccaccgtgccccaggagttcatggaccacagcatcagccccttcatgaggaagggcatggccggggactggaagaccaccttcaccgtggcccagaatgaaagatttgatgctgactatgcagagaagatggccggctgcagcctgtccttccgctctgagctgtag

SEQ ID NO: 171946 - DNA, 888 bp, Artificial Sequence; identical to SEQ ID NO: 171945
  Description of Artificial Sequence: Synthetic coding sequence

SEQ ID NO: 171947 - DNA, 654 bp, Artificial Sequence
  Description of Artificial Sequence: Synthetic coding sequence
atgctggccaagctgctgtgtgaccaggtggtgggcgcccccatcgctgtgtctgccttctacgccggcatgagcatcctgcagggcaaggatgacatcttcctggacctgaagcagaagttctggaacacctacatggtggtgtatgtggccagaaatgccaaggatgtggccgtgtcctactaccacttctaccacatggccaaggtgcaccctgagcccggcacctgggacagcttcctggagaagttcatggtgggggaggtgtcctatggctcctggtaccagcacgtgcaggagtggtgggagctgagcaggacccaccctgtgctgtacctgttctatgaggacatgaaggagaaccccaagcgggagatccagaagatcctggagtttgtgggccgcagcctgcctgaggagaccgtggactttgtggtgcagcacaccagcttcaaggagatgaagaagaaccccatgaccaactacaccaccgtgccccaggagttcatggaccacagcatcagccccttcatgaggaagggcatggccggggactggaagaccaccttcaccgtggcccagaatgaaagatttgatgctgactatgcagagaagatggccggctgcagcctgtccttccgctctgagctgtag

SEQ ID NO: 171948 - DNA, 888 bp, Artificial Sequence; identical to SEQ ID NO: 171945
  Description of Artificial Sequence: Synthetic coding sequence

SEQ ID NO: 171949 - DNA, 888 bp, Artificial Sequence; identical to SEQ ID NO: 171945
  Description of Artificial Sequence: Synthetic coding sequence

SEQ ID NO: 171950 - DNA, 888 bp, Artificial Sequence
  Description of Artificial Sequence: Synthetic coding sequence
atggagctgatccaggacatcagccggccccccctggagtatgtgaagggcgtgcccctcatcaagtactttgctgaggccctgggccccctgcagagcttccaggcccggccagatgacctgctgatcagcacctaccccaagagcggcaccacctgggtgtcccagatcctggacatgatctaccagggcggggacctggagaagtgccaccgggcccccatcttcatgagggtgcccttcctggagttcaaggtgcccggcatccccagcggcatggagaccctgaagaacaccccagccccccggctgctgaagacccacctgcccctggccctgctgccccagaccctgctggaccagaaggtgaaggtggtgtatgtggccagaaatgccaaggatgtggccgtgtcctactaccacttctaccacatggccaaggtgtacccccaccctggcacctgggagagcttcctggagaagttcatggccggggaggtgtcctatggctcctggtaccagcacgtgcaggagtggtgggagctgagcaggacccaccctgtgctgtacctgttctatgaggacatgaaggagaaccccaagcgggagatccagaagatcctggagtttgtgggccgcagcctgcctgaggagaccgtggacctgatggtggagcacaccagcttcaaggagatgaagaagaaccccatgaccaactacaccaccgtgcggcgggagttcatggaccacagcatcagccccttcatgaggaagggcatggccggggactggaagaccaccttcaccgtggcccagaatgaaagatttgatgctgactatgccaagaagatggccggctgcagcctgtccttccgctctgagctgtag

SEQ ID NO: 171951 - DNA, 888 bp, Artificial Sequence; identical to SEQ ID NO: 171950
  Description of Artificial Sequence: Synthetic coding sequence

SEQ ID NO: 171952 - DNA, 579 bp, Artificial Sequence
  Description of Artificial Sequence: Synthetic coding sequence
atggagctgatccaggacatcagccggccccccctggagtatgtgaagggcgtgcccctcatcaagtactttgctgaggccctgggccccctgcagagcttccaggcccggccagatgacctgctgatcagcacctaccccaagagcggcaccacctgggtgtcccagatcctggacatgatctaccagggcggggacctggagaagtgccaccgggcccccatcttcatgagggtgcccttcctggagttcaaggtgcccggcatccccagcggcatggagaccctgaagaacaccccagccccccggctgctgaagacccacctgcccctggccctgctgccccagaccctgctggaccagaaggtgaaggtggtgtatgtggccagaaatgccaaggatgtggccgtgtcctactaccacttctaccacatggccaaggtgtacccccaccctggcacctgggagagcttcctggagaagttcatggccggggaggtgtcctatggctcctggtaccagcacgtgcaggagtggtgggagctgagcaggacccaccctgtgctgtacctgttctag

SEQ ID NO: 171953 - DNA, 891 bp, Artificial Sequence
  Description of Artificial Sequence: Synthetic coding sequence
atggccctgaccagtgacctgggcaagcagatcaagctgaaggaggtggagggcaccctgctgcagcctgccaccgtggacaactggagccagatccagagctttgaggccaagccagatgacctgctgatctgcacctaccccaaggccggcaccacctggatccaggagatcgtggacatgattgagcagaatggagatgtggagaagtgccagagggccatcatccagcaccgccaccccttcatcgagtgggcccggcccccccagcccagcggcgtggagaaggccaaggccatgcccagcccccgcatcctgaagacccacctgagcacccagctgctgccccccagcttctgggagaacaactgcaagttcctgtatgtggccagaaatgccaaggactgcatggtgtcctactaccacttccagaggatgaaccacatgctgcctgaccccggcacctgggaggagtactttgagaccttcatcaatggcaaggtggtgtggggctcctggtttgaccacgtgaagggctggtgggagatgaaggacagacaccagatcctcttcctgttctatgaggacatcaagagggaccccaagcatgagatcaggaaggtgatgcagttcatgggcaagaaggtggatgaaacagtgctggacaagatcgtgcaggagaccagctttgagaagatgaaggagaaccccatgaccaacagaagcacagtgtccaagagcatcctggaccagagcatcagcagcttcatgaggaaaggaacagtgggggactggaagaaccacttcaccgtggcccagaatgaaagatttgatgagatctacagaaggaagatggagggcaccagcatcaacttctgcatggagctgtag

SEQ ID NO: 171954 - DNA, 924 bp, Artificial Sequence
  Description of Artificial Sequence: Synthetic coding sequence
atggccctgaccagtgacctgggcaagcagatcaagctgaaggaggtggagggcaccctgctgcagcctgccaccgtggacaactggagccagatccagagctttgaggccaagccagatgacctgctgatctgcacctaccccaaggccggcaccacctggatccaggagatcgtggacatgattgagcagaatggagatgtggagaagtgccagagggccatcatccagcaccgccaccccttcatcgagtgggcccggcccccccagcccagcgagaccggcttccaccacgtggcccaggccggcctgaagctgctgagcagcagcaaccccccagccagcaccagccagagcgccaagatcacagacctgctgcccccatccttctgggagaacaactgcaagttcctgtatgtggccagaaatgccaaggactgcatggtgtcctactaccacttccagaggatgaaccacatgctgcctgaccccggcacctgggaggagtactttgagaccttcatcaacgggaaggtggtgtggggctcctggtttgaccacgtgaagggctggtgggagatgaaggacagacaccagatcctcttcctgttctatgaggacatcaagagggaccccaagcatgagatcaggaaggtgatgcagttcatgggcaagaaggtggatgagaccgtgctggacaagatcgtgcaggagaccagctttgagaagatgaaggagaaccccatgaccaacagaagcacagtgtccaagagcatcctggaccagagcatcagcagcttcatgaggaagggcaccgtgggggactggaagaaccacttcaccgtggcccagaatgaaagatttgatgagatctacagaaggaagatggagggcaccagcatcaacttctgcatggagctgtag

SEQ ID NO: 171955 - DNA, 933 bp, Artificial Sequence
  Description of Artificial Sequence: Synthetic coding sequence
atggccctgaccagtgacctgggcaagcagatcaagctgaaggaggtggagggcaccctgctgcagcctgccaccgtggacaactggagccagatccagagctttgaggccaagccagatgacctgctgatctgcacctaccccaaggccggcaccacctggatccaggagatcgtggacatgattgagcagaatggagatgtggagaagtgccagagggccatcatccagcaccgccaccccttcatcgagtgggcccggcccccccagcccagcgtgctggtgctgcggcgctgcttcctgctgagctacttcaagggcgtggagaaggccaaggccatgcccagcccccgcatcctgaagacccacctgagcacccagctgctgccccccagcttctgggagaacaactgcaagttcctgtatgtggccagaaatgccaaggactgcatggtgtcctactaccacttccagaggatgaaccacatgctgcctgaccccggcacctgggaggagtactttgagaccttcatcaatggcaaggtggtgtggggctcctggtttgaccacgtgaagggctggtgggagatgaaggacagacaccagatcctcttcctgttctatgaggacatcaagagggaccccaagcatgagatcaggaaggtgatgcagttcatgggcaagaaggtggatgaaacagtgctggacaagatcgtgcaggagaccagctttgagaagatgaaggagaaccccatgaccaacagaagcacagtgtccaagagcatcctggaccagagcatcagcagcttcatgaggaaaggaacagtgggggactggaagaaccacttcaccgtggcccagaatgaaagatttgatgagatctacagaaggaagatggagggcaccagcatcaacttctgcatggagctgtag

SEQ ID NO: 171956 - DNA, 639 bp, Artificial Sequence
  Description of Artificial Sequence: Synthetic coding sequence
atgggccccccatctgccagcccccaccgggagtgcatcccctggcagggcctgctgctgacagccagcctgctgaacttctggaacccccccaccacagccaagctgaccatcgagagcatgcccctgtctgtggccgagggcaaggaggtgctgctgctggtgcacaacctgccccagcacctgtttggctacagctggtacaagggggagcgggtggatggcaacagcctgattgtgggctacgtgattggcacccagcaggccaccccaggagctgcctacagcggccgggagaccatctacaccaatgccagcctgctgatccagaatgtgacccagaatgacatcggcttctacaccctgcaggtgatcaagagtgacctggtgaatgaggaggccaccggccagttccacgtgtaccaggagaatgcccctggcctgcctgtgggcgctgtggccggcatcgtgactggagtgctggtgggcgtggccctggtggccgccctggtgtgcttcctgctgctggccaagacaggccggccctggagcctgccccagctgtgcctgctggatgtgcccagcctgcactgccccggcccccccacccagccccaggacagcagcttccacctgtag

SEQ ID NO: 171957 - DNA, 1098 bp, Artificial Sequence
  Description of Artificial Sequence: Synthetic coding sequence
atggatggccctgctgagccccagatccctggcctgtgggacacctatgaagatgacatcagcgagatcagccagaagctgcccggggagtacttccgctacaagggcgtgcccttccctgtgggcctgtacagcctggagagcatcagcctggccgagaacacccaggatgtgagagatgatgacatcttcatcatcacctaccccaagagcggcaccacctggatgattgagatcatctgcctgatcctgaaggagggggaccccagctggatccgctctgtgcccatctgggagcgggccccctggtgtgagaccatcgtgggcgccttcagcctgcctgaccagtacagcccccggctgatgagcagccacctgcccatccagatcttcaccaaggccttcttcagcagcaaggccaaggtgatctacatgggcaggaaccccagagatgtggtggtgtccctgtaccactacagcaagattgctggccagctgaaggaccccggcaccccagaccagttcctgcgggacttcctgaagggggaggtgcagtttggctcctggtttgaccacatcaagggctggctgaggatgaagggcaaggacaacttcctgttcatcacctatgaggagctgcagcaggacctgcagggctctgtggagcgcatctgtggcttcctgggccggcccctgggcaaggaggccctgggctctgtggtggcccacagcaccttcagcgccatgaaggccaacaccatgagcaactacaccctgctgccccccagcctgctggaccaccggcggggggccttcctgaggaaaggagtgtgtggggactggaagaaccacttcaccgtggcccagagcgaggcctttgaccgggcctacaggaagcagatgaggggcatgcccaccttcccctgggatgaagatcctgaagaagatggcagcccagaccctgagcccagccctgagcctgagcccaagcccagcctggagcccaacaccagcctggagcgggagccccggcccaacagcagccccagccccagccctggccaggccagcgagaccccccacccccggcccagctag

SEQ ID NO: 171958 - DNA, 1053 bp, Artificial Sequence
  Description of Artificial Sequence: Synthetic coding sequence
atggccagccccccacccttccacagccagaagctgcctggagagtacttccgctacaagggcgtgcccttccctgtgggcctgtacagcctggagagcatcagcctggccgagaacacccaggatgtgagagatgatgacatcttcatcatcacctaccccaagagcggcaccacctggatgattgagatcatctgcctgatcctgaaggagggggaccccagctggatccgctctgtgcccatctgggagcgggccccctggtgtgagaccatcgtgggcgccttcagcctgcctgaccagtacagcccccggctgatgagcagccacctgcccatccagatcttcaccaaggccttcttcagcagcaaggccaaggtgatctacatgggcaggaaccccagagatgtggtggtgtccctgtaccactacagcaagattgctggccagctgaaggaccccggcaccccagaccagttcctgcgggacttcctgaagggggaggtgcagtttggctcctggtttgaccacatcaagggctggctgaggatgaagggcaaggacaacttcctgttcatcacctatgaggagctgcagcaggacctgcagggctctgtggagcgcatctgtggcttcctgggccggcccctgggcaaggaggccctgggctctgtggtggcccacagcaccttcagcgccatgaaggccaacaccatgagcaactacaccctgctgccccccagcctgctggaccacagaagaggagccttcctgaggaagggcgtgtgtggggactggaagaaccacttcaccgtggcccagagcgaggcctttgaccgggcctacaggaagcagatgaggggcatgcccaccttcccctgggatgaggaccctgaggaggatggcagcccagaccctgagcccagccctgagcctgagcccaagcccagcctggagcccaacaccagcctggagcgggagccccggcccaacagcagccccagccccagccctggccaggccagcgagaccccccacccccggcccagctag

SEQ ID NO: 171959 - DNA, 1041 bp, Artificial Sequence
  Description of Artificial Sequence: Synthetic coding sequence
atggtggagaaggaggaggccggcggcggcatcagcgaggaggaggccgcccagtatgaccggcagatccggctgtggggcctggaggcccagaagaggctgcgggccagccgggtgctgctggtgggcctgaagggcctgggcgctgagatcgccaagaacctgatcctggccggcgtgaagggcctgaccatgctggaccacgagcaggtgaccccagaggaccccggggcccagttcctgatcagaacaggctctgtgggcaggaacagagctgaggccagcctggagcgggcccagaacctgaaccccatggtggatgtgaaggtggacacagaagatattgagaagaagccagagagcttcttcacccagtttgatgctgtgtgcctgacctgctgcagcagagatgtgattgtgaaggtggaccagatctgccacaagaacagcatcaagttcttcaccggagatgtgtttggctaccacggctacacctttgccaacctgggggagcacgagtttgtggaggagaagaccaaggtggccaaggtgtcccagggcgtggaggatggccctgacaccaagagggccaagctggacagcagcgagaccaccatggtgaagaagaaggtggtgttctgccctgtgaaggaggccctggaggtggactggagcagcgagaaggccaaggccgccctgaagaggaccaccagtgactacttcctgctgcaggtgctgctgaagttcagaacagacaagggccgggaccccagcagtgacacctatgaggaggacagcgagctgctgctgcagatcagaaatgatgtgctggacagcctgggcatcagcccagacctgctgcctgaagattttgtgcgctactgcttcagcgagatggcccctgtgtgtgctgtggtgggcggcatcctggcccaggagatcgtgaaggccctgagccagagggaccccccccacaacaacttcttcttctttgatggcatgaagggaaatggaattgtggagtgcctgggccccaagtag

SEQ ID NO: 171960 - DNA, 801 bp, Artificial Sequence
  Description of Artificial Sequence: Synthetic coding sequence
atggtggagaaggaggaggccggcggcggcatcagcgaggaggaggccgcccagtatgaccggcagatccggctgtggggcctggaggcccagaagaggctgcgggccagccgggtgctgctggtgggcctgaagggcctgggcgctgagatcgccaagaacctgatcctggccggcgtgaagggcctgaccatgctggaccacgagcaggtgaccccagaggaccccggggcccagttcctgatcagaacaggctctgtgggcaggaacagagctgaggccagcctggagcgggcccagaacctgaaccccatggtggatgtgaaggtggacacagaagatattgagaagaagccagagagcttcttcacccagtttgatgctgtgtgcctgacctgctgcagcagagatgtgattgtgaaggtggaccagatctgccacaagaacagcatcaagttcttcaccggagatgtgtttggctaccacggctacacctttgccaacctgggggagcacgagtttgtggaggagaagaccaaggtggccaaggtgtcccagggcgtggaggatggccctgacaccaagagggccaagctggacagcagcgagaccaccatggtgaagaagaaggtggtgttctgccctgtgaaggaggccctggaggtggactggagcagcgagaaggccaaggccgccctgaagaggaccaccagtgactacttcctgctgcagggcacagccagcccccgctggccccagtgtgtgcgctggctggagggcttctggcacaggaagctgtag

SEQ ID NO: 171961 - DNA, 900 bp, Artificial Sequence
  Description of Artificial Sequence: Synthetic coding sequence
atggtggagaaggaggaggccggcggcggcatcagcgaggaggaggccgcccagtatgaccggcagatccggctgtggggcctggaggcccagaagaggctgcgggccagccgggtgctgctggtgggcctgaagggcctgggcgctgagatcgccaagaacctgatcctggccggcgtgaagggcctgaccatgctggaccacgagcaggtgaccccagaggaccccggggcccagttcctgatcagaacaggctctgtgggcaggaacagagctgaggccagcctggagcgggcccagaacctgaaccccatggtggatgtgaaggtggacacagaagatattgagaagaagccagagagcttcttcacccagtttgatgctgtgtgcctgacctgctgcagcagagatgtgattgtgaaggtggaccagatctgccacaagaacagcatcaagttcttcaccggagatgtgtttggctaccacggctacacctttgccaacctgggggagcacgagtttgtggaggagaagaccaaggtggccaaggtgtcccagggcgtggaggatggccctgacaccaagagggccaagctggacagcagcgagaccaccatggtgaagaagaaggtggtgttctgccctgtgaaggaggccctggaggtggactggagcagcgagaaggccaaggccgccctgaagaggaccaccagtgactacttcctgctgcagggccctgtgtctgctggccccagcagccagcagctgctgctgctgcgctggcatgaaggagagtgggactgtggggtgccctggccccaggtgaacagcagatttggcagccccagagatgccaactgcagcatgcccacctgcatcccctgccccctgcccagctag

SEQ ID NO: 171962 - DNA, 900 bp, Artificial Sequence
  Description of Artificial Sequence: Synthetic coding sequence
atggtggagaaggaggaggccggcggcggcatcagcgaggaggaggccgcccagtatgaccggcagatccggctgtggggcctggaggcccagaagaggctgcgggccagccgggtgctgctggtgggcctgaagggcctgggcgctgagatcgccaagaacctgatcctggccggcgtgaagggcctgaccatgctggaccacgagcaggtgaccccagaggaccccggggcccagttcctgatcagaacaggctctgtgggcaggaacagagctgaggccagcctggagcgggcccagaacctgaaccccatggtggatgtgaaggtggacacagaagatattgagaagaagccagagagcttcttcacccagtttgatgctgtgtgcctgacctgctgcagcagagatgtgattgtgaaggtggaccagatctgccacaagaacagcatcaagttcttcaccggagatgtgtttggctaccacggctacacctttgccaacctgggggagcacgagtttgtggaggagaagaccaaggtggccaaggtgtcccagggcgtggaggatggccctgacaccaagagggccaagctggacagcagcgagaccaccatggtgaagaagaaggtggtgttctgccctgtgaaggaggccctggaggtggactggagcagcgagaaggccaaggccgccctgaagaggaccaccagtgactacttcctgctgcaggagctgttcccccgcatcgtggagcgggtgtatgcccagaggcaccccaggagcacagagaggacccacgccaagatgctgatccccttcctgaccaaggagaagccaggcttcctgggggagatggctgtgagccgctctggagtgggcaagctgcagtgcagctag

SEQ ID NO: 171963 - DNA, 519 bp, Artificial Sequence
  Description of Artificial Sequence: Synthetic coding sequence
atgctggagaagaccaaggtggccaaggtgtcccagggcgtggaggatggccctgacaccaagagggccaagctggacagcagcgagaccaccatggtgaagaagaaggtggtgttctgccctgtgaaggaggccctggaggtggactggagcagcgagaaggccaaggccgccctgaagaggaccaccagtgactacttcctgctgcaggtgctgctgaagttcagaacagacaagggccgggaccccagcagtgacacctatgaggaggacagcgagctgctgctgcagatcagaaatgatgtgctggacagcctgggcatcagcccagacctgctgcctgaagattttgtgcgctactgcttcagcgagatggcccctgtgtgtgctgtggtgggcggcatcctggcccaggagatcgtgaaggccctgagccagagggaccccccccacaacaacttcttcttctttgatggcatgaagggaaatggaattgtggagtgcctgggccccaagtag

SEQ ID NO: 171964 - DNA, 1935 bp, Artificial Sequence
  Description of Artificial Sequence: Synthetic coding sequence
atggatgacattgctgacaggatgaggatggatgctggggaggtgaccctggtgaaccacaacagcgtcttcaagacccacctgctgccccagacaggcttccctgaggaccagctgagcctgagtgaccagcagatcctgagcagccggcagggccacctggaccgctccttcacctgcagcaccaggtctgctgcctacaaccccagctactacagcgacaaccccagcagtgacagcttcctgggcagcggggacctgcggaccttcggccagagcgccaacggccagtggaggaacagcacccccagcagcagcagcagcctgcagaagagcaggaacagccgcagcctgtacctggagaccaggaagaccagcagcggcctgagcaacagctttgctgggaagagcaaccaccactgccacgtgtctgcctatgagaagagcttccccatcaagcctgtgcccagccccagctggagcggcagctgcagaagaagcctgctgagccccaagaagacccagaggagacatgtgtccacagctgaggagaccgtgcaggaggaggagcgggagatctaccggcagctgctgcagatggtgacaggcaagcagttcaccatcgccaagcccaccacccacttccccctgcacctgagccgctgcctgagcagcagcaagaacaccctgaaggacagcctcttcaagaatggaaacagctgtgccagccagatcatcggcagtgacaccagcagcagcggcagcgccagcatcctgaccaaccaggagcagctgagccacagcgtgtacagcctgagcagctacaccccagatgtggccttcggcagcaaggacagcggcaccctgcaccacccccaccaccaccacagcgtgccccaccagcctgacaacctggccgccagcaacacccagagcgagggcagtgacagcgtcatcctgctgaaggtgaaggacagccagacccccacccccagcagcaccttcttccaggccgagctgtggatcaaggagctgacctctgtgtatgacagccgggcccgggagcggctgcggcagatcgaggagcagaaggccctggccctgcagctgcagaaccagaggctgcaggagcgggagcacagcgtgcatgattctgtggagctgcacctgcgggtgcccctggagaaggagatccctgtgacagtggtgcaggagacccagaagaagggccacaagctgacagacagtgaagatgagttccctgagatcacagaggagatggagaaggagatcaagaatgtgttcagaaatggaaaccaggatgaggtgctgtctgaggccttccggctgaccatcaccaggaaggacatccagaccctgaaccacctgaactggctgaatgatgagatcatcaacttctacatgaacatgctgatggagaggagcaaggagaagggcctgcccagcgtgcacgccttcaacaccttcttcttcaccaagctgaagacagctggctaccaggccgtgaagcgctggaccaagaaggtggatgtgttttctgtggacatcctgctggtgcccatccacctgggcgtgcactggtgcctggccgtggtggacttcaggaagaagaacatcacctactatgacagcatgggcggcatcaacaatgaggcctgccgcatcctgctgcagtacctgaagcaggagagcattgacaagaagaggaaggagtttgacaccaacggctggcagctgttcagcaagaagagccaggagatcccccagcagatgaatggaagtgactgtggcatgtttgcctgcaagtatgctgactgcatcaccaaggaccggcccatcaacttcacccagcagcacatgccctacttcaggaagaggatggtgtgggagatcctgcacaggaagctgctgtag

SEQ ID NO: 171965 - DNA, 489 bp, Artificial Sequence
  Description of Artificial Sequence: Synthetic coding sequence
atgaagatccccctgacagccaccatctgcctgcccggcagcagccccccaggcctgtgcatctttgccaaggtgtctgatgtgaagaggctggagatggatgacattgctgacaggatgaggatggatgctggggaggtgaccctggtgaaccacaacagcgtcttcaagacccacctgctgccccagacaggcttccctgaggaccagctgagcctgagtgaccagcagatcctgagcagccggcagggccacctggaccgctccttcacctgcagcaccaggtctgctgcctacaaccccagctactacagcggccctggcctgggcgtgctggcccgctacagctggggcaagatgctgacctttggaggccaccacggcgtgaccctgatgcagatccgccacatggctgtggccggcttcagcagcttcatcaacttccagatcatcctgccccagacagtgttcctggcccaggccatctag

SEQ ID NO: 171966 - DNA, 1932 bp, Artificial Sequence
  Description of Artificial Sequence: Synthetic coding sequence
atggatgacattgctgacaggatgaggatggatgctggggaggtgaccctggtgaaccacaacagcgtcttcaagacccacctgctgccccagacaggcttccctgaggaccagctgagcctgagtgaccagcagatcctgagcagccggcagggccacctggaccgctccttcacctgcagcaccaggtctgctgcctacaaccccagctactacagcgacaaccccagcagtgacagcttcctgggcagcggggacctgcggaccttcggccagagcgccaacggccagtggaggaacagcacccccagcagcagcagcagcctgcagaagagcaggaacagccgcagcctgtacctggagaccaggaagaccagcagcggcctgagcaacagctttgctgggaagagcaaccaccactgccacgtgtctgcctatgagaagagcttccccatcaagcctgtgcccagccccagctggagcggcagctgcagaagaagcctgctgagccccaagaagacccagaggagacatgtgtccacagctgaggagaccgtgcaggaggaggagcgggagatctaccggcagctgctgcagatggtgacaggcaagcagttcaccatcgccaagcccaccacccacttccccctgcacctgagccgctgcctgagcagcagcaagaacaccctgaaggacagcctcttcaagaatggaaacagctgtgccagccagatcatcggcagtgacaccagcagcagcggcagcgccagcatcctgaccaaccaggagcagctgagccacagcgtgtacagcctgagcagctacaccccagatgtggccttcggcagcaaggacagcggcaccctgcaccacccccaccaccaccacagcgtgccccaccagcctgacaacctggccgccagcaacacccagagcgagggcagtgacagcgtcatcctgctgaaggtgaaggacagccagacccccacccccagcagcaccttcttccaggccgagctgtggatcaaggagctgacctctgtgtatgacagccgggcccgggagcggctgcggcagatcgaggagcagaaggccctggccctgcagctgcagaaccagaggctgcaggagcgggagcacagcgtgcatgattctgtggagctgcacctgcgggtgcccctggagaaggagatccctgtgacagtggtgcaggagacccagaagaagggccacaagctgacagacagtgaagatgagttccctgagatcacagaggagatggagaaggagatcaagaatgtgttcagaaatggaaaccaggatgaggtgctgtctgaggccttccggctgaccatcaccaggaaggacatccagaccctgaaccacctgaactggctgaatgatgagatcatcaacttctacatgaacatgctgatggagaggagcaaggagaagggcctgcccagcgtgcacgccttcaacaccttcttcttcaccaagctgaagacagctggctaccaggccgtgaagcgctggaccaagaaggtggatgtgttttctgtggacatcctgctggtgcccatccacctgggcgtgcactggtgcctggccgtggtggacttcaggaagaagaacatcacctactatgacagcatgggcggcatcaacaatgaggcctgccgcatcctgctgcagtacctgaagcaggagagcattgacaagaagaggaaggagtttgacaccaacggctggcagctgttcagcaagaagagccagatcccccagcagatgaatggaagtgactgtggcatgtttgcctgcaagtatgctgactgcatcaccaaggaccggcccatcaacttcacccagcagcacatgccctacttcaggaagaggatggtgtgggagatcctgcacaggaagctgctgtag

SEQ ID NO: 171967 - DNA, 1935 bp, Artificial Sequence; identical to SEQ ID NO: 171964
  Description of Artificial Sequence: Synthetic coding sequence

SEQ ID NO: 171968 - DNA, 1932 bp, Artificial Sequence; identical to SEQ ID NO: 171966
  Description of Artificial Sequence: Synthetic coding sequence

SEQ ID NO: 171969 - DNA, 1935 bp, Artificial Sequence; identical to SEQ ID NO: 171964
  Description of Artificial Sequence: Synthetic coding sequence

SEQ ID NO: 171970 - DNA, 2268 bp, Artificial Sequence
  Description of Artificial Sequence: Synthetic coding sequence
atgaagaagcagaggaagatcctgtggaggaagggcatccacctggccttcagcgagaagtggaacacaggctttggaggcttcaagaagttctacttccaccagcacctgtgcatcctgaaggccaagctgggccggcctgtgacctggaaccggcagctgcggcacttccagggcaggaagaaggccctgcagatccagaagacctggatcaaggatgagcccctgtgtgccaagaccaagttcaacgtggccacccagaatgtgtccaccctgagcagcaaggtgaagaggaaggatgccaagcacttcatcagcagcagcaagaccctgctgcggctgcaggccgagaagctgctgagcagcgccaagaacagcgaccacgagtactgccgggagaagaacctgctgaaggctgtgacagacttccccagcaacagcgccctgggccaggccaacggccaccggcccaggacagacccccagcccagcgacttccccatgaagttcaatggagagagccagagccctggagagagcggcaccatcgtggtgaccctgaacaaccacaagaggaagggcttctgctacggctgctgccagggccctgagcaccacagaaatggaggccccctcatccccaagaagttccagctgaaccagcaccggcgcatcaagctgagccccctgatgatgtatgagaagctgtccatgatccgcttccgctaccgcatcctgcggagccagcacttccgcaccaagagcaaggtgtgcaagctgaggaaggcccagaggtcctgggtgcagaaggtgactggagaccaccaggagaccaggagagaaaatggagagggcggcagctgcagccccttccccagccctgagcccaaggaccccagctgccgccaccagccctacttcccagacatggacagcagcgctgtggtgaagggcaccaacagccacgtgcctgactgccacaccaagggcagcagcttcctgggcaaggagctgagcctggatgaggccttcccagaccagcagaatggaagtgccaccaatgcctgggaccagagcagctgcagcagccccaagtgggagtgcacagagctgattcatgacatccccctgcctgagcacaggagcaacaccatgttcatcagcgagacagagcgggagatcatgaccctgggccaggagaaccagaccagctctgtgtctgatgacagagtgaagctgtctgtgtctggagctgacacctctgtgtcctctgtggatggccctgtgtcccagaaggctgtgcagaatgaaaattcctaccagatggaggaggatggcagcctgaagcagagcatcctgagcagcgagctgctggaccacccctactgcaagagccccctggaggcccccctggtgtgcagcggcctgaagctggagaaccaggtgggcggcggcaagaacagccagaaggccagccctgtggatgatgagcagctgtctgtgtgcctgagcggcttcctggatgaggtgatgaagaagtatggcagcctggtgcccctgtctgagaaggaggtgctgggccgcctgaaggatgtgttcaatgaagacttcagcaacaggaagcccttcatcaaccgggagatcaccaactaccgggcccggcaccagaagtgcaacttccgcatcttctacaacaagcacatgctggacatggatgacctggccaccctggatggccagaactggctgaatgaccaggtgatcaacatgtatggagagctgatcatggatgctgtgcctgacaaggtgcacttcttcaacagcttcttccaccggcagctggtgaccaagggctacaacggggtgaagcgctggaccaagaaggtggacctcttcaagaagagcctgctgctgatccccatccacctggaggtgcactggagcctcatcaccgtgaccctgagcaaccgcatcatctccttctatgacagccagggcatccacttcaagttctgtgtggagaacatcaggaagtacctgctgacagaggcccgggagaagaacagacctgagttcctgcagggctggcagacagctgtgaccaagtgcatcccccagcagaagaatgacagcgactgtggggtgtttgtgctgcagtactgcaagtgcctggccctggagcagcccttccagttcagccaggaggacatgccccgggtgaggaagaggatctacaaggagctgtgtgagtgccgcctgatggactag

SEQ ID NO: 171971 - DNA, 3318 bp, Artificial Sequence
  Description of Artificial Sequence: Synthetic coding sequence
atggctgctgggaagagcggcggcagcgctggggagatcaccttcctggaggccctggcccggtctgagagcaagagagatggcggcttcaagaacaactggagctttgaccacgaggaggagagcgagggggacacagacaaggatggcaccaacctgctgtctgtggatgaagatgaggacagcgagaccagcaagggcaagaagctgaacagaagaagtgagatcgtggccaacagcagtggagagttcatcctgaagacctacgtgagaagaaacaagtctgagagcttcaagaccctgaagggcaaccccatcggcctgaacatgctgagcaacaacaagaagctgtctgagaacacccagaacaccagcctgtgcagcggcaccgtggtgcatggaagacgcttccaccacgcccacgcccagatccctgtggtgaagacagctgcccagaggaaggagtacccacctcatgtgcagaaggtggagatcaaccctgtgcggctgagccggctgcagggcgtggagcgcatcatgaagaagacagaggagagcgagagccaggtggagcctgagatcaagaggaaggtgcagcagaagaggcactgcagcacctaccagcccaccccacccctgagccctgccagcaagaagtgcctgacccacctggaggacctgcagaggaactgccggcaggccatcaccctgaatgaaagcacaggccccctgctgcggaccagcatccaccagaacagcggcggccagaagagccagaacacaggcctgaccaccaagaagttctacggcaacaacgtggagaaggtgcccatcgacatcatcgtgaactgtgatgacagcaagcacacctacctgcagaccaacgggaaggtgatcctgcccggggccaagatccccaagatcaccaacctgaaggagaggaagaccagcctgagtgacctgaatgaccccatcatcctgagcagtgatgatgatgatgacaatgacaggaccaacagaagagagagcatcagcccccagcctgctgacagcgcctgcagcagccctgcccccagcacaggcaaggtggaggccgccctgaatgaaaacacctgcagagctgagcgggagctgcggagcatcccagaagattctgagctgaacacagtgaccctgcccaggaaggccaggatgaaggaccagtttggaaacagcatcatcaacacccccctgaagaggaggaaggtgttcagccaggagcccccagatgccctggccctgagctgccagagcagctttgattctgtcatcctgaactgccgcagcatccgggtgggcaccctcttccggctgctgattgagcctgtgatcttctgcctggacttcatcaagatccagctggatgagccagaccatgaccctgtggagatcatcctgaacaccagtgacctgaccaagtgtgagtggtgcaatgtgaggaagctgcctgtggtgttcctgcaggccatcccagctgtgtaccagaagctgagcatccagctgcagatgaacaaggaggacaaggtgtggaatgactgcaagggcgtgaacaagctgaccaacctggaggagcagtacatcatcctgatcttccagaatggcctggaccccccagccaacatggtgtttgagagcatcatcaatgaaattggcatcaagaacaacatcagcaacttctttgccaagatcccctttgaggaggccaacggccgcctggtggcctgcaccaggacctatgaggagagcatcaagggcagctgtggccagaaggagaacaagatcaagacagtgtcctttgagagcaagatccagctgcggagcaagcaggagttccagttctttgatgaggaggaggagactggagagaaccacaccatcttcatcggccctgtggagaagctgattgtgtacccacctcctccagccaagggcggcatctctgtgaccaatgaagacctgcactgcctgaatgaaggagagttcctgaatgatgtgatcatcgacttctacctgaagtacctggtgctggagaagctgaagaaggaggatgctgaccgcatccacatcttcagcagcttcttctacaagaggctgaaccagcgggagaggagaaatcatgagaccaccaacctgagcatccagcagaagagacatggccgggtgaagacctggaccaggcatgtggacatctttgagaaggacttcatctttgtgcccctgaatgaggccgcccactggttcctggccgtggtgtgcttccctggcctggagaagcccaagtatgagcccaacccccactaccatgaaaatgctgtgatccagaagtgcagcacagtggaggacagctgcatcagcagcagcgccagcgagatggagagctgcagccagaacagcagcgccaagcctgtgatcaagaagatgctgaacaagaagcactgcatcgccgtcatcgacagcaaccctggccaggaggagagtgacccccgctacaagaggaacatctgcagcgtgaagtacagcgtgaagaagatcaaccacacagcctctgaaaatgaggagttcaacaagggggagagcaccagccagaaggtggccgacaggaccaagtcagaaaatggcctgcagaatgaaagcctgagcagcacccaccacacagatggcctgagcaagatccggctgaactacagtgatgagagccctgaggccggcaagatgctggaggatgagctggtggacttcagcgaggaccaggacaaccaggatgacagcagtgatgatggcttcctggctgatgacaactgcagcagcgagatcggccagtggcacctgaagcccaccatctgcaagcagccctgcatcctgctgatggacagcctgcggggccccagccgcagcaatgtggtgaagatcctgcgggagtacctggaggtggagtgggaggtgaagaagggcagcaagaggagcttcagcaaggatgtgatgaagggcagcaaccccaaggtgccccagcagaacaacttcagtgactgtggggtgtatgtgctgcagtatgtggagagcttctttgagaaccccatcctgagctttgagctgcccatgaacctggccaactggttccccccacccaggatgaggaccaagcgggaggagatccggaacatcatcctgaagctgcaggaggaccagagcaaggagaagaggaagcacaaggacacctacagcacagaggcccccctgggggagggcacagagcagtatgtgaacagcatcagtgactag

SEQ ID NO: 171972 - DNA, 3339 bp, Artificial Sequence
  Description of Artificial Sequence: Synthetic coding sequence
atggctgctgggaagagcggcggcagcgctggggagatcaccttcctggaggccctggcccggtctgagagcaagagagatggcggcttcaagaacaactggagctttgaccacgaggaggagagcgagggggacacagacaaggatggcaccaacctgctgtctgtggatgaagatgaggacagcgagaccagcaagggcaagaagctgaacagaagaagtgagatcgtggccaacagcagtggagagttcatcctgaagacctacgtgagaagaaacaagtctgagagcttcaagaccctgaagggcaaccccatcggcctgaacatgctgagcaacaacaagaagctgtctgagaacacccagaacaccagcctgtgcagcggcaccgtggtgcatggaagacgcttccaccacgcccacgcccagatccctgtggtgaagacagctgcccagaggctgctgagcaaccagatcctgaaggagtacccaccccacgtgcagaaggtggagatcaaccctgtgcggctgagccggctgcagggcgtggagcgcatcatgaagaagacagaggagagcgagagccaggtggagcctgagatcaagaggaaggtgcagcagaagaggcactgcagcacctaccagcccaccccacccctgagccctgccagcaagaagtgcctgacccacctggaggacctgcagaggaactgccggcaggccatcaccctgaatgaaagcacaggccccctgctgcggaccagcatccaccagaacagcggcggccagaagagccagaacacaggcctgaccaccaagaagttctacggcaacaacgtggagaaggtgcccatcgacatcatcgtgaactgtgatgacagcaagcacacctacctgcagaccaacgggaaggtgatcctgcccggggccaagatccccaagatcaccaacctgaaggagaggaagaccagcctgagtgacctgaatgaccccatcatcctgagcagtgatgatgatgatgacaatgacaggaccaacagaagagagagcatcagcccccagcctgctgacagcgcctgcagcagccctgcccccagcacaggcaaggtggaggccgccctgaatgaaaacacctgcagagctgagcgggagctgcggagcatccctgaggacagcgagctgaacacagtgaccctgcccaggaaggccaggatgaaggaccagtttggaaacagcatcatcaacacccccctgaagaggaggaaggtgttcagccaggagcccccagatgccctggccctgagctgccagagcagctttgacagcgtcatcctgaactgccgcagcatccgggtgggcaccctcttccggctgctgattgagcccgtcatcttctgcctggacttcatcaagatccagctggatgagccagaccatgaccctgtggagatcatcctgaacaccagtgacctgaccaagtgtgagtggtgcaatgtgaggaagctgcctgtggtgttcctgcaggccatcccagctgtgtaccagaagctgagcatccagctgcagatgaacaaggaggacaaggtgtggaatgactgcaagggcgtgaacaagctgaccaacctggaggagcagtacatcatcctgatcttccagaatggcctggaccccccagccaacatggtgtttgagagcatcatcaatgagatcggcatcaagaacaacatcagcaacttctttgccaagatcccctttgaggaggccaacggccgcctggtggcctgcaccaggacctatgaggagagcatcaagggcagctgtggccagaaggagaacaagatcaagacagtgtcctttgagagcaagatccagctgcggagcaagcaggagttccagttctttgatgaggaggaggagaccggggagaaccacaccatcttcatcggccctgtggagaagctgattgtgtacccacctcctccagccaagggcggcatctctgtgaccaatgaagacctgcactgcctgaatgaaggagagttcctgaatgatgtgatcatcgacttctacctgaagtacctggtgctggagaagctgaagaaggaggatgctgaccgcatccacatcttcagcagcttcttctacaagaggctgaaccagcgggagaggaggaaccacgagaccaccaacctgagcatccagcagaagagacatggccgggtgaagacctggaccaggcatgtggacatctttgagaaggacttcatctttgtgcccctgaatgaagctgcccactggttcctggccgtggtgtgcttccctggcctggagaagcccaagtatgagcccaacccccactaccatgaaaatgctgtgatccagaagtgcagcacagtggaggacagctgcatcagcagcagcgccagcgagatggagagctgcagccagaacagcagcgccaagcctgtgatcaagaagatgctgaacaagaagcactgcatcgctgtgattgacagcaaccctggccaggaggagagtgacccccgctacaagaggaacatctgcagcgtgaagtacagcgtgaagaagatcaaccacacagcctctgaaaatgaggagttcaacaagggggagagcaccagccagaaggtggccgacaggaccaagtcagaaaatggcctgcagaatgaaagcctgagcagcacccaccacacagatggcctgagcaagatccggctgaactacagtgatgagagccctgaggccggcaagatgctggaggatgagctggtggacttcagcgaggaccaggacaaccaggatgacagcagtgatgatggcttcctggctgatgacaactgcagcagcgagatcggccagtggcacctgaagcccaccatctgcaagcagccctgcatcctgctgatggacagcctgcggggccccagccgcagcaatgtggtgaagatcctgcgggagtacctggaggtggagtgggaggtgaagaagggcagcaagaggagcttcagcaaggatgtgatgaagggcagcaaccccaaggtgccccagcagaacaacttcagtgactgtggggtgtatgtgctgcagtatgtggagagcttctttgagaaccccatcctgagctttgagctgcccatgaacctggccaactggttccccccacccaggatgaggaccaagcgggaggagatccggaacatcatcctgaagctgcaggaggaccagagcaaggagaagaggaagcacaaggacacctacagcacagaggcccccctgggggagggcacagagcagtatgtgaacagcatcagtgactag

SEQ ID NO: 171973 - DNA, 3339 bp, Artificial Sequence
  Description of Artificial Sequence: Synthetic coding sequence
atggctgctgggaagagcggcggcagcgctggggagatcaccttcctggaggccctggcccggtctgagagcaagagagatggcggcttcaagaacaactggagctttgaccacgaggaggagagcgagggggacacagacaaggatggcaccaacctgctgtctgtggatgaagatgaggacagcgagaccagcaagggcaagaagctgaacagaagaagtgagatcgtggccaacagcagtggagagttcatcctgaagacctacgtgagaagaaacaagtctgagagcttcaagaccctgaagggcaaccccatcggcctgaacatgctgagcaacaacaagaagctgtctgagaacacccagaacaccagcctgtgcagcggcaccgtggtgcatggaagacgcttccaccacgcccacgcccagatccctgtggtgaagacagctgcccagagcagcctggacaggaaggagaggaaggagtacccaccccacgtgcagaaggtggagatcaaccctgtgcggctgagccggctgcagggcgtggagcgcatcatgaagaagacagaggagagcgagagccaggtggagcctgagatcaagaggaaggtgcagcagaagaggcactgcagcacctaccagcccaccccacccctgagccctgccagcaagaagtgcctgacccacctggaggacctgcagaggaactgccggcaggccatcaccctgaatgaaagcacaggccccctgctgcggaccagcatccaccagaacagcggcggccagaagagccagaacacaggcctgaccaccaagaagttctacggcaacaacgtggagaaggtgcccatcgacatcatcgtgaactgtgatgacagcaagcacacctacctgcagaccaacgggaaggtgatcctgcccggggccaagatccccaagatcaccaacctgaaggagaggaagaccagcctgagtgacctgaatgaccccatcatcctgagcagtgatgatgatgatgacaatgacaggaccaacagaagagagagcatcagcccccagcctgctgacagcgcctgcagcagccctgcccccagcacaggcaaggtggaggccgccctgaatgaaaacacctgcagagctgagcgggagctgcggagcatccctgaggacagcgagctgaacacagtgaccctgcccaggaaggccaggatgaaggaccagtttggaaacagcatcatcaacacccccctgaagaggaggaaggtgttcagccaggagcccccagatgccctggccctgagctgccagagcagctttgacagcgtcatcctgaactgccgcagcatccgggtgggcaccctcttccggctgctgattgagcccgtcatcttctgcctggacttcatcaagatccagctggatgagccagaccatgaccctgtggagatcatcctgaacaccagtgacctgaccaagtgtgagtggtgcaatgtgaggaagctgcctgtggtgttcctgcaggccatcccagctgtgtaccagaagctgagcatccagctgcagatgaacaaggaggacaaggtgtggaatgactgcaagggcgtgaacaagctgaccaacctggaggagcagtacatcatcctgatcttccagaatggcctggaccccccagccaacatggtgtttgagagcatcatcaatgagatcggcatcaagaacaacatcagcaacttctttgccaagatcccctttgaggaggccaacggccgcctggtggcctgcaccaggacctatgaggagagcatcaagggcagctgtggccagaaggagaacaagatcaagacagtgtcctttgagagcaagatccagctgcggagcaagcaggagttccagttctttgatgaggaggaggagaccggggagaaccacaccatcttcatcggccctgtggagaagctgattgtgtacccacctcctccagccaagggcggcatctctgtgaccaatgaagacctgcactgcctgaatgaaggagagttcctgaatgatgtgatcatcgacttctacctgaagtacctggtgctggagaagctgaagaaggaggatgctgaccgcatccacatcttcagcagcttcttctacaagaggctgaaccagcgggagaggaggaaccacgagaccaccaacctgagcatccagcagaagagacatggccgggtgaagacctggaccaggcatgtggacatctttgagaaggacttcatctttgtgcccctgaatgaagctgcccactggttcctggccgtggtgtgcttccctggcctggagaagcccaagtatgagcccaacccccactaccatgaaaatgctgtgatccagaagtgcagcacagtggaggacagctgcatcagcagcagcgccagcgagatggagagctgcagccagaacagcagcgccaagcctgtgatcaagaagatgctgaacaagaagcactgcatcgctgtgattgacagcaaccctggccaggaggagagtgacccccgctacaagaggaacatctgcagcgtgaagtacagcgtgaagaagatcaaccacacagcctctgaaaatgaggagttcaacaagggggagagcaccagccagaaggtggccgacaggaccaagtcagaaaatggcctgcagaatgaaagcctgagcagcacccaccacacagatggcctgagcaagatccggctgaactacagtgatgagagccctgaggccggcaagatgctggaggatgagctggtggacttcagcgaggaccaggacaaccaggatgacagcagtgatgatggcttcctggctgatgacaactgcagcagcgagatcggccagtggcacctgaagcccaccatctgcaagcagccctgcatcctgctgatggacagcctgcggggccccagccgcagcaatgtggtgaagatcctgcgggagtacctggaggtggagtgggaggtgaagaagggcagcaagaggagcttcagcaaggatgtgatgaagggcagcaaccccaaggtgccccagcagaacaacttcagtgactgtggggtgtatgtgctgcagtatgtggagagcttctttgagaaccccatcctgagctttgagctgcccatgaacctggccaactggttccccccacccaggatgaggaccaagcgggaggagatccggaacatcatcctgaagctgcaggaggaccagagcaaggagaagaggaagcacaaggacacctacagcacagaggcccccctgggggagggcacagagcagtatgtgaacagcatcagtgactag

SEQ ID NO: 171974 - DNA, 1074 bp, Artificial Sequence
  Description of Artificial Sequence: Synthetic coding sequence
atggctgctgggaagagcggcggcagcgctggggagatcaccttcctggaggccctggcccggtctgagagcaagagagatggcggcttcaagaacaactggagctttgaccacgaggaggagagcgagggggacacagacaaggatggcaccaacctgctgtctgtggatgaagatgaggacagcgagaccagcaagggcaagaagctgaacagaagaagtgagatcgtggccaacagcagtggagagttcatcctgaagacctacgtgagaagaaacaagtctgagagcttcaagaccctgaagggcaaccccatcggcctgaacatgctgagcaacaacaagaagctgtctgagaacacccagaacaccagcctgtgcagcggcaccgtggtgcatggaagacgcttccaccacgcccacgcccagatccctgtggtgaagacagctgcccagagcaaccagatcctgaaggagtacccacctcatgtgcagaaggtggagatcaaccctgtgcggctgagccggctgcagggcgtggtgatcctgagcagtgatgatgatgatgacaatgacaggaccaacagaagagagagcatcagcccccagcctgctgacagcgcctgcagcagccctgcccccagcacaggcaaggtggaggccgccctgaatgaaaacacctgcagagctgagcgggagctgcggagcatcccagaagattctgagctgaacacagtgaccctgcccaggaaggccaggatgaaggaccagtttggaaacagcatcatcaacacccccctgaagaggaggaaggtgttcagccaggagcccccagatgccctggccctgagctgccagagcagctttgattctgtcatcctgaactgccgcagcatccgggtgggcaccctcttccggctgctgattgagcctgtgattgtcatcatcaagatcttcttcatcacccacaagaagccagaccatgaccctgtggagatcatcctgaacaccagtgacctgaccaagtgtgagtggtgcaatgtgaggaagctgcctgtggtgttcctgcagtag

SEQ ID NO: 171975 - DNA, 1107 bp, Artificial Sequence
  Description of Artificial Sequence: Synthetic coding sequence
atgaaggaccagtttggaaacagcatcatcaacacccccctgaagaggaggaaggtgttcagccaggagcccccagatgccctggccctgagctgccagagcagctttgacagcgtcatcctgaactgccgcagcatccgggtgggcaccctcttccggctgctgattgagcccgtcatcttctgcctggacttcatcaagatccagctggatgagccagaccatgaccctgtggagatcatcctgaacaccagtgacctgaccaagtgtgagtggtgcaatgtgaggaagctgcctgtggtgttcctgcaggccatcccagctgtgtaccagaagctgagcatccagctgcagatgaacaaggaggacaaggtgtggaatgactgcaagggcgtgaacaagctgaccaacctggaggagcagtacatcatcctgatcttccagaatggcctggaccccccagccaacatggtgtttgagagcatcatcaatgagatcggcatcaagaacaacatcagcaacttctttgccaagatcccctttgaggaggccaacggccgcctggtggcctgcaccaggacctatgaggagagcatcaagggcagctgtggccagaaggagaacaagatcaagacagtgtcctttgagagcaagatccagctgcggagcaagcaggagttccagttctttgatgaggaggaggagaccggggagaaccacaccatcttcatcggccctgtggagaagctgattgtgtacccacctcctccagccaagggcggcatctctgtgaccaatgaagacctgcactgcctgaatgaaggagagttcctgaatgatgtgatcatcgacttctacctgaagtacctggtgctggagaagctgaagaaggaggatgctgaccgcatccacatcttcagcagcttcttctacaagaggctgaaccagcgggagaggaggaaccacgagaccaccaacctgagcatccagcagaagagacatggccgggtgaagacctggaccaggcatgtggacatctttgagaaggacttcatctttgtgcccctgaatgaggcctggctgaagcagaaccagaccaagctgtag

SEQ ID NO: 171976 - DNA, 2955 bp, Artificial Sequence
  Description of Artificial Sequence: Synthetic coding sequence
atggacaagaggaagctgggccggcggcccagcagcagcgagatcatcacagagggcaagaggaagaagagcagcagtgacctgtctgagatcaggaagatgctgaatgccaagccagaagatgtgcacgtgcagagccccctgagcaagttccgcagcagcgagcgctggaccctgcccctgcagtgggagaggagcctgaggaacaaggtgatcagcctggaccacaagaacaagaagcacatccggggctgccctgtgaccagcaagagcagccctgagcgcatccccagggtcatcctgaccaacgtgctgggcacagagctgggcaggaagtacatccgcaccccacctgtgacagagggcagcctgagtgacacagacaacctgcagagcgagcagctgagcagcagcagtgatggcagcctggagagctaccagaacctgaacccccacaagagctgctacctgtctgagcggggcagccagaggagcaagacagtggatgacaacagcgccaagcagacagcccacaacaaggagaagaggaggaaggatgatggcatcagcctgctgatcagtgacacccagcctgaggacctgaacagcggcagccggggctgtgaccacctggagcaggagagcaggaacaaggatgtgaagtacagcgacagcaaggtggagctgaccctcatcagcaggaagaccaagaggcggctgaggaacaacctgcctgacagccagtactgcaccagcctggacaagagcacagagcagaccaagaagcaggaggatgacagcaccatcagcacagaatttgagaagcccagcgagaactaccaccaggaccccaagctgcctgaggagatcaccaccaagcccaccaagagtgacttcaccaagctgagcagcctgaacagccaggagctgaccctgagcaatgccaccaagagcgccagcgctggcagcaccacagaaacagtggagaacagcaacagcattgacatcgtgggcatcagcagcctggtggagaaggatgaaaatgagctgaacaccatcgagaagcccatcctgcggggccacaatgaaggcaaccagagcctcatctctgctgagcccatcgtggtgtccagtgatgaggagggccctgtggagcacaagagcagcgagatcctgaagctgcagagcaagcaggaccgggagaccaccaatgaaaatgaaagcaccagcgagagcgccctgctggagctgcccctcatcacctgtgagagcgtgcagatgagcagcgagctgtgcccctacaaccctgtgatggagaacatcagcagcatcatgcccagcaatgagatggacctgcagctggacttcatcttcacctctgtgtacatcggcaagatcaagggggccagcaagggctgtgtgaccatcaccaagaagtacatcaagatccccttccaggtgtccctgaatgagatcagcctgctggtggacaccacccacctgaagcgcttcggcctgtggaagagcaaggatgacaaccacagcaagaggagccacgccatcctcttcttctgggtgtccagtgactacctgcaggagatccagacccagctggagcacagcgtgctgagccagcagagcaagagcagcgagttcatcttcctggagctgcacaaccctgtgtcccagcgggaggagctgaagctgaaggacatcatgacagagatcagcatcatcagcggggagctggagctgagctaccccctgtcctgggtgcaggccttccccctcttccagaacctgagcagcaaggagagcagcttcatccactactactgtgtgtccacctgcagcttccctgctggggtggccgtggccgaggagatgaagctgaagtctgtgtcccagcccagcaacacagatgctgccaagcccacctacaccttcctgcagaagcagagcagcggctgctacagcctgagcatcaccagcaacccagatgaggagtggagggaggtgcgccacacaggcctggtgcagaagctgattgtgtacccacctccacccaccaagggcggcctgggcgtgaccaatgaagacctggagtgcctggaggagggggagttcctgaatgatgtgatcatcgacttctacctgaagtacctgatcctggagaaggccagtgatgagctggtggagaggagccacatcttcagcagcttcttctacaagtgcctgaccaggaaggagaacaacctgacagaggacaaccccaacctgtccatggcccagaggaggcacaagagggtgaggacctggaccaggcacatcaacatcttcaacaaggactacatctttgtgcctgtgaatgaaagcagccactggtacctggccgtcatctgcttcccctggctggaggaggccgtgtatgaggacttcccccagacagtgtcccagcagagccaggcccagcagagccagaatgacaacaagaccatcgacaatgacctgcggaccaccagcaccctgagcctgtctgctgaggacagccagagcacagagagcaacatgtctgtgcccaagaagatgtgcaagaggccctgcatcctgatcctggacagcctgaaggccgcctctgtgcagaacacagtgcagaacctgcgggagtacctggaggtggagtgggaggtgaagctgaagacccaccggcagttcagcaagaccaacatggtggacctgtgccccaaggtgcccaagcaggacaacagcagtgactgtggggtgtacctgctgcagtatgtggagagcttcttcaaggaccccatcgtgaactttgagctgcccatccacctggagaagtggttccccaggcatgtgatcaagaccaagcgggaggacatccgggagctgatcctgaagctgcacctgcagcagcagaagggcagcagcagctag

SEQ ID NO: 171977 - DNA, 3054 bp, Artificial Sequence
  Description of Artificial Sequence: Synthetic coding sequence
atgctgaatgccaagccagaagatgtgcacgtgcagagccccctgagcaagttccgcagcagcgagcgctggaccctgcccctgcagtgggagaggagcctgaggaacaaggtgatcagcctggaccacaagaacaagaagcacatccggggctgccctgtgaccagcaagagcagccctgagcggcagctgaaggtgatgctgaccaacgtgctgtggacagacctgggcaggaagttcaggaagaccctgcccagaaatgatgccaacctgtgtgatgccaacaaggtgcagagcgacagcctgcccagcacctctgtggacagcctggagacctgccagaagctggagcccctgcggcagagcctgaacctgtctgagcgcatccccagggtcatcctgaccaacgtgctgggcacagagctgggcaggaagtacatccgcaccccacctgtgacagagggcagcctgagtgacacagacaacctgcagagcgagcagctgagcagcagcagtgatggcagcctggagagctaccagaacctgaacccccacaagagctgctacctgtctgagcggggcagccagaggagcaagacagtggatgacaacagcgccaagcagacagcccacaacaaggagaagaggaggaaggatgatggcatcagcctgctgatcagtgacacccagcctgaggacctgaacagcggcagccggggctgtgaccacctggagcaggagagcaggaacaaggatgtgaagtacagcgacagcaaggtggagctgaccctcatcagcaggaagaccaagaggcggctgaggaacaacctgcctgacagccagtactgcaccagcctggacaagagcacagagcagaccaagaagcaggaggatgacagcaccatcagcacagaatttgagaagcccagcgagaactaccaccaggaccccaagctgcctgaggagatcaccaccaagcccaccaagagtgacttcaccaagctgagcagcctgaacagccaggagctgaccctgagcaatgccaccaagagcgccagcgctggcagcaccacagagaccgtggagaacagcaacagcattgatattgtgggcatcagcagcctggtggagaaggatgaaaatgagctgaacaccatcgagaagcccatcctgcggggccacaatgaaggcaaccagagcctcatctctgctgagcccatcgtggtgtccagtgatgaggagggccctgtggagcacaagagcagcgagatcctgaagctgcagagcaagcaggaccgggagaccaccaatgaaaatgaaagcaccagcgagagcgccctgctggagctgcccctcatcacctgtgagagcgtgcagatgagcagcgagctgtgcccctacaaccctgtgatggagaacatcagcagcatcatgcccagcaatgagatggacctgcagctggacttcatcttcacctctgtgtacatcggcaagatcaagggggccagcaagggctgtgtgaccatcaccaagaagtacatcaagatccccttccaggtgtccctgaatgagatcagcctgctggtggacaccacccacctgaagagatttggcctgtggaagagcaaggatgacaaccacagcaagaggagccacgccatcctcttcttctgggtgtccagtgactacctgcaggagatccagacccagctggagcacagcgtgctgagccagcagagcaagagcagcgagttcatcttcctggagctgcacaaccctgtgtcccagcgggaggagctgaagctgaaggacatcatgacagagatcagcatcatctctggagagctggagctgagctaccccctgtcctgggtgcaggccttccccctcttccagaacctgagcagcaaggagagcagcttcatccactactactgtgtgtccacctgcagcttccctgctggggtggccgtggccgaggagatgaagctgaagtctgtgtcccagcccagcaacacagatgctgccaagcccacctacaccttcctgcagaagcagagcagcggctgctacagcctgagcatcaccagcaacccagatgaggagtggagggaggtgcgccacacaggcctggtgcagaagctgattgtgtacccacctccacccaccaagggcggcctgggcgtgaccaatgaagacctggagtgcctggaggagggggagttcctgaatgatgtgatcatcgacttctacctgaagtacctgatcctggagaaggccagtgatgagctggtggagaggagccacatcttcagcagcttcttctacaagtgcctgaccaggaaagaaaacaacctgacagaggacaaccccaacctgtccatggcccagaggaggcacaagagggtgaggacctggaccaggcacatcaacatcttcaacaaggactacatctttgtgcctgtgaatgaaagcagccactggtacctggccgtcatctgcttcccctggctggaggaggccgtgtatgaggacttcccccagacagtgtcccagcagagccaggcccagcagagccagaatgacaacaagaccatcgacaatgacctgcggaccaccagcaccctgagcctgtctgctgaggacagccagagcacagagagcaacatgtctgtgcccaagaagatgtgcaagaggccctgcatcctgatcctggacagcctgaaggccgcctctgtgcagaacacagtgcagaacctgcgggagtacctggaggtggagtgggaggtgaagctgaagacccaccggcagttcagcaagaccaacatggtggacctgtgccccaaggtgcccaagcaggacaacagcagtgactgtggggtgtacctgctgcagtatgtggagagcttcttcaaggaccccatcgtgaactttgagctgcccatccacctggagaagtggttccccaggcatgtgatcaagaccaagcgggaggacatccgggagctgatcctgaagctgcacctgcagcagcagaagggcagcagcagctag

SEQ ID NO: 171978 - DNA, 2661 bp, Artificial Sequence
  Description of Artificial Sequence: Synthetic coding sequence
atgctgaatgccaagccagaagatgtgcacgtgcagagccccctgagcaagttccgcagcagcgagcgctggaccctgcccctgcagtgggagaggagcctgaggaacaaggtgatcagcctggaccacaagaacaagaagcacatccggggctgccctgtgaccagcaagagcagccctgagcggggcagccagaggagcaagacagtggatgacaacagcgccaagcagacagcccacaacaaggagaagaggaggaaggatgatggcatcagcctgctgatcagtgacacccagcctgaggacctgaacagcggcagccggggctgtgaccacctggagcaggagagcaggaacaaggatgtgaagtacagcgacagcaaggtggagctgaccctcatcagcaggaagaccaagaggcggctgaggaacaacctgcctgacagccagtactgcaccagcctggacaagagcacagagcagaccaagaagcaggaggatgacagcaccatcagcacagaatttgagaagcccagcgagaactaccaccaggaccccaagctgcctgaggagatcaccaccaagcccaccaagagtgacttcaccaagctgagcagcctgaacagccaggagctgaccctgagcaatgccaccaagagcgccagcgctggcagcaccacagaaacagtggagaacagcaacagcattgacatcgtgggcatcagcagcctggtggagaaggatgaaaatgagctgaacaccatcgagaagcccatcctgcggggccacaatgaaggcaaccagagcctcatctctgctgagcccatcgtggtgtccagtgatgaggagggccctgtggagcacaagagcagcgagatcctgaagctgcagagcaagcaggaccgggagaccaccaatgaaaatgaaagcaccagcgagagcgccctgctggagctgcccctcatcacctgtgagagcgtgcagatgagcagcgagctgtgcccctacaaccctgtgatggagaacatcagcagcatcatgcccagcaatgagatggacctgcagctggacttcatcttcacctctgtgtacatcggcaagatcaagggggccagcaagggctgtgtgaccatcaccaagaagtacatcaagatccccttccaggtgtccctgaatgagatcagcctgctggtggacaccacccacctgaagcgcttcggcctgtggaagagcaaggatgacaaccacagcaagaggagccacgccatcctcttcttctgggtgtccagtgactacctgcaggagatccagacccagctggagcacagcgtgctgagccagcagagcaagagcagcgagttcatcttcctggagctgcacaaccctgtgtcccagcgggaggagctgaagctgaaggacatcatgacagagatcagcatcatcagcggggagctggagctgagctaccccctgtcctgggtgcaggccttccccctcttccagaacctgagcagcaaggagagcagcttcatccactactactgtgtgtccacctgcagcttccctgctggggtggccgtggccgaggagatgaagctgaagtctgtgtcccagcccagcaacacagatgctgccaagcccacctacaccttcctgcagaagcagagcagcggctgctacagcctgagcatcaccagcaacccagatgaggagtggagggaggtgcgccacacaggcctggtgcagaagctgattgtgtacccacctccacccaccaagggcggcctgggcgtgaccaatgaagacctggagtgcctggaggagggggagttcctgaatgatgtgatcatcgacttctacctgaagtacctgatcctggagaaggccagtgatgagctggtggagaggagccacatcttcagcagcttcttctacaagtgcctgaccaggaaggagaacaacctgacagaggacaaccccaacctgtccatggcccagaggaggcacaagagggtgaggacctggaccaggcacatcaacatcttcaacaaggactacatctttgtgcctgtgaatgaaagcagccactggtacctggccgtcatctgcttcccctggctggaggaggccgtgtatgaggacttcccccagacagtgtcccagcagagccaggcccagcagagccagaatgacaacaagaccatcgacaatgacctgcggaccaccagcaccctgagcctgtctgctgaggacagccagagcacagagagcaacatgtctgtgcccaagaagatgtgcaagaggccctgcatcctgatcctggacagcctgaaggccgcctctgtgcagaacacagtgcagaacctgcgggagtacctggaggtggagtgggaggtgaagctgaagacccaccggcagttcagcaagaccaacatggtggacctgtgccccaaggtgcccaagcaggacaacagcagtgactgtggggtgtacctgctgcagtatgtggagagcttcttcaaggaccccatcgtgaactttgagctgcccatccacctggagaagtggttccccaggcatgtgatcaagaccaagcgggaggacatccgggagctgatcctgaagctgcacctgcagcagcagaagggcagcagcagctag

SEQ ID NO: 171979 - DNA, 717 bp, Artificial Sequence
  Description of Artificial Sequence: Synthetic coding sequence
atgaagaagttcctgtacatcaagtctgtgttccacaccctgaggatggcccagaggaggcacaagagggtgaggacctggaccaggcacatcaacatcttcaacaaggactacatctttgtgcctgtgaatgaaagcagccactggtacctggccgtcatctgcttcccctggctggaggaggccgtgtatgaggacttcccccagacagtgtcccagcagagccaggcccagcagagccagaatgacaacaagaccatcgacaatgacctgcggaccaccagcaccctgagcctgtctgctgaggacagccagagcacagagagcaacatgtctgtgcccaagaagatgtgcaagaggccctgcatcctgatcctggacagcctgaaggccgcctctgtgcagaacacagtgcagaacctgcgggagtacctggaggtggagtgggaggtgaagctgaagacccaccggcagttcagcaagaccaacatggtggacctgtgccccaaggtgcccaagcaggacaacagcagtgactgtggggtgtacctgctgcagtatgtggagagcttcttcaaggaccccatcgtgaactttgagctgcccatccacctggagaagtggttccccaggcatgtgatcaagaccaagcgggaggacatccgggagctgatcctgaagctgcacctgcagcagcagaagggcagcagcagctag

SEQ ID NO: 171980 - DNA, 2958 bp, Artificial Sequence
  Description of Artificial Sequence: Synthetic coding sequence
atggacaagaggaagctgggccggcggcccagcagcagcgagatcatcacagagggcaagaggaagaagagcagcagtgacctgtctgagatcaggaagatgctgaatgccaagccagaagatgtgcacgtgcagagccccctgagcaagttccgcagcagcgagcgctggaccctgcccctgcagtgggagaggagcctgaggaacaaggtgatcagcctggaccacaagaacaagaagcacatccggggctgccctgtgaccagcaagagcagccctgagcggcagctgaaggtgatgctgaccaacgtgctgtggacagacctgggcaggaagttcaggaagaccctgcccagaaatgatgccaacctgtgtgatgccaacaaggtgcagagcgacagcctgcccagcacctctgtggacagcctggagacctgccagaagctggagcccctgcggcagagcctgaacctgtctgagcggggcagccagaggagcaagacagtggatgacaacagcgccaagcagacagcccacaacaaggagaagaggaggaaggatgatggcatcagcctgctgatcagtgacacccagcctgaggacctgaacagcggcagccggggctgtgaccacctggagcaggagagcaggaacaaggatgtgaagtacagcgacagcaaggtggagctgaccctcatcagcaggaagaccaagaggcggctgaggaacaacctgcctgacagccagtactgcaccagcctggacaagagcacagagcagaccaagaagcaggaggatgacagcaccatcagcacagaatttgagaagcccagcgagaactaccaccaggaccccaagctgcctgaggagatcaccaccaagcccaccaagagtgacttcaccaagctgagcagcctgaacagccaggagctgaccctgagcaatgccaccaagagcgccagcgctggcagcaccacagagaccgtggagaacagcaacagcattgatattgtgggcatcagcagcctggtggagaaggatgaaaatgagctgaacaccatcgagaagcccatcctgcggggccacaatgaaggcaaccagagcctcatctctgctgagcccatcgtggtgtccagtgatgaggagggccctgtggagcacaagagcagcgagatcctgaagctgcagagcaagcaggaccgggagaccaccaatgaaaatgaaagcaccagcgagagcgccctgctggagctgcccctcatcacctgtgagagcgtgcagatgagcagcgagctgtgcccctacaaccctgtgatggagaacatcagcagcatcatgcccagcaatgagatggacctgcagctggacttcatcttcacctctgtgtacatcggcaagatcaagggggccagcaagggctgtgtgaccatcaccaagaagtacatcaagatccccttccaggtgtccctgaatgagatcagcctgctggtggacaccacccacctgaagagatttggcctgtggaagagcaaggatgacaaccacagcaagaggagccacgccatcctcttcttctgggtgtccagtgactacctgcaggagatccagacccagctggagcacagcgtgctgagccagcagagcaagagcagcgagttcatcttcctggagctgcacaaccctgtgtcccagcgggaggagctgaagctgaaggacatcatgacagagatcagcatcatctctggagagctggagctgagctaccccctgtcctgggtgcaggccttccccctcttccagaacctgagcagcaaggagagcagcttcatccactactactgtgtgtccacctgcagcttccctgctggggtggccgtggccgaggagatgaagctgaagtctgtgtcccagcccagcaacacagatgctgccaagcccacctacaccttcctgcagaagcagagcagcggctgctacagcctgagcatcaccagcaacccagatgaggagtggagggaggtgcgccacacaggcctggtgcagaagctgattgtgtacccacctccacccaccaagggcggcctgggcgtgaccaatgaagacctggagtgcctggaggagggggagttcctgaatgatgtgatcatcgacttctacctgaagtacctgatcctggagaaggccagtgatgagctggtggagaggagccacatcttcagcagcttcttctacaagtgcctgaccaggaaagaaaacaacctgacagaggacaaccccaacctgtccatggcccagaggaggcacaagagggtgaggacctggaccaggcacatcaacatcttcaacaaggactacatctttgtgcctgtgaatgaaagcagccactggtacctggccgtcatctgcttcccctggctggaggaggccgtgtatgaggacttcccccagacagtgtcccagcagagccaggcccagcagagccagaatgacaacaagaccatcgacaatgacctgcggaccaccagcaccctgagcctgtctgctgaggacagccagagcacagagagcaacatgtctgtgcccaagaagatgtgcaagaggccctgcatcctgatcctggacagcctgaaggccgcctctgtgcagaacacagtgcagaacctgcgggagtacctggaggtggagtgggaggtgaagctgaagacccaccggcagttcagcaagaccaacatggtggacctgtgccccaaggtgcccaagcaggacaacagcagtgactgtggggtgtacctgctgcagtatgtggagagcttcttcaaggaccccatcgtgaactttgagctgcccatccacctggagaagtggttccccaggcatgtgatcaagaccaagcgggaggacatccgggagctgatcctgaagctgcacctgcagcagcagaagggcagcagcagctag

SEQ ID NO: 171981 - DNA, 3153 bp, Artificial Sequence
  Description of Artificial Sequence: Synthetic coding sequence
atggacaagaggaagctgggccggcggcccagcagcagcgagatcatcacagagggcaagaggaagaagagcagcagtgacctgtctgagatcaggaagatgctgaatgccaagccagaagatgtgcacgtgcagagccccctgagcaagttccgcagcagcgagcgctggaccctgcccctgcagtgggagaggagcctgaggaacaaggtgatcagcctggaccacaagaacaagaagcacatccggggctgccctgtgaccagcaagagcagccctgagcggcagctgaaggtgatgctgaccaacgtgctgtggacagacctgggcaggaagttcaggaagaccctgcccagaaatgatgccaacctgtgtgatgccaacaaggtgcagagcgacagcctgcccagcacctctgtggacagcctggagacctgccagaagctggagcccctgcggcagagcctgaacctgtctgagcgcatccccagggtcatcctgaccaacgtgctgggcacagagctgggcaggaagtacatccgcaccccacctgtgacagagggcagcctgagtgacacagacaacctgcagagcgagcagctgagcagcagcagtgatggcagcctggagagctaccagaacctgaacccccacaagagctgctacctgtctgagcggggcagccagaggagcaagacagtggatgacaacagcgccaagcagacagcccacaacaaggagaagaggaggaaggatgatggcatcagcctgctgatcagtgacacccagcctgaggacctgaacagcggcagccggggctgtgaccacctggagcaggagagcaggaacaaggatgtgaagtacagcgacagcaaggtggagctgaccctcatcagcaggaagaccaagaggcggctgaggaacaacctgcctgacagccagtactgcaccagcctggacaagagcacagagcagaccaagaagcaggaggatgacagcaccatcagcacagaatttgagaagcccagcgagaactaccaccaggaccccaagctgcctgaggagatcaccaccaagcccaccaagagtgacttcaccaagctgagcagcctgaacagccaggagctgaccctgagcaatgccaccaagagcgccagcgctggcagcaccacagaaacagtggagaacagcaacagcattgacatcgtgggcatcagcagcctggtggagaaggatgaaaatgagctgaacaccatcgagaagcccatcctgcggggccacaatgaaggcaaccagagcctcatctctgctgagcccatcgtggtgtccagtgatgaggagggccctgtggagcacaagagcagcgagatcctgaagctgcagagcaagcaggaccgggagaccaccaatgaaaatgaaagcaccagcgagagcgccctgctggagctgcccctcatcacctgtgagagcgtgcagatgagcagcgagctgtgcccctacaaccctgtgatggagaacatcagcagcatcatgcccagcaatgagatggacctgcagctggacttcatcttcacctctgtgtacatcggcaagatcaagggggccagcaagggctgtgtgaccatcaccaagaagtacatcaagatccccttccaggtgtccctgaatgagatcagcctgctggtggacaccacccacctgaagcgcttcggcctgtggaagagcaaggatgacaaccacagcaagaggagccacgccatcctcttcttctgggtgtccagtgactacctgcaggagatccagacccagctggagcacagcgtgctgagccagcagagcaagagcagcgagttcatcttcctggagctgcacaaccctgtgtcccagcgggaggagctgaagctgaaggacatcatgacagagatcagcatcatcagcggggagctggagctgagctaccccctgtcctgggtgcaggccttccccctcttccagaacctgagcagcaaggagagcagcttcatccactactactgtgtgtccacctgcagcttccctgctggggtggccgtggccgaggagatgaagctgaagtctgtgtcccagcccagcaacacagatgctgccaagcccacctacaccttcctgcagaagcagagcagcggctgctacagcctgagcatcaccagcaacccagatgaggagtggagggaggtgcgccacacaggcctggtgcagaagctgattgtgtacccacctccacccaccaagggcggcctgggcgtgaccaatgaagacctggagtgcctggaggagggggagttcctgaatgatgtgatcatcgacttctacctgaagtacctgatcctggagaaggccagtgatgagctggtggagaggagccacatcttcagcagcttcttctacaagtgcctgaccaggaaggagaacaacctgacagaggacaaccccaacctgtccatggcccagaggaggcacaagagggtgaggacctggaccaggcacatcaacatcttcaacaaggactacatctttgtgcctgtgaatgaaagcagccactggtacctggccgtcatctgcttcccctggctggaggaggccgtgtatgaggacttcccccagacagtgtcccagcagagccaggcccagcagagccagaatgacaacaagaccatcgacaatgacctgcggaccaccagcaccctgagcctgtctgctgaggacagccagagcacagagagcaacatgtctgtgcccaagaagatgtgcaagaggccctgcatcctgatcctggacagcctgaaggccgcctctgtgcagaacacagtgcagaacctgcgggagtacctggaggtggagtgggaggtgaagctgaagacccaccggcagttcagcaagaccaacatggtggacctgtgccccaaggtgcccaagcaggacaacagcagtgactgtggggtgtacctgctgcagtatgtggagagcttcttcaaggaccccatcgtgaactttgagctgcccatccacctggagaagtggttccccaggcatgtgatcaagaccaagcgggaggacatccgggagctgatcctgaagctgcacctgcagcagcagaagggcagcagcagctag

SEQ ID NO: 171982 - DNA, 1770 bp, Artificial Sequence
  Description of Artificial Sequence: Synthetic coding sequence
atgtaccgctggctggtgcgcatcctgggcaccatcttccgcttctgtgacagatctgtgcccccagcccgggccctgctgaagagaagaagaagtgacagcaccctcttcagcacagtggacacagatgagatcccagccaagaggccccggctggactgcttcatccaccaggtgaagaacagcctgtacaatgctgccagcctgtttggcttccccttccagctgaccaccaagcccatggtgaccagcgcctgcaatggcaccagaaatgtggcccccagcggggaggtgttcagcaacagcagcagctgtgagctgaccggcagcggctcctggaacaacatgctgaagctgggcaacaagagccccaacggcatcagtgactaccccaagatccgggtgacagtgacccgggaccagcccaggagagtgctgcccagctttggcttcaccctgaacagcgagggctgcaacagaagacctgggggcagaagacacagcaaaggaaatcctgagagcagcctgatgtggaagccccaggagcaggccgtgacagagatgatcagcgaggagagcggcaagggcctgcggcggccccactgcaccgtggaggagggcgtgcagaaggaggagcgggagaagtacaggaagctgctggagcggctgaaggagagcggccacggcaacagcgtgtgccctgtgaccagcaactaccacagcagccagaggagccagatggacaccctgaagaccaagggctggggcgaggagcagaaccacggcgtgaagaccacccagtttgtgcccaagcagtaccgcctggtggagacccggggccccctgtgcagcctgcggtctgagaagcgctgcagcaagggcaagatcacagacacagagaccatggtgggcatccgctttgaaaatgaaagccggcggggctaccagctggagccagacctgtctgaggaggtgtctgcccggctgcggctgggcagcggcagcaatggcctgctgcggaggaaggtgtccatcatcgagaccaaggagaagaactgcagcggcaaggagcgggacagaagaacagatgacctgctggagctgacagaggacatggagaaggagatcagcaatgccctgggccacggcccccaggatgagatcctgagcagcgccttcaagctgcgcatcaccaggggggacatccagaccctgaagaactaccactggctgaatgatgaagtcatcaacttctacatgaacctgctggtggagaggaacaagaagcagggctacccagccctgcacgtgttcagcaccttcttctaccccaagctgaagagcggcggctaccaggccgtgaagcgctggaccaagggcgtgaacctgtttgagcaggagatcatcctggtgcccatccacaggaaggtgcactggagcctggtggtgattgacctgaggaagaagtgcctgaagtacctggacagcatgggccagaagggccaccgcatctgtgagatcctgctgcagtacctgcaggatgagagcaagaccaagaggaacagcgacctgaacctgctggagtggacccaccacagcatgaagccccatgagatcccccagcagctgaatggaagtgactgtggcatgttcacctgcaagtatgctgactacatcagccgggacaagcccatcaccttcacccagcaccagatgcccctcttcaggaagaagatggtgtgggagatcctgcaccagcagctgctgtag

SEQ ID NO: 171983 - DNA, 1242 bp, Artificial Sequence
  Description of Artificial Sequence: Synthetic coding sequence
atgtggaagccccaggagcaggccgtgacagagatgatcagcgaggagagcggcaagggcctgcggcggccccactgcaccgtggaggagggcgtgcagaaggaggagcgggagaagtacaggaagctgctggagcggctgaaggagagcggccacggcaacagcgtgtgccctgtgaccagcaactaccacagcagccagaggagccagatggacaccctgaagaccaagggctggggcgaggagcagaaccacggcgtgaagaccacccagtttgtgcccaagcagtaccgcctggtggagacccggggccccctgtgcagcctgcggtctgagaagcgctgcagcaagggcaagatcacagacacagagaccatggtgggcatccgctttgaaaatgaaagccggcggggctaccagctggagccagacctgtctgaggaggtgtctgcccggctgcggctgggcagcggcagcaatggcctgctgcggaggaaggtgtccatcatcgagaccaaggagaagaactgcagcggcaaggagcgggacagaagaacagatgacctgctggagctgacagaggacatggagaaggagatcagcaatgccctgggccacggcccccaggatgagatcctgagcagcgccttcaagctgcgcatcaccaggggggacatccagaccctgaagaactaccactggctgaatgatgaagtcatcaacttctacatgaacctgctggtggagaggaacaagaagcagggctacccagccctgcacgtgttcagcaccttcttctaccccaagctgaagagcggcggctaccaggccgtgaagcgctggaccaagggcgtgaacctgtttgagcaggagatcatcctggtgcccatccacaggaaggtgcactggagcctggtggtgattgacctgaggaagaagtgcctgaagtacctggacagcatgggccagaagggccaccgcatctgtgagatcctgctgcagtacctgcaggatgagagcaagaccaagaggaacagcgacctgaacctgctggagtggacccaccacagcatgaagccccatgagatcccccagcagctgaatggaagtgactgtggcatgttcacctgcaagtatgctgactacatcagccgggacaagcccatcaccttcacccagcaccagatgcccctcttcaggaagaagatggtgtgggagatcctgcaccagcagctgctgtag

SEQ ID NO: 171984 - DNA, 1383 bp, Artificial Sequence
  Description of Artificial Sequence: Synthetic coding sequence
atgtaccgctggctggtgcgcatcctgggcaccatcttccgcttctgtgacagatctgtgcccccagcccgggccctgctgaagagaagaagaagtgacagcaccctcttcagcacagtggacacagatgagatcccagccaagaggccccggctggactgcttcatccaccaggtgaagaacagcctgtacaatgctgccagcctgtttggcttccccttccagctgaccaccaagcccatggtgaccagcgcctgcaatggcaccagaaatgtggcccccagcggggaggtgaatggaaacagcgtgtgccctgtgaccagcaactaccacagcagccagaggagccagatggacaccctgaagaccaagggctggggcgaggagcagaaccacggcgtgaagaccacccagtttgtgcccaagcagtaccgcctggtggagacccggggccccctgtgcagcctgcggtctgagaagcgctgcagcaagggcaagatcacagacacagagaccatggtgggcatccgctttgaaaatgaaagcagaagaggctaccagctggagccagacctgtctgaggaggtgtctgcccggctgcggctgggcagcggcagcaatggcctgctgcggaggaaggtgtccatcatcgagaccaaggagaagaactgcagcggcaaggagcgggacagaagaacagatgacctgctggagctgacagaggacatggagaaggagatcagcaatgccctgggccacggcccccaggatgagatcctgagcagcgccttcaagctgcgcatcaccaggggggacatccagaccctgaagaactaccactggctgaatgatgaggtgatcaacttctacatgaacctgctggtggagaggaacaagaagcagggctacccagccctgcacgtgttcagcaccttcttctaccccaagctgaagagcggcggctaccaggccgtgaagcgctggaccaagggcgtgaacctgtttgagcaggagatcatcctggtgcccatccacaggaaggtgcactggagcctggtggtgattgacctgaggaagaagtgcctgaagtacctggacagcatgggccagaagggccaccgcatctgtgagatcctgctgcagtacctgcaggatgagagcaagaccaagaggaacagcgacctgaacctgctggagtggacccaccacagcatgaagccccatgagatcccccagcagctgaatggaagtgactgtggcatgttcacctgcaagtatgctgactacatcagccgggacaagcccatcaccttcacccagcaccagatgcccctcttcaggaagaagatggtgtgggagatcctgcaccagcagctgctgtag

SEQ ID NO: 171985 - DNA, 1740 bp, Artificial Sequence
  Description of Artificial Sequence: Synthetic coding sequence
atggacagccacccctgcctgtactgcggcccccaggacagcgagggcaccaactggcagaccagccccagcaccctcttcagcacagtggacacagatgagatcccagccaagaggccccggctggactgcttcatccaccaggtgaagaacagcctgtacaatgctgccagcctgtttggcttccccttccagctgaccaccaagcccatggtgaccagcgcctgcaatggcaccagaaatgtggcccccagcggggaggtgttcagcaacagcagcagctgtgagctgaccggcagcggctcctggaacaacatgctgaagctgggcaacaagagccccaacggcatcagtgactaccccaagatccgggtgacagtgacccgggaccagcccaggagagtgctgcccagctttggcttcaccctgaacagcgagggctgcaacagaagacctgggggcagaagacacagcaaaggaaatcctgagagcagcctgatgtggaagccccaggagcaggccgtgacagagatgatcagcgaggagagcggcaagggcctgcggcggccccactgcaccgtggaggagggcgtgcagaaggaggagcgggagaagtacaggaagctgctggagcggctgaaggagagcggccacggcaacagcgtgtgccctgtgaccagcaactaccacagcagccagaggagccagatggacaccctgaagaccaagggctggggcgaggagcagaaccacggcgtgaagaccacccagtttgtgcccaagcagtaccgcctggtggagacccggggccccctgtgcagcctgcggtctgagaagcgctgcagcaagggcaagatcacagacacagagaccatggtgggcatccgctttgaaaatgaaagccggcggggctaccagctggagccagacctgtctgaggaggtgtctgcccggctgcggctgggcagcggcagcaatggcctgctgcggaggaaggtgtccatcatcgagaccaaggagaagaactgcagcggcaaggagcgggacagaagaacagatgacctgctggagctgacagaggacatggagaaggagatcagcaatgccctgggccacggcccccaggatgagatcctgagcagcgccttcaagctgcgcatcaccaggggggacatccagaccctgaagaactaccactggctgaatgatgaagtcatcaacttctacatgaacctgctggtggagaggaacaagaagcagggctacccagccctgcacgtgttcagcaccttcttctaccccaagctgaagagcggcggctaccaggccgtgaagcgctggaccaagggcgtgaacctgtttgagcaggagatcatcctggtgcccatccacaggaaggtgcactggagcctggtggtgattgacctgaggaagaagtgcctgaagtacctggacagcatgggccagaagggccaccgcatctgtgagatcctgctgcagtacctgcaggatgagagcaagaccaagaggaacagcgacctgaacctgctggagtggacccaccacagcatgaagccccatgagatcccccagcagctgaatggaagtgactgtggcatgttcacctgcaagtatgctgactacatcagccgggacaagcccatcaccttcacccagcaccagatgcccctcttcaggaagaagatggtgtgggagatcctgcaccagcagctgctgtag

SEQ ID NO: 171986 - DNA, 1722 bp, Artificial Sequence
  Description of Artificial Sequence: Synthetic coding sequence
atgaaggagaccatccagggcaccggctcctggggccctgagcccccaggccctggcatccccccagcctacagcagcccccggcgggagcggctgcgctggcccccaccacccaagccccggctgaagagcggcggcggcttcggccctgaccccggcagcggcaccaccgtgcctgcccggcggctgcctgtgccccggcccagctttgatgccagcgccagcgaggaggaggaggaggaggaggaggaggaggatgaagatgaggaggaggaggtggccgcctggaggctgcccccacgctggagccagctgggcaccagccagaggccccggcccagccggcccacccacaggaagacctgcagccagaggagaagaagagccatgagggccttcaggatgctgctgtacagcaagagcaccagcctgaccttccactggaagctgtggggccgccaccggggcagaagaagaggcctggcccaccccaagaaccacctgagcccccagcagggcggggccaccccccaggtgcccagcccctgctgccgctttgacagcccccggggccccccaccaccccggctgggcctgctgggcgccctgatggccgaggatggagtgcggggcagcccccctgtgcccagcggcccccccatggaggaggatggcctgcgctggacccccaagagccccctggaccctgacagcggcctgctgagctgcaccctgcccaatggatttggaggccagagcggccctgagggggagaggagcctggcccccccagatgccagcatcctgatcagcaatgtgtgcagcatcggggaccacgtggcccaggagctgttccagggcagtgacctgggcatggccgaggaggccgagaggcctggagagaaggccggccagcacagccccctgcgggaggagcacgtgacctgtgtgcagagcatcctggatgagttcctgcagacctacggcagcctcatccccctgagcacagatgaggtggtggagaagctggaggacatcttccagcaggagttcagcacccccagcaggaagggcctggtgctgcagctgatccagagctaccagaggatgcctggaaatgccatggtgcggggcttccgggtggcctacaagagacatgtgctgaccatggatgacctgggcaccctgtatggccagaactggctgaatgaccaggtgatgaacatgtacggggacctggtgatggacacagtgcctgagaaggtgcacttcttcaacagcttcttctatgacaagctgaggacaggctatgatggagtgaagcgctggaccaagaatgtggacatcttcaacaaggagctgctgctgatccccatccacctggaggtgcactggagcctcatctctgtggatgtgagaagaaggaccatcacctactttgacagccagaggaccctgaacagacgctgccccaagcacatcgccaagtacctgcaggccgaggccgtgaagaaggaccggctggacttccaccagggctggaagggctacttcaagatgaatgtggcccggcagaacaatgacagcgactgtggggcctttgtgctgcagtactgcaagcacctggccctgagccagcccttctccttcacccagcaggacatgcccaagctgcggcggcagatctacaaggagctgtgccactgcaagctgactgtgtag

SEQ ID NO: 171987 - DNA, 1725 bp, Artificial Sequence
  Description of Artificial Sequence: Synthetic coding sequence
atgaaggagaccatccagggcaccggctcctggggccctgagcccccaggccctggcatccccccagcctacagcagcccccggcgggagcggctgcgctggcccccaccacccaagccccggctgaagagcggcggcggcttcggccctgaccccggcagcggcaccaccgtgcctgcccggcggctgcctgtgccccggcccagctttgatgccagcgccagcgaggaggaggaggaggaggaggaggaggaggatgaagatgaggaggaggaggtggccgcctggaggctgcccccacgctggagccagctgggcaccagccagaggccccggcccagccggcccacccacaggaagacctgcagccagaggagaagaagagccatgagggccttcaggatgctgctgtacagcaagagcaccagcctgaccttccactggaagctgtggggccgccaccggggcagaagaagaggcctggcccaccccaagaaccacctgagcccccagcagggcggggccaccccccaggtgcccagcccctgctgccgctttgacagcccccggggccccccaccaccccggctgggcctgctgggcgccctgatggccgaggatggagtgcggggcagcccccctgtgcccagcggcccccccatggaggaggatggcctgcgctggacccccaagagccccctggaccctgacagcggcctgctgagctgcaccctgcccaatggatttggaggccagagcggccctgagggggagaggagcctggcccccccagatgccagcatcctgatcagcaatgtgtgcagcatcggggaccacgtggcccaggagctgttccagggcagtgacctgggcatggccgaggaggccgagaggcctggagagaaggccggccagcacagccccctgcgggaggagcacgtgacctgtgtgcagagcatcctggatgagttcctgcagacctacggcagcctcatccccctgagcacagatgaggtggtggagaagctggaggacatcttccagcaggagttcagcacccccagcaggaagggcctggtgctgcagctgatccagagctaccagaggatgcctggaaatgccatggtgcggggcttccgggtggcctacaagagacatgtgctgaccatggatgacctgggcaccctgtatggccagaactggctgaatgaccaggtgatgaacatgtacggggacctggtgatggacacagtgcctgagaaggtgcacttcttcaacagcttcttctatgacaagctgcggaccaagggctatgatggagtgaagcgctggaccaagaatgtggacatcttcaacaaggagctgctgctgatccccatccacctggaggtgcactggagcctcatctctgtggatgtgagaagaaggaccatcacctactttgacagccagaggaccctgaacagacgctgccccaagcacatcgccaagtacctgcaggccgaggccgtgaagaaggaccggctggacttccaccagggctggaagggctacttcaagatgaatgtggcccggcagaacaatgacagcgactgtggggcctttgtgctgcagtactgcaagcacctggccctgagccagcccttctccttcacccagcaggacatgcccaagctgcggcggcagatctacaaggagctgtgccactgcaagctgactgtgtag

SEQ ID NO: 171988 - DNA, 3741 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagaacaccaacctgagcgccaccaccagcctgagcctgcggcggcccccaggccctgccagccagagcctgtggggcaaccccacccagtaccccttctggccaggcggcatggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcatgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171989 - DNA, 3741 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagaacaccaacctgagcgccaccaccagcctgagcctgcggcggcccccaggccctgccagccagagcctgtggggcaaccccacccagtaccccttctggccaggcggcatggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcctgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171990 - DNA, 3741 bp, Artificial Sequence; identical to SEQ ID NO: 171989
  Description of Artificial Sequence: Synthetic coding sequence

SEQ ID NO: 171991 - DNA, 3741 bp, Artificial Sequence; identical to SEQ ID NO: 171989
  Description of Artificial Sequence: Synthetic coding sequence

SEQ ID NO: 171992 - DNA, 3741 bp, Artificial Sequence; identical to SEQ ID NO: 171989
  Description of Artificial Sequence: Synthetic coding sequence

SEQ ID NO: 171993 - DNA, 3267 bp, Artificial Sequence
  Description of Artificial Sequence: Synthetic coding sequence
atggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcatgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171994 - DNA, 3741 bp, Artificial Sequence; identical to SEQ ID NO: 171988
  Description of Artificial Sequence: Synthetic coding sequence

SEQ ID NO: 171995 - DNA, 3162 bp, Artificial Sequence
  Description of Artificial Sequence: Synthetic coding sequence
atggactttgcccccaaggactgccccaccccagcccctggcctgctgagcctgagctgcatgctggagcccctggacctgggcggcggagatgaagatgaaaatgaagctgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgacagcgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagacctttggagccaagcagcccacccaccagggcggccctgcccaggacagaggagtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcctggagaatatgtgcagatggccggccgggccggcagaagaggcctggaccccactggaacagtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaggccggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggggccgcccggctggtgggggagcctgtgctgggcgccaagatggagacagctgccaccctgctgcggcgggacatcgtgtttgctgccagcctgtacacccagtag

SEQ ID NO: 171996 - DNA, 3162 bp, Artificial Sequence; identical to SEQ ID NO: 171995
  Description of Artificial Sequence: Synthetic coding sequence

SEQ ID NO: 171997 - DNA, 693 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagaacaccaacctgagcgccaccaccagcctgagcctgcggcggcccccaggccctgccagccagagcctgtggggcaaccccacccagtaccccttctggccaggcggcatggatgagcccaccatcacagacctgaacacccgggaggaggccgaggaggagattgactttgagaaggacctgctgaccatccccccaggcttcaagaagggcatggactttgcccccaagggctctgtgcacagctgcatccacccccggggcccccgggccagcatcagcggggctgtgggccacccctgtggccgccacctgccctgctggtag

SEQ ID NO: 171998 - DNA, 3267 bp, Artificial Sequence
  Description of Artificial Sequence: Synthetic coding sequence
atggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcctgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171999 - DNA, 3162 bp, Artificial Sequence
  Description of Artificial Sequence: Synthetic coding sequence
atggactttgcccccaaggactgccccaccccagcccctggcctgctgagcctgagctgcctgctggagcccctggacctgggcggcggagatgaagatgaaaatgaagctgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgacagcgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagacctttggagccaagcagcccacccaccagggcggccctgcccaggacagaggagtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcctggagaatatgtgcagatggccggccgggccggcagaagaggcctggaccccactggaacagtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaggccggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggggccgcccggctggtgggggagcctgtgctgggcgccaagatggagacagctgccaccctgctgcggcgggacatcgtgtttgctgccagcctgtacacccagtag

SEQ ID NO: 172000 - DNA, 2643 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 172001 - DNA, 3267 bp, Artificial Sequence; identical to SEQ ID NO: 171998
  Description of Artificial Sequence: Synthetic coding sequence

SEQ ID NO: 172002 - DNA, 2643 bp, Artificial Sequence; identical to SEQ ID NO: 172000
  Description of Artificial Sequence: Synthetic coding sequence

SEQ ID NO: 172003 - DNA, 2643 bp, Artificial Sequence; identical to SEQ ID NO: 172000
  Description of Artificial Sequence: Synthetic coding sequence

SEQ ID NO: 172004 - DNA, 693 bp, Artificial Sequence; identical to SEQ ID NO: 171997
  Description of Artificial Sequence: Synthetic coding sequence

SEQ ID NO: 172005 - DNA, 2643 bp, Artificial Sequence; identical to SEQ ID NO: 172000
  Description of Artificial Sequence: Synthetic coding sequence

SEQ ID NO: 172006 - DNA, 3267 bp, Artificial Sequence; identical to SEQ ID NO: 171998
  Description of Artificial Sequence: Synthetic coding sequence

SEQ ID NO: 172007 - DNA, 3267 bp, Artificial Sequence; identical to SEQ ID NO: 171998
  Description of Artificial Sequence: Synthetic coding sequence

SEQ ID NO: 172008 - DNA, 693 bp, Artificial Sequence; identical to SEQ ID NO: 171997
  Description of Artificial Sequence: Synthetic coding sequence

SEQ ID NO: 172009 - DNA, 3267 bp, Artificial Sequence; identical to SEQ ID NO: 171993
  Description of Artificial Sequence: Synthetic coding sequence

SEQ ID NO: 172010 - DNA, 693 bp, Artificial Sequence; identical to SEQ ID NO: 171997
  Description of Artificial Sequence: Synthetic coding sequence

SEQ ID NO: 172011 - DNA, 2643 bp, Artificial Sequence; identical to SEQ ID NO: 172000
  Description of Artificial Sequence: Synthetic coding sequence

SEQ ID NO: 172012 - DNA, 693 bp, Artificial Sequence; identical to SEQ ID NO: 171997
  Description of Artificial Sequence: Synthetic coding sequence

SEQ ID NO: 172013 - DNA, 3162 bp, Artificial Sequence; identical to SEQ ID NO: 171999
  Description of Artificial Sequence: Synthetic coding sequence

SEQ ID NO: 172014 - DNA, 3162 bp, Artificial Sequence; identical to SEQ ID NO: 171999
  Description of Artificial Sequence: Synthetic coding sequence

SEQ ID NO: 172015 - DNA, 3162 bp, Artificial Sequence; identical to SEQ ID NO: 171999
  Description of Artificial Sequence: Synthetic coding sequence

SEQ ID NO: 172016 - DNA, 465 bp, Artificial Sequence
  Description of Artificial Sequence: Synthetic coding sequence
atggccaccaaggctgtgtgtgtgctgaagggagatggccctgtgcagggcatcatcaactttgagcagaaggagagcaatggacctgtgaaggtgtggggcagcatcaagggcctgacagagggcctgcacggcttccacgtgcatgaatttggagacaacacagctggctgcaccagcgctggcccccacttcaaccccctgagcaggaagcacggcggccccaaggatgaggagagacatgtgggggacctgggcaatgtgacagctgacaaggatggagtggctgatgtgtccattgaagattctgtcatcagcctgagcggggaccactgcatcatcggccgcaccctggtggtgcatgagaaggcagatgacctgggcaaaggaggaaatgaggagagcaccaagacaggaaatgccggcagccggctggcctgtggggtcatcggcatcgcccagtag

SEQ ID NO: 172017 - DNA, 108 bp, Artificial Sequence
  Description of Artificial Sequence: Synthetic coding sequence
atggccaccaaggctgtgtgtgtgctgaagggagatggccctgtgcagggcatcatcaactttgagcagaaggagagcaatggacctgagggcgtgggcaagcactag

SEQ ID NO: 172018 - DNA, 1074 bp, Artificial Sequence
  Description of Artificial Sequence: Synthetic coding sequence
atggattctgtggagaagaccaccaacagaagtgagcagaagagcaggaagttcctgaagagcctcatcaggaagcagccccaggagctgctgctggtgattggcaccggggtgtctgctgctgtggcccctggcatcccagccctgtgctcctggaggagctgcatcgaggccgtcatcgaggccgctgagcagctggaggtgctgcaccctggagatgtggccgagttccggaggaaggtgaccaaggaccgggacctgctggtggtggcccatgacctgatcaggaagatgagccccaggactggagatgccaagcccagcttcttccaggactgcctgatggaggtgtttgatgacctggagcagcacatccgcagccctgtggtgctgcagagcatcctgagcctgatggacagaggagccatggtgctgaccaccaactatgacaacctgctggaggccttcggccggcggcagaacaagcccatggagagcctggacctgaaggacaagaccaaggtgctggagtgggcccggggccacatgaagtatggagtgctgcacatccacggcctgtacacagacccctgtggggtggtgctggaccccagcggctacaaggatgtgacccaggatgctgaggtgatggaggtgctgcagaacctgtaccgcaccaagagcttcctgtttgtgggctgtggggagaccctgcgggaccagatcttccaggccctcttcctgtacagcgtgcccaacaaggtggacctggagcactacatgctggtgctgaaggaaaatgaagaccacttcttcaagcaccaggccgacatgctgctgcacggcatcaaggtggtgtcctatggagactgctttgaccacttccctggctacgtgcaggacctggccacccagatctgcaagcagcagagcccagatgctgacagagtggacagcaccaccctgctgggcaatgcctgccaggactgtgccaagaggaagctggaggagaatggcatcgaggtgtccaagaagaggacccagagcgacacagatgatgctgggggcagctag

SEQ ID NO: 172019 - DNA, 636 bp, Artificial Sequence
  Description of Artificial Sequence: Synthetic coding sequence
atggaccccaggaaggtgaatgagctgcgggcctttgtgaagatgtgcaagcaggaccccagcgtgctgcacacagaggagatgaggttcctgcgggagtgggtggagagcatgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtgattgaaccagacacagatgccccccaggagatgggagatgaaaatgctgagatcacagaggagatgatggaccaggccaatgacaagaaggtggccgccatcgaggccctgaatgatggagagctgcagaaggccatcgacctcttcacagatgccatcaagctgaacccccggctggccatcctgtatgccaagagggcctctgtgtttgtgaagctgcagaagcccaatgctgccatccgggactgtgaccgggccatcgagatcaacccagattctgcccagccctacaagtggaggggcaaggcccaccggctgctgggccactgggaggaggccgcccatgacctggccctggcctggacccagtag

SEQ ID NO: 172020 - DNA, 489 bp, Artificial Sequence
  Description of Artificial Sequence: Synthetic coding sequence
atgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtcatcgagccagacacagatgccccccaggagatgggagatgaaaatgctgagatcacagaggagatgatggaccaggccaatgacaagaaggtggccgccatcgaggccctgaatgatggagagctgcagaaggccatcgacctcttcacagatgccatcaagctgaacccccggctggccatcctgtatgccaagagggcctctgtgtttgtgaagctgcagaagcccaatgctgccatccgggactgtgaccgggccatcgagatcaacccagacagcgcccagccctacaagtggaggggcaaggcccaccggctgctgggccactgggagtag

SEQ ID NO: 172021 - DNA, 366 bp, Artificial Sequence
  Description of Artificial Sequence: Synthetic coding sequence
atggaccccaggaaggtgaatgagctgcgggcctttgtgaagatgtgcaagcaggaccccagcgtgctgcacacagaggagatgaggttcctgcgggagtgggtggagagcatgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtgattgaaccagacacagatgccccccaggagatgggagatgaaaatgctgagatcacagaggagatgatggaccaggccaatgacaagagcggctgctactag

SEQ ID NO: 172022 - DNA, 2568 bp, Artificial Sequence
  Description of Artificial Sequence: Synthetic coding sequence
atgggcagtgaccgggccaggaagggcggcggcggccccaaggactttggagctggcctgaagtacaacagcagacatgagaaggtgaatggcctggaggagggcgtggagttcctgcctgtgaacaacgtgaagaaggtggagaagcacggccctggccgctgggtggtgctggccgctgtgctgattggcctgctgctggtgctgctgggcatcggcttcctggtgtggcacctgcagtacagagatgtgcgggtgcagaaggtgttcaacggctacatgaggatcaccaatgaaaattttgtggatgcctatgagaacagcaacagcacagaatttgtgtccctggccagcaaggtgaaggatgccctgaagctgctgtacagcggcgtgcccttcctgggcccctaccacaaggagagcgctgtgacagccttcagcgagggcagcgtcatcgcctactactggagcgagttcagcatcccccagcacctggtggaggaggccgagcgggtgatggccgaggagcgggtggtgatgctgcccccccgggcccggagcctgaagagctttgtggtgacctctgtggtggccttccccacagacagcaagacagtgcagaggacccaggacaacagctgcagctttggcctgcacgcccggggcgtggagctgatgaggttcaccaccccaggcttcccagacagcccctacccagcccacgcccgctgccagtgggccctgcggggagatgctgacagcgtgctgagcctgaccttccgcagctttgacctggccagctgtgatgagcggggcagtgacctggtgacagtgtacaacaccctgagccccatggagccccacgccctggtgcagctgtgtggcacctacccacccagctacaacctgaccttccacagcagccagaatgtgctgctgatcaccctcatcaccaacacagagcggcggcaccctggctttgaggccaccttcttccagctgcccaggatgagcagctgtggcggccgcctgaggaaggcccagggcaccttcaacagcccctactacccaggccactacccacccaacatcgactgcacctggaacatcgaggtgcccaacaaccagcacgtgaaggtgcgcttcaagttcttctacctgctggagcccggggtgcctgctggcacctgccccaaggactatgtggagatcaatggagagaagtactgtggggagaggagccagtttgtggtgaccagcaacagcaacaagatcaccgtgcgcttccacagcgaccagagctacacagacaccggcttcctggccgagtacctgtcctatgacagcagtgacccctgccccggccagttcacctgcaggacaggccgctgcatcaggaaggagctgcgctgtgatggctgggccgactgcacagaccacagtgatgagctgaactgcagctgtgatgctggccaccagttcacctgcaagaacaagttctgcaagcccctcttctgggtgtgtgacagcgtgaatgactgtggggacaacagtgatgagcagggctgcagctgcccagcccagaccttccgctgcagcaatggcaagtgcctgagcaagagccagcagtgcaatggcaaggatgactgtggagatggcagtgatgaggccagctgccccaaggtgaatgtggtgacctgcaccaagcacacctaccgctgcctgaatggcctgtgcctgagcaagggcaacccagaatgtgatggcaaggaggactgcagtgatggcagtgatgagaaggactgtgactgtggcctgcggagcttcacccggcaggcccgggtggtgggcggcacagatgctgatgaaggagagtggccctggcaggtgtccctgcacgccctgggccagggccacatctgtggggccagcctcatcagccccaactggctggtgtctgctgcccactgctacattgatgaccggggcttccgctacagcgaccccacccagtggacagccttcctgggcctgcatgaccagagccagaggtctgcccctggggtgcaggagcggcggctgaagaggatcatcagccaccccttcttcaatgacttcacctttgattatgacatcgccctgctggagctggagaagccagctgagtacagctccatggtgcggcccatctgcctgcctgatgccagccacgtgtttcctgctgggaaggccatctgggtgacaggctggggccacacccagtatggaggcaccggggccctgatcctgcagaagggggagatccgggtcatcaaccagaccacctgtgagaacctgctgccccagcagatcacccccaggatgatgtgtgtgggcttcctgtctggaggagtggacagctgccagggcgacagcggcggccccctgagctctgtggaggctgatggccgcatcttccaggccggcgtggtgtcctggggagatggctgtgcccagaggaacaagccaggagtgtacacccggctgcccctcttccgggactggatcaaggaaaatactggagtgtag

SEQ ID NO: 172023 - DNA, 3414 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggccctgctgctggcccccggggcgtgctgctgaccaggacaggcacccgggcccacagcctgggcatccgggagaagatcagcgcctgggagggccggcgggaggccagccccaggatgtccatgtgtggggagaagcgggagggcagcggcagcgagtgggccgccagcgagggctgccccagcctgggctgccccagcgtggtgcccagcccctgcagcagcgagaagacctttgacttcaagggcctgcggaggatgagcaggaccttcagcgagtgcagctacccagagacagaggaggagggggaggccctgcctgtgcgggacagcttctaccgcctggagaagaggctgggccgctctgagcccagcgccttcctgcggggccacggcagcaggaaggagagcagcgctgtgctgagccgcatccagaagattgagcaggtgctgaaggagcagcccggccggggcctgccccagctgcccagcagctgctacagcgtggaccggggcaagaggaagacaggcaccctgggcagcctggaggagcctgctggaggagcctctgtgtctgctggcagcagagctgtgggcgtggccggcgtggccggggaggccggccccccacctgagcgggagggcagcggcagcaccaagccaggcaccccaggcaacagccccagcagccagaggctgcccagcaagagcagcctggaccctgctgtgaaccctgtgcccaagcccaagaggacctttgaatatgaggccgacaagaaccccaagagcaagcccagcaatggcctgccccccagccccaccccagctgcccccccacccctgcccagcaccccagcccctcctgtgacccggcggcccaagaaggacatgaggggccacaggaagagccagagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtggactttgaatgtctcttcacctgcctgtctgtgcggcagctgatccgcatctttgccagcctgctgctggagaggagggtcatctttgtggccgacaagctgagcaccctgagcagctgcagccatgctgtggtggccctgctgtaccccttctcctggcagcacaccttcatccctgtgctgcctgcctccatgattgacatcgtgtgctgccccacccccttcctggtgggcctgctgagcagcagcctgcccaagctgaaggagctgcctgtggaggaggccctgatggtgaacctgggcagtgaccgcttcatccggcagatggatgatgaggacaccctgctgcccaggaagctgcaggccgccctggagcaggccctggagaggaagaatgagctgatcagccaggacagcgacagcgacagtgatgatgagtgcaacaccctgaatggcctggtgtctgaggtgttcatccgcttctttgtggagaccgtgggccactacagcctcttcctgacccagagcgagaagggggagcgggccttccagcgggaggccttcaggaagtctgtggccagcaagagcatccgccgcttcctggaggtgttcatggagagccagatgtttgctggcttcatccaggaccgggagctgaggaaatgtcgggccaagggcctgtttgagcagagggtggagcagtacctggaggagctgcctgacacagagcagagcggcatgaacaagttcctgcggggcctgggcaacaagatgaagttcctgcacaagaagaactag

SEQ ID NO: 172024 - DNA, 3414 bp, Artificial Sequence; identical to SEQ ID NO: 172023
  Description of Artificial Sequence: Synthetic coding sequence

SEQ ID NO: 172025 - DNA, 1263 bp, Artificial Sequence
  Description of Artificial Sequence: Synthetic coding sequence
atgaccagcaggaagaatggaggaggagcccacagctggcaggagaccccctgggagcagaggcgggccctgggcctgcagagagctgagatgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgctgagcaccctgtggtggtgccccagccgccgcagccaccgggagacccccaccagccccaagagccccaccagcttccccagaaatgtgctgagccctgccctgcacgtggccgccggcagcttctccttcctgcggctgtgcagcagcaggaccagcttcagaagatctgtgcagaccccagcctggagccccagccctgcccagctggccctgctggaccggcccaccaagcagatgagggaggccgaggagcggctgaaggccatcccccagttctgcttcccagatgccaaggactggctgcctgtgtctgagtacatgaggcccttcctgagctgctag

SEQ ID NO: 172026 - DNA, 174 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctactag

SEQ ID NO: 172027 - DNA, 123 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccatag

SEQ ID NO: 172028 - DNA, 144 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccactag

SEQ ID NO: 172029 - DNA, 219 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgtag

SEQ ID NO: 172030 - DNA, 375 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggactag

SEQ ID NO: 172031 - DNA, 429 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggatag

SEQ ID NO: 172032 - DNA, 2154 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtggactttgaatgtctcttcacctgcctgtctgtgcggcagctgatccgcatctttgccagcctgctgctggagaggagggtcatctttgtggccgacaagctgagcaccctgagcagctgcagccatgctgtggtggccctgctgtaccccttctcctggcagcacaccttcatccctgtgctgcctgcctccatgattgacatcgtgtgctgccccacccccttcctggtgggcctgctgagcagcagcctgcccaagctgaaggagctgcctgtggaggaggccctgatggtgaacctgggcagtgaccgcttcatccggcagatggatgatgaggacaccctgctgcccaggaagctgcaggccgccctggagcaggccctggagaggaagaatgagctgatcagccaggacagcgacagcgacagtgatgatgagtgcaacaccctgaatggcctggtgtctgaggtgttcatccgcttctttgtggagaccgtgggccactacagcctcttcctgacccagagcgagaagggggagcgggccttccagcgggaggccttcaggaagtctgtggccagcaagagcatccgccgcttcctggaggtgttcatggagagccagatgtttgctggcttcatccaggaccgggagctgaggaaatgtcgggccaagggcctgtttgagcagagggtggagcagtacctggaggagctgcctgacacagagcagagcggcatgaacaagttcctgcggggcctgggcaacaagatgaagttcctgcacaagaagaactag

SEQ ID NO: 172033 - DNA, 159 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagacctag

SEQ ID NO: 172034 - DNA, 336 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagaggtag

SEQ ID NO: 172035 - DNA, 162 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagctag

SEQ ID NO: 172036 - DNA, 252 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggacccctag

SEQ ID NO: 172037 - DNA, 288 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagtag

SEQ ID NO: 172038 - DNA, 465 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggccctgctgctggcccccggggcgtgctgctgaccaggtag

SEQ ID NO: 172039 - DNA, 540 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagtag

SEQ ID NO: 172040 - DNA, 2154 bp, Artificial Sequence; identical to SEQ ID NO: 172032
  Description of Artificial Sequence: Synthetic coding sequence

SEQ ID NO: 172041 - DNA, 411 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggtctggatag

SEQ ID NO: 172042 - DNA, 225 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcctag

SEQ ID NO: 172043 - DNA, 420 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcaccccctag

SEQ ID NO: 172044 - DNA, 1830 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtggactttgaatgtctcttcacctgcctgtctgtgcggcagctgatccgcatctttgccagcctgctgctggagaggagggtcatctttgtggccgacaagctgagcaccctgagcagctgcagccatgctgtggtggccctgctgtaccccttctcctggcagcacaccttcatccctgtgctgcctgcctccatgattgacatcgtgtgctgccccacccccttcctggtgggcctgctgagcagcagcctgcccaagctgaaggagctgcctgtggaggaggccctgatggtgaacctgggcagtgaccgcttcatccggcagatggatgatgaggacaccctgctgcccaggaagctgcaggccgccctggagcaggccctggagaggaagaatgagctgatcagccaggacagcgacagcgacagtgatgatgagtgcaacaccctgaatggcctggtgtctgaggtgttcatccgcttctttgtggagaccgtgggccactacagcctcttcctgacccagagcgagaagggggagcgggccttccagcgggaggccttcaggaagtctgtggccagcaagagcatccgccgcttcctggaggtgttcatggagagccagatgtttgctggcttcatccaggaccgggagctgaggaaatgtcgggccaagggcctgtttgagcagagggtggagcagtacctggaggagctgcctgacacagagcagagcggcatgaacaagttcctgcggggcctgggcaacaagatgaagttcctgcacaagaagaactag

SEQ ID NO: 172045 - DNA, 234 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaagtag

SEQ ID NO: 172046 - DNA, 81 bp, Artificial Sequence
  Description of Artificial Sequence: Synthetic coding sequence
atgaccatgacagccaacaagaacagcagcatcacccatggagctgggggcaccaaggccccccggggcaccctgtcctag

SEQ ID NO: 172047 - DNA, 1035 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtgtag

SEQ ID NO: 172048 - DNA, 231 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgccctag

SEQ ID NO: 172049 - DNA, 225 bp, Artificial Sequence; identical to SEQ ID NO: 172042
  Description of Artificial Sequence: Synthetic coding sequence

SEQ ID NO: 172050 - DNA, 435 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggccctgcctag

SEQ ID NO: 172051 - DNA, 3414 bp, Artificial Sequence; identical to SEQ ID NO: 172023
  Description of Artificial Sequence: Synthetic coding sequence

SEQ ID NO: 172052 - DNA, 369 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcctag

SEQ ID NO: 172053 - DNA, 93 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagctag

SEQ ID NO: 172054 - DNA, 1758 bp, Artificial Sequence
  Description of Artificial Sequence: Synthetic coding sequence
atggccgaggccgccaccggcttcctggagcagctgaagagctgcatcgtgtggagctggacctacctgtggacagtgtggttcttcatcgtgctcttcctggtgtacatcctgcgggtgcccctgaagatcaatgacaacctgagcacagtgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgagatccgcagccgggtggaggtgcccctcatcgccagcagcaccatctgggagatcaagctgctgcccaagtgtgccacagcctacatcctgctggccgaggaggaggccaccaccatcgccgaggccgagaagctgttcaagcaggccctgaaggctggagatggctgctaccgccgcagccagcagctgcagcaccacggcagccagtatgaggcccagcacagaagagacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagccggcggggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccatgattgacatcttctgcagcgctgagttccgggactggaactgcaagagcatcttcatgagggtggaggatgagctggagatccccccagccccccagagccagcacttccagaactag

SEQ ID NO: 172055 - DNA, 1500 bp, Artificial Sequence
  Description of Artificial Sequence: Synthetic coding sequence
atgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgaatgtgccacagcctacatcctgctggccgaggaggaggccaccaccatcgccgaggccgagaagctgttcaagcaggccctgaaggctggagatggctgctacagaagaagccagcagctgcagcaccacggcagccagtatgaggcccagcaccggcgggacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagcagaagaggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcacagcttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172056 - DNA, 1536 bp, Artificial Sequence
  Description of Artificial Sequence: Synthetic coding sequence
atgtttggaacagagagcagcctgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgaatgtgccacagcctacatcctgctggccgaggaggaggccaccaccatcgccgaggccgagaagctgttcaagcaggccctgaaggctggagatggctgctaccgccgcagccagcagctgcagcaccacggcagccagtatgaggcccagcacagaagagacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagccggcggggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172057 - DNA, 1605 bp, Artificial Sequence
  Description of Artificial Sequence: Synthetic coding sequence
atgtttggaacagagagcagcctgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgagatccgcagccgggtggaggtgcccctgattgccagcagcaccatctgggagatcaagctgctgcccaagtgtgccacagcctacatcctgctggccgaggaggaggccaccaccatcgccgaggccgagaagctgttcaagcaggccctgaaggctggagatggctgctacagaagaagccagcagctgcagcaccacggcagccagtatgaggcccagcaccggcgggacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagcagaagaggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172058 - DNA, 1665 bp, Artificial Sequence
  Description of Artificial Sequence: Synthetic coding sequence
atggccgaggccgccaccggcttcctggagcagctgaagagctgcatcgtgtggagctggacctacctgtggacagtgtggttcttcatcgtgctcttcctggtgtacatcctgcgggtgcccctgaagatcaatgacaacctgagcacagtgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgaatgtgccacagcctacatcctgctggccgaggaggaggccaccaccatcgccgaggccgagaagctgttcaagcaggccctgaaggctggagatggctgctacagaagaagccagcagctgcagcaccacggcagccagtatgaggcccagcaccggcgggacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagcagaagaggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172059 - DNA, 189 bp, Artificial Sequence
  Description of Artificial Sequence: Synthetic coding sequence
atgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagctag

SEQ ID NO: 172060 - DNA, 264 bp, Artificial Sequence
  Description of Artificial Sequence: Synthetic coding sequence
atgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggtag

SEQ ID NO: 172061 - DNA, 1323 bp, Artificial Sequence
  Description of Artificial Sequence: Synthetic coding sequence
atggctgaaaataatgaaaacatcagcaagaatgtggatgtgcggcccaagaccagccgcagccgctctgctgacaggaaggatggctacgtgtggagcggcaagaagctgtcctggagcaagaagtctgagagctacagtgatgctgagaccgtgaatggaattgagaagacagaggtgtccctgaggaaccaggagaggaagcacagctgcagcagcattgagctggacctggaccacagctgtggccaccgcttcctgggccgcagcctgaagcagaagctgcaggatgctgtgggccagtgcttccccatcaagaactgcagcagccgccacagcagcggcctgcccagcaagaggaagatccacatcagcgagctgatgctggacaagtgccccttccccccaagaagtgacctggccttccgctggcacttcatcaagaggcacacagcccccatcaacagcaagagtgatgagtgggtgtccacagacctgagccagacagagctgagagatggccagctgaagagaagaaacatggaggagaacatcaactgcttcagccacaccaacgtgcagccctgcgtcatcaccacagacaatgccctgtgccgggagggccccatgactggatctgtgatgaacctggtgagcaacaacagcattgaggacagcgacatggacagtgatgatgagatcctgaccctgtgcaccagcagcaggaagaggaacaagcccaagtgggacctggatgatgagatcctgcagctggagaccccacccaagtaccacacccagattgattatgtgcactgcctggtgcctgacctgctgcagatcaacaacaacccctgctactggggcgtgatggacaagtatgctgctgaggccctgctggagggcaagccagagggcaccttcctgctgcgggacagcgcccaggaggactacctgttctctgtgtccttccgccgctacagccgcagcctgcacgccagaattgagcagtggaaccacaacttctcctttgatgcccatgacccctgtgtgttccacagcccagacatcaccggcctgctggagcactacaaggaccccagcgcctgcatgttctttgagcccctgctgagcacccccctcatccgcaccttccccttcagcctgcagcacatctgcaggacagtcatctgcaactgcaccacctatgatggcattgatgccctgcccatccccagctccatgaagctgtacctgaaggagtaccactacaagagcaaggtgcgggtgctgagaattgatgcccctgagcagcagtgctag

SEQ ID NO: 172062 - DNA, 1323 bp, Artificial Sequence; identical to SEQ ID NO: 172061
  Description of Artificial Sequence: Synthetic coding sequence

SEQ ID NO: 172063 - DNA, 1323 bp, Artificial Sequence; identical to SEQ ID NO: 172061
  Description of Artificial Sequence: Synthetic coding sequence

SEQ ID NO: 172064 - DNA, 1611 bp, Artificial Sequence
  Description of Artificial Sequence: Synthetic coding sequence
atggacaaggtgggcaagatgtggaacaacttcaagtaccgctgccagaacctgtttggacatgaaggaggcagccgctcagaaaatgtggacatgaacagcaaccgctgcctgtctgtgaaggagaagaacatcagcattggagacagcaccccccagcagcagagcagccccctgagagaaaatattgccctgcagctgggcctgagccccagcaagaacagcagcagaagaaaccagaactgtgccacagagatcccccagatcgtggagatcagcattgagaaggacaatgacagctgtgtgaccccaggcacccggctggcccggcgggacagctacagcagacatgccccctggggcggcaagaagaagcacagctgcagcaccaagacccagagcagcctggatgctgacaagaagtttggccgcaccaggagcggcctgcagaggcgggagcggcgctatggagtgtcctctgtgcatgacatggacagcgtgagcagcaggacagtgggcagccgcagcctgcggcagaggctgcaggacacagtgggcctgtgcttccccatgaggacctacagcaagcagagcaagcccctcttcagcaacaagaggaagatccacctgtctgagctgatgctggagaagtgccccttccctgctggcagtgacctggcccagaagtggcacctgatcaagcagcacacagcccctgtgagcccccacagcaccttctttgacacctttgaccccagcctggtgtccacagaagatgaagaagatcggctgcgggagcggcggcggctgagcattgaggagggcgtggaccccccaccaaatgcccagatccacacctttgaggccacagcccaggtgaaccccctgtacaagctgggccccaagctggcccctggcatgacagagatcagcggggacagcagcgccatcccccaggccaactgtgacagcgaggaggacaccaccaccctgtgcctgcagagccggcggcagaagcagaggcagatcagcggggacagccacacccacgtgtcccggcagggcgcctggaaggtgcacacccagattgactacatccactgcctggtgcctgacctgctgcagatcactggaaacccctgctactggggcgtgatggacagatatgaagctgaggccctgctggagggcaagccagagggcaccttcctgctgcgggacagcgcccaggaggactacctgttctctgtgtccttccgccgctacaacagaagcctgcacgcccgcatcgagcagtggaaccacaacttctcctttgatgcccatgacccctgtgtgttccacagcagcacagtgacaggcctgctggagcactacaaggaccccagcagctgcatgttctttgagcccctgctgaccatcagcctgaacagaaccttccccttcagcctgcagtacatctgccgggccgtcatctgccgctgcaccacctatgatggcattgatggcctgcccctgcccagcatgctgcaggacttcctgaaggagtaccactacaagcagaaggtgcgggtgcgctggctggagcgggagcctgtgaaggccaagtag

SEQ ID NO: 172065 - DNA, 1611 bp, Artificial Sequence; identical to SEQ ID NO: 172064
  Description of Artificial Sequence: Synthetic coding sequence

SEQ ID NO: 172066 - DNA, 3264 bp, Artificial Sequence
  Description of Artificial Sequence: Synthetic coding sequence
atgtctgacagcgaggacagcaacttcagcgaggaggaggacagcgagaggagcagtgatggagaggaggccgaggtggatgaggagcggcgctctgctgctggcagcgagaaggaggaggagccagaagatgaggaggaggaggaggaggaggaggagtatgatgaggaggaggaggaggaggatgatgaccggccccccaagaagcccaggcatggaggcttcatcctggatgaagcagatgtggatgatgaatatgaagatgaggaccagtgggaggatggagctgaggacatcctggagaaggaggagattgaggccagcaacatcgacaacgtggtgctggatgaagatagaagtggggcccggcggctgcagaacctgtggagggaccagcgggaggaggagctgggggagtactacatgaagaagtatgccaagagctctgtgggggagaccgtgtatggaggcagtgatgagctgagtgatgacatcacccagcagcagctgctgcccggggtgaaggaccccaacctgtggacagtgaagtgcaagatcggggaggagcgggccacagccatcagcctgatgaggaagttcatcgcctaccagttcacagacacccccctgcagatcaagtctgtggtggcccctgagcacgtgaagggctacatctacgtggaggcctacaagcagacccacgtgaagcaggccattgaaggagtgggcaacctgcggctgggctactggaaccagcagatggtgcccatcaaggagatgacagatgtgctgaaggtggtgaaggaggtggccaacctgaagcccaagtcctgggtgcggctgaagaggggcatctacaaggatgacatcgcccaggtggactatgtggagcccagccagaacaccatcagcctgaagatgatccccagaattgattatgaccgcatcaaggccaggatgagcctgaaggactggtttgccaagaggaagaagttcaagaggcctccccagaggctgtttgatgctgagaagatccgcagcctgggcggagatgtggccagtgatggagacttcctgatctttgagggcaaccgctacagcaggaagggcttcctgttcaagagctttgccatgtctgctgtgatcacagaaggagtgaagcccaccctgtctgagctggagaagtttgaggaccagcctgagggcatcgacctggaggtggtgacagagagcacaggcaaggagcgggagcacaacttccagcccggggacaacgtggaggtgtgtgagggggagctgatcaacctgcagggcaagatcctgtctgtggatggcaacaagatcaccatcatgcccaagcatgaggacctgaaggacatgctggagttccctgcccaggagctgaggaagtacttcaagatgggagaccacgtgaaggtgattgctggccgctttgaaggagacaccggcctcatcgtgcgggtggaggagaactttgtgatcctcttcagtgacctgaccatgcatgagctgaaggtgctgccccgggacctgcagctgtgcagcgagacagccagcggcgtggatgtgggcggccagcacgagtggggcgagctggtgcagctggacccccagacagtgggcgtcatcgtgcggctggagcgggagaccttccaggtgctgaacatgtatggcaaggtggtgacagtgcgccaccaggccgtgaccaggaagaaggacaacagatttgctgtggccctggacagcgagcagaacaacatccacgtgaaggacatcgtgaaggtgattgatggcccccacagcggccgggagggggagatccgccacctgttccgcagctttgccttcctgcactgcaagaagctggtggagaatggaggcatgtttgtgtgcaagaccaggcacctggtgctggccggcggcagcaagcccagagatgtgaccaacttcaccgtgggcggctttgcccccatgagcccccgcatcagcagccccatgcaccccagcgctgggggccagaggggcggcttcggcagccctgggggcggcagcggcggcatgagccggggccggggccggcgggacaatgaactcatcggccagacagtgcgcatcagccagggcccctacaagggctacatcggcgtggtgaaggatgccacagagagcacagcccgggtggagctgcacagcacctgccagaccatctctgtggaccggcagaggctgaccaccgtgggcagccggcggcctgggggcatgaccagcacctacggccgcacccccatgtatggcagccagacccccatgtatggcagcggcagcaggacccccatgtatggcagccagacccccctgcaggacggcagcaggaccccccactacggcagccagacccccctgcatgatggcagcaggaccccagcccagagcggggcctgggaccccaacaaccccaacacccccagcagagctgaggaggagtatgaatatgcctttgatgatgagcccacccccagcccccaggcctatggaggcacccccaacccccagaccccaggctacccagaccccagcagcccccaggtgaacccccagtacaacccccagaccccaggcaccccagccatgtacaacacagaccagttcagcccctatgctgcccccagcccccagggcagctaccagcccagccccagcccccagagctaccaccaggtggcccccagccctgctggctaccagaacacccacagccctgccagctaccaccccacccccagccccatggcctaccaggccagccccagccccagccctgtgggctacagccccatgacccctggggcccccagccctgggggctacaacccccacaccccaggcagcggcatcgagcagaacagcagtgactgggtgaccacagacatccaggtgaaggtgcgggacacctacctggacacccaggtggtgggccagacaggagtcatccgctctgtgactggaggcatgtgcagcgtgtacctgaaggacagcgagaaggtggtgtccatcagcagcgagcacctggagcccatcacccccaccaagaacaacaaggtgaaggtgatcctgggagaagatcgggaggccaccggggtgctgctgagcattgatggagaagatggcatcgtgaggatggacctggatgagcagctgaagatcctgaacctgcgcttcctgggcaagctgctggaggcctag

SEQ ID NO: 172067 - DNA, 3198 bp, Artificial Sequence
  Description of Artificial Sequence: Synthetic coding sequence
atgtctgacagcgaggacagcaacttcagcgaggaggaggacagcgagaggagcagtgatggagaggaggccgaggtggatgaggagcggcgctctgctgctggcagcgagaaggaggatgatgaccggccccccaagaagcccaggcatggaggcttcatcctggatgaagcagatgtggatgatgaatatgaagatgaggaccagtgggaggatggagctgaggacatcctggagaaggaggagattgaggccagcaacatcgacaacgtggtgctggatgaagatagaagtggggcccggcggctgcagaacctgtggagggaccagcgggaggaggagctgggggagtactacatgaagaagtatgccaagagctctgtgggggagaccgtgtatggaggcagtgatgagctgagtgatgacatcacccagcagcagctgctgcccggggtgaaggaccccaacctgtggacagtgaagtgcaagatcggggaggagcgggccacagccatcagcctgatgaggaagttcatcgcctaccagttcacagacacccccctgcagatcaagtctgtggtggcccctgagcacgtgaagggctacatctacgtggaggcctacaagcagacccacgtgaagcaggccattgaaggagtgggcaacctgcggctgggctactggaaccagcagatggtgcccatcaaggagatgacagatgtgctgaaggtggtgaaggaggtggccaacctgaagcccaagtcctgggtgcggctgaagaggggcatctacaaggatgacatcgcccaggtggactatgtggagcccagccagaacaccatcagcctgaagatgatccccagaattgattatgaccgcatcaaggccaggatgagcctgaaggactggtttgccaagaggaagaagttcaagaggcctccccagaggctgtttgatgctgagaagatccgcagcctgggcggagatgtggccagtgatggagacttcctgatctttgagggcaaccgctacagcaggaagggcttcctgttcaagagctttgccatgtctgctgtgatcacagaaggagtgaagcccaccctgtctgagctggagaagtttgaggaccagcctgagggcatcgacctggaggtggtgacagagagcacaggcaaggagcgggagcacaacttccagcccggggacaacgtggaggtgtgtgagggggagctgatcaacctgcagggcaagatcctgtctgtggatggcaacaagatcaccatcatgcccaagcatgaggacctgaaggacatgctggagttccctgcccaggagctgaggaagtacttcaagatgggagaccacgtgaaggtgattgctggccgctttgaaggagacaccggcctcatcgtgcgggtggaggagaactttgtgatcctcttcagtgacctgaccatgcatgagctgaaggtgctgccccgggacctgcagctgtgcagcgagacagccagcggcgtggatgtgggcggccagcacgagtggggcgagctggtgcagctggacccccagacagtgggcgtcatcgtgcggctggagcgggagaccttccaggtgctgaacatgtatggcaaggtggtgacagtgcgccaccaggccgtgaccaggaagaaggacaacagatttgctgtggccctggacagcgagcagaacaacatccacgtgaaggacatcgtgaaggtgattgatggcccccacagcggccgggagggggagatccgccacctgttccgcagctttgccttcctgcactgcaagaagctggtggagaatggaggcatgtttgtgtgcaagaccaggcacctggtgctggccggcggcagcaagcccagagatgtgaccaacttcaccgtgggcggctttgcccccatgagcccccgcatcagcagccccatgcaccccagcgctgggggccagaggggcggcttcggcagccctgggggcggcagcggcggcatgagccggggccggggccggcgggacaatgaactcatcggccagacagtgcgcatcagccagggcccctacaagggctacatcggcgtggtgaaggatgccacagagagcacagcccgggtggagctgcacagcacctgccagaccatctctgtggaccggcagaggctgaccaccgtgggcagccggcggcctgggggcatgaccagcacctacggccgcacccccatgtatggcagccagacccccatgtatggcagcggcagcaggacccccatgtatggcagccagacccccctgcaggacggcagcaggaccccccactacggcagccagacccccctgcatgatggcagcaggaccccagcccagagcggggcctgggaccccaacaaccccaacacccccagcagagctgaggaggagtatgaatatgcctttgatgatgagcccacccccagcccccaggcctatggaggcacccccaacccccagaccccaggctacccagaccccagcagcccccaggtgaacccccagtacaacccccagaccccaggcaccccagccatgtacaacacagaccagttcagcccctatgctgcccccagcccccagggcagctaccagcccagccccagcccccagagctaccaccaggtggcccccagccctgctggctaccagaacacccacagccctgccagctaccaccccacccccagccccatggcctaccaggccagccccagccccagccctgtgggctacagccccatgacccctggggcccccagccctgggggctacaacccccacaccccaggcagcggcatcgagcagaacagcagtgactgggtgaccacagacatccaggtgaaggtgcgggacacctacctggacacccaggtggtgggccagacaggagtcatccgctctgtgactggaggcatgtgcagcgtgtacctgaaggacagcgagaaggtggtgtccatcagcagcgagcacctggagcccatcacccccaccaagaacaacaaggtgaaggtgatcctgggagaagatcgggaggccaccggggtgctgctgagcattgatggagaagatggcatcgtgaggatggacctggatgagcagctgaagatcctgaacctgcgcttcctgggcaagctgctggaggcctag

SEQ ID NO: 172068 - DNA, 3252 bp, Artificial Sequence
  Description of Artificial Sequence: Synthetic coding sequence
atgtctgacagcgaggacagcaacttcagcgaggaggaggacagcgagaggagcagtgatggagaggaggccgaggtggatgaggagcggcgctctgctgctggcagcgagaaggaggaggagccagaagatgaggaggaggaggaggaggaggaggagtatgatgaggaggaggaggaggaggatgatgaccggccccccaagaagcccaggcatggaggcttcatcctggatgaagcagatgtggatgatgaatatgaagatgaggaccagtgggaggatggagctgaggacatcctggagaaggccagcaacatcgacaacgtggtgctggatgaagatagaagtggggcccggcggctgcagaacctgtggagggaccagcgggaggaggagctgggggagtactacatgaagaagtatgccaagagctctgtgggggagaccgtgtatggaggcagtgatgagctgagtgatgacatcacccagcagcagctgctgcccggggtgaaggaccccaacctgtggacagtgaagtgcaagatcggggaggagcgggccacagccatcagcctgatgaggaagttcatcgcctaccagttcacagacacccccctgcagatcaagtctgtggtggcccctgagcacgtgaagggctacatctacgtggaggcctacaagcagacccacgtgaagcaggccattgaaggagtgggcaacctgcggctgggctactggaaccagcagatggtgcccatcaaggagatgacagatgtgctgaaggtggtgaaggaggtggccaacctgaagcccaagtcctgggtgcggctgaagaggggcatctacaaggatgacatcgcccaggtggactatgtggagcccagccagaacaccatcagcctgaagatgatccccagaattgattatgaccgcatcaaggccaggatgagcctgaaggactggtttgccaagaggaagaagttcaagaggcctccccagaggctgtttgatgctgagaagatccgcagcctgggcggagatgtggccagtgatggagacttcctgatctttgagggcaaccgctacagcaggaagggcttcctgttcaagagctttgccatgtctgctgtgatcacagaaggagtgaagcccaccctgtctgagctggagaagtttgaggaccagcctgagggcatcgacctggaggtggtgacagagagcacaggcaaggagcgggagcacaacttccagcccggggacaacgtggaggtgtgtgagggggagctgatcaacctgcagggcaagatcctgtctgtggatggcaacaagatcaccatcatgcccaagcatgaggacctgaaggacatgctggagttccctgcccaggagctgaggaagtacttcaagatgggagaccacgtgaaggtgattgctggccgctttgaaggagacaccggcctcatcgtgcgggtggaggagaactttgtgatcctcttcagtgacctgaccatgcatgagctgaaggtgctgccccgggacctgcagctgtgcagcgagacagccagcggcgtggatgtgggcggccagcacgagtggggcgagctggtgcagctggacccccagacagtgggcgtcatcgtgcggctggagcgggagaccttccaggtgctgaacatgtatggcaaggtggtgacagtgcgccaccaggccgtgaccaggaagaaggacaacagatttgctgtggccctggacagcgagcagaacaacatccacgtgaaggacatcgtgaaggtgattgatggcccccacagcggccgggagggggagatccgccacctgttccgcagctttgccttcctgcactgcaagaagctggtggagaatggaggcatgtttgtgtgcaagaccaggcacctggtgctggccggcggcagcaagcccagagatgtgaccaacttcaccgtgggcggctttgcccccatgagcccccgcatcagcagccccatgcaccccagcgctgggggccagaggggcggcttcggcagccctgggggcggcagcggcggcatgagccggggccggggccggcgggacaatgaactcatcggccagacagtgcgcatcagccagggcccctacaagggctacatcggcgtggtgaaggatgccacagagagcacagcccgggtggagctgcacagcacctgccagaccatctctgtggaccggcagaggctgaccaccgtgggcagccggcggcctgggggcatgaccagcacctacggccgcacccccatgtatggcagccagacccccatgtatggcagcggcagcaggacccccatgtatggcagccagacccccctgcaggacggcagcaggaccccccactacggcagccagacccccctgcatgatggcagcaggaccccagcccagagcggggcctgggaccccaacaaccccaacacccccagcagagctgaggaggagtatgaatatgcctttgatgatgagcccacccccagcccccaggcctatggaggcacccccaacccccagaccccaggctacccagaccccagcagcccccaggtgaacccccagtacaacccccagaccccaggcaccccagccatgtacaacacagaccagttcagcccctatgctgcccccagcccccagggcagctaccagcccagccccagcccccagagctaccaccaggtggcccccagccctgctggctaccagaacacccacagccctgccagctaccaccccacccccagccccatggcctaccaggccagccccagccccagccctgtgggctacagccccatgacccctggggcccccagccctgggggctacaacccccacaccccaggcagcggcatcgagcagaacagcagtgactgggtgaccacagacatccaggtgaaggtgcgggacacctacctggacacccaggtggtgggccagacaggagtcatccgctctgtgactggaggcatgtgcagcgtgtacctgaaggacagcgagaaggtggtgtccatcagcagcgagcacctggagcccatcacccccaccaagaacaacaaggtgaaggtgatcctgggagaagatcgggaggccaccggggtgctgctgagcattgatggagaagatggcatcgtgaggatggacctggatgagcagctgaagatcctgaacctgcgcttcctgggcaagctgctggaggcctag

SEQ ID NO: 172069 - DNA, 3264 bp, Artificial Sequence; identical to SEQ ID NO: 172066
  Description of Artificial Sequence: Synthetic coding sequence

SEQ ID NO: 172070 - DNA, 3264 bp, Artificial Sequence; identical to SEQ ID NO: 172066
  Description of Artificial Sequence: Synthetic coding sequence

SEQ ID NO: 172071 - DNA, 3264 bp, Artificial Sequence; identical to SEQ ID NO: 172066
  Description of Artificial Sequence: Synthetic coding sequence

SEQ ID NO: 172072 - DNA, 5181 bp, Artificial Sequence
  Description of Artificial Sequence: Synthetic coding sequence
atgtctgactttgtggagagcgaggccgaggagagcgaggaggagtacaatgatgaaggagaggtggtgccccgggtgaccaagaagtttgtggaggaggaggatgatgatgaggaggaggaggaggagaacctggatgaccaggatgagcagggcaacctgaagggcttcatcaatgatgatgatgatgaagatgaaggagaagaagatgagggcagtgacagcggggacagtgaagatgatgtgggccacaagaagaggaagaggaccagctttgatgaccggctggaggatgatgactttgacctgattgaggagaacctgggcgtgaaggtgaagaggggccagaagtacagaagagtgaagaagatgtctgatgatgaagatgatgatgaggaggagtatggcaaggaggagcacgagaaggaggccatcgccgaggagatcttccaggatggagagggggaggagggccaggaggccatggaggcccccatggcccctcctgaggaggaggaggaggatgatgaggagagtgacattgatgacttcatcgtggatgatgatggccagcccctgaagaagcccaagtggaggaagaagctgcccggctacacagatgctgccctgcaggaggcccaggagatctttggagtggactttgattatgatgaatttgagaagtacaatgaatatgatgaggagctggaggaggagtatgaatatgaagatgatgaagctgagggggagatccgggtgcggcccaagaagaccaccaagaagagggtgtccagaagaagcatctttgagatgtatgagcccagcgagctggagagcagccacctgacagaccaggacaatgagatccgggccacagacctgcctgagcgcttccagctgcggagcatccctgtgaagggagcagaagatgatgagctggaggaggaggccgactggatctacagaaatgcctttgccacccccaccatcagcctgcaggagagctgtgactacctggaccggggccagcctgccagcagcttcagcaggaagggccccagcaccatccagaagatcaaggaggccctgggcttcatgaggaaccagcactttgaggtgcccttcatcgccttctacaggaaggagtatgtggagcctgagctgcacatcaatgacctgtggagggtgtggcagtgggatgagaagtggacccagctgcgcatcagaaaagaaaacctgacccggctgtttgagaagatgcaggcctaccagtatgagcagatctctgctgaccctgacaagcccctggctgatggcatccgggccctggacaccacagacatggagcggctgaaggatgtgcagagcatggatgagctgaaggatgtgtacaaccacttcctgctgtactacggccgggacatccccaagatgcagaatgctgccaaggccagcaggaagaagctgaagagggtgcgggaggagggagatgaggagggggagggagatgaagcagaagatgaggagcagaggggccctgagctgaagcaggccagccggcgggacatgtacaccatctgccagagcgctggcctggatggcctggccaagaagtttggcctgaccccagagcagtttggagagaacctgcgggacagctaccagagacatgaaacagagcagtttcctgctgagcccctggagctggccaaggactatgtgtgcagccagttccccaccccagaggccgtgctggagggcgcccgctacatggtggccctgcagatcgcccgggagcccctggtgcggcaggtgctgcggcagaccttccaggagcgggccaagctgaacatcacccccaccaagaagggcaggaaggatgtggatgaggcccactacgcctacagcttcaagtacctgaagaacaagcctgtgaaggagctgagagatgaccagttcctgaagatctgcctggccgaggatgagggcctgctgaccacagacatcagcattgacctgaagggcgtggagggctatggaaatgaccagacctactttgaggagatcaagcagttctactacagagatgagttcagccaccaggtgcaggagtggaaccggcagaggaccatggccatcgagcgggccctgcagcagttcctgtatgtgcagatggccaaggagctgaagaacaagctgctggccgaggccaaggagtatgtgatcaaggcctgcagcaggaagctgtacaactggctgcgggtggccccctacagaccagaccagcaggtggaggaggatgatgacttcatggatgagaaccagggcaagggcatccgggtgctgggcatcgccttcagcagcgcccgggaccaccctgtgttctgtgccctggtgaatggagagggggaggtgacagacttcctgcggctgccccacttcaccaagagaagaacagcctggagggaggaggagcgggagaagaaggcccaggacatcgagaccctgaagaagttcctgctgaacaagaagccccacgtggtgacagtggccggagaaaatagagatgcccagatgctgattgaagatgtgaagagaattgtgcatgagctggaccagggccagcagctgagcagcattggagtggagctggtggacaatgagctggccatcctgtacatgaacagcaagaagtctgaggccgagttccgggactacccacctgtgctgcggcaggccgtgtccctggcccggcgcatccaggaccccctgattgaatttgcccaggtgtgcagcagtgatgaggacatcctgtgcctgaagttccaccccctgcaggagcacgtggtgaaggaggagctgctgaatgccctgtactgtgagttcatcaacagagtgaatgaggtgggcgtggatgtgaacagagccatcgcccacccctacagccaggccctgatccagtatgtgtgtggcctgggccccaggaagggcacccacctgctgaagatcctgaagcagaacaacacccggctggagagcaggacccagctggtgaccatgtgccacatgggccccaaggtgttcatgaactgtgccggcttcctgaagattgacacagccagcctgggggacagcacagacagctacatcgaggtgctggatggcagccgggtgcaccctgagacctatgagtgggccaggaagatggctgtggatgccctggagtatgatgaatctgcagaagatgccaacccagctggggccctggaggagatcctggagaaccctgagcggctgaaggacctggacctggatgcctttgctgaggagctggagcggcagggctacggggacaagcacatcaccctgtatgacatccgggcagagctgagctgccgctacaaggacctgaggacagcctaccgcagccccaacacagaggagatcttcaacatgctgaccaaggagaccccagagaccttctacatcggcaagctgatcatctgcaatgtgacaggcatcgcccacagaagaccccagggcgagagctatgaccaggccatcagaaatgatgaaacaggcctgtggcagtgccccttctgccagcaggacaacttccctgagctgtctgaggtgtggaaccactttgacagcggcagctgccccggccaggccatcggcgtgaagacccggctggacaacggggtgacaggcttcatccccaccaagttcctgagtgacaaggtggtgaagaggcctgaggagcgggtgaaggtgggcatgacagtgcactgccgcatcatgaagattgacatcgagaagttctctgctgacctgacctgcaggaccagtgacctgatggacagaaataatgagtggaagctgcccaaggacacctactatgactttgatgctgaggccgctgaccacaagcaggaggaggacatgaagaggaagcagcagaggaccacctacatcaagagggtcatcgcccaccccagcttccacaacatcaacttcaagcaggccgagaagatgatggagaccatggaccagggagatgtgatcatccggcccagcagcaagggggagaaccacctgactgtgacctggaaggtgtctgatggcatctaccagcacgtggatgtgcgggaggagggcaaggaaaatgccttcagcctgggcgccaccctgtggatcaacagcgaggagtttgaggacctggatgaaattgtggcccgctacgtgcagcccatggccagctttgcccgggacctgctgaaccacaagtactaccaggactgcagcggcggggacaggaagaagctggaggagctgctgatcaagaccaagaaggagaagcccaccttcatcccctacttcatctgtgcctgcaaggagctgcccgggaagttcctgctgggctaccagccccggggcaagccccgcatcgagtatgtgacagtgaccccagagggcttccgctaccggggccagatcttccccaccgtgaatggcctcttccgctggttcaaggaccactaccaggaccctgtgcccggcatcacccccagcagcagcagcaggaccaggaccccagccagcatcaatgccaccccagccaacatcaacctggccgacctgaccagggctgtgaatgccctgccccagaacatgaccagccagatgttttctgccatcgctgctgtgacaggccagggccagaaccccaatgccaccccagcccagtgggccagcagccagtatggctatggaggcagcggcggcggcagcagcgcctaccacgtgttccccaccccagcccagcagcctgtggccacccccctgatgacccccagctacagctacaccacccccagccagcccatcaccaccccccagtaccaccagctgcaggccagcaccaccccccagagcgcccaggcccagccccagcccagcagcagcagccggcagaggcagcagcagcccaagagcaacagccacgccgccatcgactggggcaagatggccgagcagtggctgcaggagaaggaggccgagaggaggaagcagaagcagaggctgaccccccggcccagccccagccccatgattgagagcacccccatgagcattgctggagatgccacccccctgctggatgagatggacagatag

SEQ ID NO: 172073 - DNA, 2181 bp, Artificial Sequence
  Description of Artificial Sequence: Synthetic coding sequence
atgtctgactttgtggagagcgaggccgaggagagcgaggaggagtacaatgatgaaggagaggtggtgccccgggtgaccaagaagtttgtggaggaggaggatgatgatgaggaggaggaggaggagaacctggatgaccaggatgagcagggcaacctgaagggcttcatcaatgatgatgatgatgaagatgaaggagaagaagatgagggcagtgacagcggggacagtgaagatgatgtgggccacaagaagaggaagaggaccagctttgatgaccggctggaggatgatgactttgacctgattgaggagaacctgggcgtgaaggtgaagaggggccagaagtacagaagagtgaagaagatgtctgatgatgaagatgatgatgaggaggagtatggcaaggaggagcacgagaaggaggccatcgccgaggagatcttccaggatggagagggggaggagggccaggaggccatggaggcccccatggcccctcctgaggaggaggaggaggatgatgaggagagtgacattgatgacttcatcgtggatgatgatggccagcccctgaagaagcccaagtggaggaagaagctgcccggctacacagatgctgccctgcaggaggcccaggagatctttggagtggactttgattatgatgaatttgagaagtacaatgaatatgatgaggagctggaggaggagtatgaatatgaagatgatgaagctgagggggagatccgggtgcggcccaagaagaccaccaagaagagggtgtccagaagaagcatctttgagatgtatgagcccagcgagctggagagcagccacctgacagaccaggacaatgagatccgggccacagacctgcctgagcgcttccagctgcggagcatccctgtgaagggagcagaagatgatgagctggaggaggaggccgactggatctacagaaatgcctttgccacccccaccatcagcctgcaggagagctgtgactacctggaccggggccagcctgccagcagcttcagcaggaagggccccagcaccatccagaagatcaaggaggccctgggcttcatgaggaaccagcactttgaggtgcccttcatcgccttctacaggaaggagtatgtggagcctgagctgcacatcaatgacctgtggagggtgtggcagtgggatgagaagtggacccagctgcgcatcagaaaagaaaacctgacccggctgtttgagaagatgcaggcctaccagtatgagcagatctctgctgaccctgacaagcccctggctgatggcatccgggccctggacaccacagacatggagcggctgaaggatgtgcagagcatggatgagctgaaggatgtgtacaaccacttcctgctgtactacggccgggacatccccaagatgcagaatgctgccaaggccagcaggaagaagctgaagagggtgcgggaggagggagatgaggagggggagggagatgaagcagaagatgaggagcagaggggccctgagctgaagcaggccagccggcgggacatgtacaccatctgccagagcgctggcctggatggcctggccaagaagtttggcctgaccccagagcagtttggagagaacctgcgggacagctaccagagacatgaaacagagcagtttcctgctgagcccctggagctggccaaggactatgtgtgcagccagttccccaccccagaggccgtgctggagggcgcccgctacatggtggccctgcagatcgcccgggagcccctggtgcggcaggtgctgcggcagaccttccaggagcgggccaagctgatgacccccagctacagctacaccacccccagccagcccatcaccaccccccagtaccaccagctgcaggccagcaccaccccccagagcgcccaggcccagccccagcccagcagcagcagccggcagaggcagcagcagcccaagagcaacagccacgccgccatcgactggggcaagatggccgagcagtggctgcaggagaaggaggccgagaggaggaagcagaagcagaggctgaccccccggcccagccccagccccatgattgagagcacccccatgagcattgctggagatgccacccccctgctggatgagatggacagatag

SEQ ID NO: 172074 - DNA, 2361 bp, Artificial Sequence
  Description of Artificial Sequence: Synthetic coding sequence
atgtccttcagccgggccctgctgtgggcccggctgcctgctggccggcaggccggccaccgggccgccatctgcagcgccctgcggccccacttcggccccttccctggggtgctgggccaggtgtctgtgctggccacagccagcagcagcgccagcggcggcagcaagatccccaacaccagcctgtttgtgcccctgactgtgaagccccagggccccagcgcagatggagatgtgggcgctgagctgacccggcccctggacaagaatgaggtgaagaaggtgctggacaagttctacaagaggaaggagatccagaagctgggcgctgactatggcctggatgcccggctcttccaccaggccttcatctccttcaggaactacatcatgcagagccacagcctggatgtggacatccacatcgtgctgaatgacatctgcttcggggccgcccatgctgatgacctcttccccttcttcctgcggcatgccaagcagatcttccctgtgctggactgcaaggatgacctgaggaagatcagtgacctgcgcatcccccccaactggtacccagatgcccgggccatgcagaggaagatcatcttccacagcggccccaccaacagcggcaagacctaccacgccatccagaagtacttcagcgccaagagcggcgtgtactgcggccccctgaagctgctggcccacgagatctttgagaagagcaatgctgctggggtgccctgtgacctggtgactggagaggagcgggtgacagtgcagcccaacgggaagcaggccagccacgtgtcctgcaccgtggagatgtgcagcgtgaccaccccctatgaggtggccgtgattgatgagatccagatgatccgggaccctgcccggggctgggcctggacccgggccctgctgggcctgtgtgccgaggaggtgcacctgtgtggggagcctgctgccatcgacctggtgatggagctgatgtacaccaccggggaggaggtggaggtgcgggactacaagaggctgacccccatctctgtgctggaccacgccctggagagcctggacaacctgcggcctggggactgcatcgtgtgcttcagcaagaatgacatctacagcgtgtcccggcagatcgagatccggggcctggagagcgctgtgatctacggcagcctgcccccaggcaccaagctggcccaggccaagaagttcaatgaccccaatgacccctgcaagatcctggtggccacagatgccatcggcatgggcctgaacctgagcatccgccgcatcatcttctacagcctcatcaagcccagcatcaatgaaaaaggagagcgggagctggagcccatcaccaccagccaggccctgcagattgctggccgggccggccgcttcagcagccgcttcaaggagggggaggtgaccaccatgaaccacgaggacctgagcctgctgaaggagatcctgaagaggcctgtggaccccatccgggccgccggcctgcaccccacagctgagcagatcgagatgtttgcctaccacctgcctgatgccaccctgagcaacctgattgacatctttgtggacttcagccaggtggatggccagtactttgtgtgcaacatggatgacttcaagttctctgctgagctgatccagcacatccccctgagcctgcgggtgcgctacgtgttctgcacagcccccatcaacaagaagcagccctttgtgtgcagcagcctgctgcagtttgcccggcagtacagcagaaatgagcccctgacctttgcctggctgcggcgctacatcaagtggcccctgctgccccccaagaacatcaaggacctgatggacctggaggccgtgcatgatgtgctggacctgtacctgtggctgagctaccgcttcatggacatgtttcctgatgccagcctcatccgggacctgcagaaggagctggatggcatcatccaggatggagtgcacaacatcaccaagctgatcaagatgtctgagacccacaagctgctgaacctggagggcttccccagcggcagccagagccggctgagcggcaccctgaagagccaggcccggaggacccggggcaccaaggccctgggcagcaaggccacagagccccccagcccagatgctggggagctgagcctggccagccggctggtgcagcagggcctgctgaccccagacatgctgaagcagctggagaaggagtggatgacccagcagacagagcacaacaaggagaagacagaaagtggcacccaccccaagggcaccaggaggaagaagaaggagccagacagcgactag

SEQ ID NO: 172075 - DNA, 792 bp, Artificial Sequence
  Description of Artificial Sequence: Synthetic coding sequence
atgtccttcagccgggccctgctgtgggcccggctgcctgctggccggcaggccggccaccgggccgccatctgcagcgccctgcggccccacttcggccccttccctggggtgctgggccaggtgtctgtgctggccacagccagcagcagcgccagcggcggcagcaagatccccaacaccagcctgtttgtgcccctgactgtgaagccccagggccccagcgcagatggagatgtgggcgctgagctgacccggcccctggacaagaatgaggtggccgtgattgatgagatccagatgatccgggaccctgcccggggctgggcctggacccgggccctgctgggcctgtgtgccgaggaggtgcacctgtgtggggagcctgctgccatcgacctggtgatggagctgatgtacaccaccggggaggaggtggaggtgcgggactacaagaggctgacccccatctctgtgctggaccacgccctggagagcctggacaacctgcggcctggggactgcatcgtgtgcttcagcaagaatgacatctacagcgtgtcccggcagatcgagatccggggcctggagagcgctgtgatctacggcagcctgcccccaggcaccaagctggcccaggccaagaagttcaatgaccccaatgacccctgcaagatcctggtggccacagatgccatcggcatgggcctgaacctgagcatccgccgcatcatcttctacagcctcatcaagcccagcatcaatgaaaaaggagagcgggagctggagtag

SEQ ID NO: 172076 - DNA, 1233 bp, Artificial Sequence
  Description of Artificial Sequence: Synthetic coding sequence
atggctgctgtgggcgctgaggcccggggggcctggtgtgtgccctgcctggtgtccctggacaccctgcaggagctgtgcaggaaggagaagctgacctgcaagagcatcggcatcaccaagaggaacctgaacaactatgaggtggagtacctgtgtgactacaaggtggtgaaggacatggagtactacctggtgaagtggaagggctggccagacagcaccaacacctgggagcccctgcagaacctgaagtgccccctgctgctgcagcagttcagcaatgacaagcacaactacctgagccaggtgaagaagggcaaggccatcacccccaaggacaacaacaagaccctgaagccagccatcgccgagtacatcgtgaagaaggccaagcagagaattgccctgcagcgctggcaggatgagctgaacagaaggaagaaccacaagggcatgatctttgtggagaacacagtggacctggagggccccccaagtgacttctactacatcaatgagtacaagccagcccctggcatcagcctggtgaatgaggccaccttcggctgcagctgcacagactgcttcttccagaagtgctgcccagctgaggccggcgtgctgctggcctacaacaagaaccagcagatcaagatccccccaggcacccccatctatgagtgcaacagccgctgccagtgtggccctgactgccccaacagaattgtgcagaagggcacccagtacagcctgtgcatcttccgcaccagcaatggccggggctggggcgtgaagaccctggtgaagatcaagaggatgagctttgtgatggagtatgtgggggaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagagggtgaggacagtgtgcaagtgtggggctgtgacctgccggggctacctgaactag

SEQ ID NO: 172077 - DNA, 693 bp, Artificial Sequence
  Description of Artificial Sequence: Synthetic coding sequence
atggctgctgtgggcgctgaggcccggggggcctggtgtgtgccctgcctggtgtccctggacaccctgcaggagctgtgcaggaaggagaagctgacctgcaagagcatcggcatcaccaagaggaacctgaacaactatgaggtggagtacctgtgtgactacaaggtggtgaaggacatggagtactacctggtgaagtggaagggctggccagacagcaccaacacctgggagcccctgcagaacctgaagtgccccctgctgctgcagcagttcagcaatgacaagcacaactacctgagccaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagagggtgaggacagtgtgcaagtgtggggctgtgacctgccggggctacctgaactag

SEQ ID NO: 172078 - DNA, 459 bp, Artificial Sequence
  Description of Artificial Sequence: Synthetic coding sequence
atggagtactacctggtgaagtggaagggctggccagacagcaccaacacctgggagcccctgcagaacctgaagtgccccctgctgctgcagcagttcagcaatgacaagcacaactacctgagccaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagtag

SEQ ID NO: 172079 - DNA, 1053 bp, Artificial Sequence
  Description of Artificial Sequence: Synthetic coding sequence
atggagtactacctggtgaagtggaagggctggccagacagcaccaacacctgggagcccctgcagaacctgaagtgccccctgctgctgcagcagttcagcaatgacaagcacaactacctgagccaggtgaagaagggcaaggccatcacccccaaggacaacaacaagaccctgaagccagccatcgccgagtacatcgtgaagaaggccaagcagagaattgccctgcagcgctggcaggatgagctgaacagaaggaagaaccacaagggcatgatctttgtggagaacacagtggacctggagggccccccaagtgacttctactacatcaatgagtacaagccagcccctggcatcagcctggtgaatgaggccaccttcggctgcagctgcacagactgcttcttccagaagtgctgcccagctgaggccggcgtgctgctggcctacaacaagaaccagcagatcaagatccccccaggcacccccatctatgagtgcaacagccgctgccagtgtggccctgactgccccaacagaattgtgcagaagggcacccagtacagcctgtgcatcttccgcaccagcaatggccggggctggggcgtgaagaccctggtgaagatcaagaggatgagctttgtgatggagtatgtgggggaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagagggtgaggacagtgtgcaagtgtggggctgtgacctgccggggctacctgaactag

SEQ ID NO: 172080 - DNA, 2658 bp, Artificial Sequence
  Description of Artificial Sequence: Synthetic coding sequence
atgaagtggctgggggagagcaagatcatggtggtgaatggaagaagaaatggaggcaagctgagcaatgaccaccagcagaaccagagcaagctgcagcacacaggcaaggacaccctgaaggccggcaagaatgctgtggagaggaggagcaaccgctgcaatggaaacagcggctttgagggccagagccgctacgtgcccagcagcggcatgtctgccaaggagctgtgtgaaaatgatgacctggccaccagcctggtgctggacccctacctgggcttccagacccacaagatgaacaccagcgccttccccagccgcagcagccgccacttcagcaagagtgacagcttcagccacaacaaccctgtgcgcttccggcccatcaagggccggcaggaggagctgaaggaggtgattgagcgcttcaagaaggatgagcacctggagaaggccttcaagtgcctgaccagcggggagtgggcccggcactacttcctgaacaagaacaagatgcaggagaagctgttcaaggagcacgtgttcatctacctgaggatgtttgccacagattctggctttgagatcctgccctgcaaccgctacagcagcgagcagaatggagccaagatcgtggccaccaaggagtggaagagaaatgacaagattgagctgctggtgggctgcatcgccgagctgtctgaaattgaggagaacatgctgctgcggcatggagaaaatgacttctctgtgatgtacagcaccaggaagaactgtgcccagctgtggctgggccctgctgccttcatcaaccacgactgccggcccaactgcaagtttgtgtccacaggccgggacacagcctgtgtgaaggccctgcgggacatcgagcctggagaggagatcagctgctactatggagatggcttcttcggggagaacaatgagttctgtgagtgctacacctgtgagcggcggggcactggagccttcaagagccgggtgggcctgcctgccccagcccctgtgatcaacagcaaatatggcctgcgggagacagacaagaggctgaaccggctgaagaagctgggggacagcagcaagaacagcgacagccagagcgtgagcagcaacacagatgctgacaccacccaggagaagaacaatgccaccagcaacaggaagagctctgtgggcgtgaagaagaacagcaagagcaggaccctgacccggcagagcatgagccgcatcccagccagcagcaacagcaccagcagcaagctgacccacatcaacaacagccgggtgcccaagaagctgaagaagccagccaagcccctgctgagcaagatcaagctgaggaaccactgcaagaggctggagcagaagaatgccagcaggaagctggagatgggcaacctggtgctgaaggagcccaaggtggtgctgtacaagaacctgcccatcaagaaggacaaggagcctgagggccctgcccaggccgctgtggccagcggctgcctgaccaggcatgctgcccgggagcaccggcagaaccctgtgcggggggcccacagccagggcgagagcagcccctgcacctacatcaccaggagatctgtgaggaccaggaccaacctgaaggaggccagtgacatcaagctggagcccaacaccctgaatggctacaagagctctgtgacagagccctgcccagattctggagagcagctgcagcctgcccctgtgctgcaggaggaggagctggcccacgagacagcccagaagggggaggccaagtgccacaagagtgacaccggcatgagcaagaagaagagccggcagggcaagctggtgaagcagtttgccaagattgaggagagcacccctgtgcatgacagccctgggaaggatgatgctgtgcctgacctgatgggcccccacagcgaccagggcgagcacagcggcaccgtgggcgtgcctgtgtcctacacagactgtgcccccagccctgtgggctgcagcgtggtgaccagtgacagcttcaagaccaaggacagcttcagaacagccaagagcaagaagaagaggcgcatcaccaggtatgatgcccagctgatcctggagaacaacagcggcatccccaagctgaccctgcggaggagacatgacagcagcagcaagaccaatgaccaggagaatgatggcatgaacagcagcaagatcagcatcaagctgagcaaggaccatgacaatgacaacaacctgtatgtggccaagctgaacaacggcttcaacagcggcagcggcagcagcagcaccaagctgaagatccagctgaagagagatgaggagaacagaggcagctacacagagggcctgcatgaaaatggagtgtgctgcagcgaccccctgagcctgctggagagcaggatggaggtggatgactacagccagtatgaggaggagagcacagatgacagcagcagcagtgaaggagatgaggaggaggatgattatgatgatgactttgaagatgacttcatccccctgcccccagccaagaggctgcggctgattgtgggcaaggacagcattgatattgacatcagcagcagaagaagagaggaccagagcctgcggctgaatgcctag

SEQ ID NO: 172081 - DNA, 1182 bp, Artificial Sequence
  Description of Artificial Sequence: Synthetic coding sequence
atgaagtggctgggggagagcaagatcatggtggtgaatggaagaagaaatggaggcaagctgagcaatgaccaccagcagaaccagagcaagctgcagcacacaggcaaggacaccctgaaggccggcaagaatgctgtggagaggaggagcaaccgctgcaatggaaacagcggctttgagggccagagccgctacgtgcccagcagcggcatgtctgccaaggagctgtgtgaaaatgatgacctggccaccagcctggtgctggacccctacctgggcttccagacccacaagatgaacaccagcgccttccccagccgcagcagccgccacttcagcaagagtgacagcttcagccacaacaaccctgtgcgcttccggcccatcaagggccggcaggaggagctgaaggaggtgattgagcgcttcaagaaggatgagcacctggagaaggccttcaagtgcctgaccagcggggagtgggcccggcactacttcctgaacaagaacaagatgcaggagaagctgttcaaggagcacgtgttcatctacctgaggatgtttgccacagattctggctttgagatcctgccctgcaaccgctacagcagcgagcagaatggagccaagatcgtggccaccaaggagtggaagagaaatgacaagattgagctgctggtgggctgcatcgccgagctgtctgaaattgaggagaacatgctgctgcggcatggagaaaatgacttctctgtgatgtacagcaccaggaagaactgtgcccagctgtggctgggccctgctgccttcatcaaccacgactgccggcccaactgcaagtttgtgtccacaggccgggacacagcctgtgtgaaggccctgcgggacatcgagcctggagaggagatcagctgctactatggagatggcttcttcggggagaacaatgagttctgtgagtgctacacctgtgagcggcggggcactggagccttcaagagccgggtgggcctgcctgccccagcccctgtgatcaacagcaaatatggcctgcgggagacagacaagaggctgaaccggctgaagaagctgggggacagcagcaagaacagcgacagccagagcgtgagcagcaacacagatgctgacaccacccaggagaagaacaatgccagcaagtag

SEQ ID NO: 172082 - DNA, 1182 bp, Artificial Sequence; identical to SEQ ID NO: 172081
  Description of Artificial Sequence: Synthetic coding sequence

SEQ ID NO: 172083 - DNA, 357 bp, Artificial Sequence
  Description of Artificial Sequence: Synthetic coding sequence
atgaagtggctgggggagagcaagatcatggtggtgaatggaagaagaaatggaggcaagctgagcaatgaccaccagcagaaccagagcaagctgcagcacacaggcaaggacaccctgaaggccggcaagaatgctgtggagaggaggagcaaccgctgcaatggaaacagcggctttgagggccagagccgctacgtgcccagcagcggcatgtctgccaaggagctgtgtgaaaatgatgacctggccaccagcctggtgctggacccctacctgggcttccagacccacaagatgaacaccagcgccttccccagccgcagcagccgccacttcagcaagagtgacagctag

SEQ ID NO: 172084 - DNA, 1389 bp, Artificial Sequence
  Description of Artificial Sequence: Synthetic coding sequence
atgggccctgacagagtgacagcccgggagctgtgtgaaaatgatgacctggccaccagcctggtgctggacccctacctgggcttccgcacccacaagatgaatgtgtcccctgtgccccccctgcggcggcagcagcacctgcggagcgccctggagaccttcctgcggcagagggacctggaggccgcctaccgggccctgaccctgggcggctggacagcccgctacttccagagccggggcccccggcaggaggccgccctgaagacccacgtgtaccgctacctgcgggccttcctgcctgagagcggcttcaccatcctgccctgcacccgctacagcatggagaccaatggagccaagatcgtgtccacccgggcctggaagaagaatgagaagctggagctgctggtgggctgcatcgccgagctgcgggaggctgatgagggcctgctgcgggctggagaaaatgacttcagcatcatgtacagcaccaggaagaggtctgcccagctgtggctgggccctgctgccttcatcaaccacgactgcaagcccaactgcaagtttgtgcctgcagatggaaatgctgcctgtgtgaaggtgctgcgggacatcgagcctggagatgaggtgacctgcttctatggagagggcttcttcggggagaagaatgagcactgtgagtgccacacctgtgagaggaaaggagagggcgccttccgcacccggccccgggagcccgccctgcccccccggcccctggacaagtaccagctgcgggagaccaagaggcggctgcagcagggcctggacagcggcagccggcagggcctgctgggcccccgggcctgtgtgcaccccagccccctgcggcgggaccccttctgtgccgcctgccagcccctgcggctgcctgcctgcagcgcccggccagacaccagccccctgtggctgcagtggctgccccagccccagccccgggtgcggcccaggaagagaagaagaccccggccccggcgggcccctgtgctgagcacccaccacgccgcccgggtgtccctgcaccgctggggcggctgcggcccccactgccgcctgcggggggaggccctggtggccctgggccagccccctcatgcccgctgggccccccagcaggactggcactgggcccggcgctatggcctgccctacgtggtgcgggtggacctgcggcggctggccccagcccccccagccaccccagccccagctggcaccccaggccccatcctgatccccaagcaggccctggcctttgcccccttcagcccccccaagaggctgcggctggtggtgagccacggcagcattgacctggatgtgggcggggaggagctgtag

SEQ ID NO: 172085 - DNA, 390 bp, Artificial Sequence
  Description of Artificial Sequence: Synthetic coding sequence
atgccccggcggggccgctggctgagctgcagccctgaggccgagggcatccggcgggtgggcagccgggccgccctgcgggtgcaccccctggagcaccggccccgctggggcacccctgggggcatgaccaagggcagccgcttcctggcccctgagagcgagctgtcctggggccctggagatgccaccccaggcctgtggttcttcatcagtgatggagtgggggaggacctgtggaacagcgctggctggagctctgtgcctgagggcttcggccagaggatgaggggccctggcctgaccccccacacagatgctggaggagatggcaacaagaggaggcacagcgagcggctgtgccgggcctctgtgctgcagcccccatag

SEQ ID NO: 172086 - DNA, 744 bp, Artificial Sequence
  Description of Artificial Sequence: Synthetic coding sequence
atgcacctggcccggctggtgggcagctgcagcctgctgctgctgctgggcgccctgagcggctgggccgccagtgatgaccccatcgagaaggtgattgagggcatcaacagaggcctgagcaatgctgagcgggaggtgggcaaggccctggatggcatcaacagcggcatcacccatgctggccgggaggtggagaaggtgttcaacggcctgagcaacatgggcagccacacaggcaaggagctggacaagggcgtgcagggcctgaaccacggcatggacaaggtggcccacgagatcaaccacggcatcggccaggccggcaaggaggccgagaagctgggccatggagtgaacaatgctgctggccaggccggcaaggaggccgacaaggctgtgcagggcttccacactggagtgcaccaggccggcaaggaggccgagaagctgggccagggcgtgaaccacgccgctgaccaggccggcaaggaggtggagaagctgggccagggcgcccaccacgccgccggccaggccggcaaggagctgcagaatgcccacaatggagtgaaccaggccagcaaggaggccaaccagctgctgaatggaaaccaccagagcggcagcagcagccaccagggcggggccaccaccacccccctggccagcggggcctctgtgaacacccccttcatcaacctgcctgccctgtggaggtctgtggccaacatcatgccctag

SEQ ID NO: 172087 - DNA, 1773 bp, Artificial Sequence
  Description of Artificial Sequence: Synthetic coding sequence
atgcacctggcccggctggtgggcagctgcagcctgctgctgctgctgggcgccctgagcggctgggccgccagtgatgaccccatcgagaaggtgattgagggcatcaacagaggcctgagcaatgctgagcgggaggtgggcaaggccctggatggcatcaacagcggcatcacccatgctggccgggaggtggagaaggtgttcaacggcctgagcaacatgggcagccacacaggcaaggagctggacaagggcgtgcagggcctgaaccacggcatggacaaggtggcccacgagatcaaccacggcatcggccaggccggcaaggaggccgagaagctgggccatggagtgaacaatgctgctggccaggtgggcaaggaggccgacaagctgatccaccacggcgtgcaccacggggccaaccaggccggcagcgaggccggcaagtttggccagggcgtggacaatgctgctggccaggccggaaatgaagctggccgcttcggccagggcgtgcaccacgccgccggccaggccggaaatgaagctggccgcttcggccagggcgtgcaccacgccgccggccaggccggaaatgaagctggccgcttcggccagggcgcccaccacggcctgtctgagggctggaaggagacagagaagtttggccagggcatccaccacgccgccggccaggtgggcaaggaggccgagaagtttggccagggcgcccaccacgccgccggccaggccggaaatgaagctggccgcttcggccagggcgtgcaccacggcctgtctgagggctggaaggagacagagaagtttggccagggcgtgcaccacacagctggccaggtgggcaaggaggccgagaagtttggccagggcgcccaccacgccgccggccaggccggaaatgaagctggccgcttcggccagggcgcccaccacgccgccggccaggccggaaatgaagctggccgcttcggccagggcgtgcaccacggcctgtctgagggctggaaggagacagagaagtttggccagggcgtgcaccacgccgccagccagtttgggaaggagacagagaagctgggccacggcgtgcaccacggcgtgaatgaggcctggaaggaggccgagaagtttggccagggcgtgcaccacgccgccagccaggtgggcaaggaggaggacagagtggtgcagggcctgcaccacggcgtgtcccaggccggccgggaggccggccagtttggacatgacatccaccacacagctggccaggccggcaaggagggggacattgctgtgcacggcgtgcagcccggggtgcatgaagctgggaaggaggccggccagtttggccagggcgtgcaccacaccctggagcaggccggcaaggaggccgacaaggctgtgcagggcttccacactggagtgcaccaggccggcaaggaggccgagaagctgggccagggcgtgaaccacgccgctgaccaggccggcaaggaggtggagaagctgggccagggcgcccaccacgccgccggccaggccggcaaggagctgcagaatgcccacaacggggtgaaccaggccagcaaggaggccaaccagctgctgaatggaaaccaccagagcggcagcagcagccaccagggcggggccaccaccacccccctggccagcggggcctctgtgaacacccccttcatcaacctgcctgccctgtggaggtctgtggccaacatcatgccctag

SEQ ID NO: 172088 - DNA, 288 bp, Artificial Sequence
  Description of Artificial Sequence: Synthetic coding sequence
atgggcagccacacaggcaaggagctggacaagggcgtgcagggcctgaaccacggcatggacaaggtggcccacgagatcaaccacggcatcggccaggccggcaaggaggccgagaagctgggccatggagtgaacaatgctgctggccagggcaaccaccagagcggcagcagcagccaccagggcggggccaccaccacccccctggccagcggggcctctgtgaacacccccttcatcaacctgcctgccctgtggaggtctgtggccaacatcatgccctag

SEQ ID NO: 172089 - DNA, 738 bp, Artificial Sequence
  Description of Artificial Sequence: Synthetic coding sequence
atgtggctgtgccccctggccctgaacctgatcctgatggccgccagcggggctgtgtgtgaggtgaaggatgtgtgtgtgggcagccctggcatccctggcaccccaggcagccacggcctgcccggcagagatggaagagatggcctgaagggggaccccggccccccaggccccatgggccccccaggagagatgccctgccccccaggaaatgatggcctgcccggggcccctggcatccctggagaatgtggggagaagggggagcctggagagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccaggaaccctgaggagaatgaggccatcgccagctttgtgaagaagtacaacacctacgcctacgtgggcctgacagagggccccagccctggggacttccgctacagtgatggcacccctgtgaactacaccaactggtacagaggagagcctgctggccggggcaaggagcagtgtgtggagatgtacacagatggccagtggaatgacaggaactgcctgtacagccggctgaccatctag

SEQ ID NO: 172090 - DNA, 570 bp, Artificial Sequence
  Description of Artificial Sequence: Synthetic coding sequence
atgggccccccaggagagatgccctgccccccaggaaatgatggcctgcccggggcccctggcatccctggagaatgtggggagaagggggagcccggggagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccagaaatccagaagaaaatgaggccatcgccagctttgtgaagaagtacaacacctacgcctacgtgggcctgacagagggccccagccctggggacttccgctacagtgatggcacccctgtgaactacaccaactggtacagaggagagcccgccggccggggcaaggagcagtgtgtggagatgtacacagatggccagtggaatgacaggaactgcctgtacagccggctgaccatctgtgagttctag
